United States Patent 11,098,302 (IDENTIFICATION OF POLYNUCLEOTIDES ASSOCIATED WITH A SAMPLE) - sequence listing, part 46

SEQ ID NO: 155886 - DNA, 514 bp, Homo sapiens
  misc_feature: GYAE6OF02IPZQZ.29.67.G01.1.454.CMB.1.raw
  modified_base (499)..(499): a, c, t, g, unknown or other
  misc_feature (499)..(499): n is a, c, g, or t
tcagatagagtactcacgaccggtgctcgatttagagtatacatattggggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatattttatatagctaccaacaataagaattacttagctggtaccagcagaaaccaggacagcctcctaagctgctcatttactggcatctacccgggaagtccggggtcctcgaccgattcagtggcagcgggtctgggacagactttcacactcagtattagcagctgcaggctagaagatgtggcctaatttatactgtacagactaatattatacctaccgtcccgacgttcgaccgaggaccgaggtggaagtcagaactacgngtagcagacacactc

SEQ ID NO: 155887 - DNA, 513 bp, Homo sapiens
  misc_feature: GYAE6OF02GD5BI.29.67.G01.1.454.CMB.1.raw
  modified_base (238)..(238): a, c, t, g, unknown or other
  misc_feature (238)..(238): n is a, c, g, or t
  modified_base (481)..(481): a, c, t, g, unknown or other
  misc_feature (481)..(481): n is a, c, g, or t
  modified_base (485)..(485): a, c, t, g, unknown or other
  misc_feature (485)..(485): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatattttanatagctccaacaataagaattacttagcttggtaccagcagaaccaggacagcctcctaagctgctcatttactggcatctacccgggaatccggggtccctgaccgattcagtggcagcgggtcgtgggacagatttccacactcagtattagcagcctgcaggctaggaagatgtggcctaattttattactgtcagactaattattactacctactcccggagttcgccgacggacaggngganagtacaacgagtgtcgctgcaccatccg

SEQ ID NO: 155888 - DNA, 502 bp, Homo sapiens
  misc_feature: GYAE6OF02IGDTN.29.67.G01.1.454.CMB.1.raw
  modified_base (238)..(238): a, c, t, g, unknown or other
  misc_feature (238)..(238): n is a, c, g, or t
  modified_base (294)..(294): a, c, t, g, unknown or other
  misc_feature (294)..(294): n is a, c, g, or t
  modified_base (312)..(312): a, c, t, g, unknown or other
  misc_feature (312)..(312): n is a, c, g, or t
  modified_base (361)..(361): a, c, t, g, unknown or other
  misc_feature (361)..(361): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatattttanatagctccaacaataagaattacttagcttggtaccagcagaaaccaggacagccnctaagctgctcatttacngggcatctacccgggaatccgggtcctgaccgattcagtgcagcggtcngggacagagtttcacactcagtattagcagcctgcaggctgaagatgtcggacctatttactactgtcagcaattatatactactcccggagttcgcgagacaaggtgagagtacaacgaacgtgtggactgacaccatcg

SEQ ID NO: 155889 - DNA, 588 bp, Homo sapiens
  misc_feature: GYAE6OF02IEJ85.29.67.G01.1.454.CMB.1.raw
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatattttatatagctaccaacaataagaattacttagcttggtaccagcaagaaaccaggacagcctcctaagctgctcatttactgggcatccgtacccggaagtcccgggtcctgacccgattcagtcggcgacgcgggtctgggacaggtactttcactactagaaatcgaggccgggtggaggcgtggaggagtggttggctatttattattgtcattgactaagtttacacgtcttgttacgttacgttttcggaccgtacggggtaccctacgttaccgtacggtaactaacgttaccgaaaccgtaacgttacggttcggtccgtcggtaccaacccgtacttcgttaccgg

SEQ ID NO: 155890 - DNA, 574 bp, Homo sapiens
  misc_feature: GYAE6OF02IP0ZP.29.67.G01.1.454.CMB.1.raw
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatattttatatagctaccaacaataagaattacttagcttggtaccagcaagaaaccaggacagcctacctaagctgctcactttactgggcatccgtacccggaacgttccgggtcctgaccgtattcagtgcagcgggtctgggacagactttcacgtactcagttatagcagtcctgcaggctgaagatggtgcctaagtttattactgttaccagtactaaattacttataaccgttacctaccccggaacgttcggaccgtaacggggacctaagggtcggaacggaactaccgaaacgtaacgttacggtacggtccgttaggacccaaccgtataccg

SEQ ID NO: 155891 - DNA, 597 bp, Homo sapiens
  misc_feature: GYAE6OF02IRC2E.29.67.G01.1.454.CMB.1.raw
  modified_base (140)..(140): a, c, t, g, unknown or other
  misc_feature (140)..(140): n is a, c, g, or t
  modified_base (237)..(237): a, c, t, g, unknown or other
  misc_feature (237)..(237): n is a, c, g, or t
  modified_base (324)..(324): a, c, t, g, unknown or other
  misc_feature (324)..(324): n is a, c, g, or t
  modified_base (446)..(446): a, c, t, g, unknown or other
  misc_feature (446)..(446): n is a, c, g, or t
  modified_base (466)..(466): a, c, t, g, unknown or other
  misc_feature (466)..(466): n is a, c, g, or t
tcagatagagtactcacgaccggtgctcgatttagagtatacatattggggtttgggggagctacaacaggcaggcaggggcagcaagatggtgttgcagacccaggtcttcatttctctgttgctctggatctctggtncctacggggacatcgtgatgacccagtctccagactccctggctgtgttctgggcgagagggccaccatcaactgcaagtccagccagaatatttanatagctacaacaataaagaattacttagctttaggaaccagacaagaaaccaggtacacgcctacctaaagctagctacaatttcgnggacagtccgtaaccggggaacgtccgggtcctagacccgatttcgaagtcggcaggcgggtactcggggaacaggtatttcaacgctgatagtacgcacgtctagcgaaggctagaagtangtcggcctagtttatacgtntacgtaagactaattaacttaatacctaccgtaccggtacgttacggaccgtaccggtaacgaacgggttacgaacggacgtaacgaaaccgtaacgtacggtacggtacgtacggacgtaccaattccgg

SEQ ID NO: 155892 - DNA, 131 bp, Homo sapiens; identical to SEQ ID NO: 155600
  misc_feature: GYAE6OF02G0OAV.29.67.G01.1.454.CMB.1.raw
  modified_base (130)..(131): a, c, t, g, unknown or other
  misc_feature (130)..(131): n is a, c, g, or t

SEQ ID NO: 155893 - DNA, 499 bp, Homo sapiens
  misc_feature: GYAE6OF02GG36B.29.67.G01.1.454.CMB.1.raw
  modified_base (238)..(238): a, c, t, g, unknown or other
  misc_feature (238)..(238): n is a, c, g, or t
  modified_base (409)..(409): a, c, t, g, unknown or other
  misc_feature (409)..(409): n is a, c, g, or t
  modified_base (483)..(483): a, c, t, g, unknown or other
  misc_feature (483)..(483): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatattttanatagctaccaacaataagaattacttagcttggtaccagcagaaaccaggacagcctcctaagctgctcatttactggcatctacccgggaatccggggtccctgaccgattcagtgcagcgggtctgggacagatttcacactcagtattagcagcctgcaggctgaagntgtgctatttatacgtgtcagcaatatatactactcccgagtcgcacggacaagtcggagatacaacgaactgnggtctgactaccatcg

SEQ ID NO: 155894 - DNA, 520 bp, Homo sapiens
  misc_feature: GYAE6OF02H7KVW.29.67.G01.1.454.CMB.1.raw
  modified_base (238)..(238): a, c, t, g, unknown or other
  misc_feature (238)..(238): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatattttanatagctccaacaataagaattacttagcttggtaccagcagaaaccaggacagcctcctaagctgctcatttactgggcatctaccgggaatccggggtccctgacccgattcagtggcagcggtctggacagatttcacactcagtattagcagcctgcaggctgaagatgtggcctaagttttatactgtcagtcaattatatactactccccggtagttcgaccacgggaccaaggtcggaagagtacgaaacgacgtagtcgacgtcgacaccgatcg

SEQ ID NO: 155895 - DNA, 508 bp, Homo sapiens
  misc_feature: GYAE6OF02HPNI8.29.67.G01.1.454.CMB.1.raw
  modified_base (403)..(403): a, c, t, g, unknown or other
  misc_feature (403)..(403): n is a, c, g, or t
  modified_base (415)..(415): a, c, t, g, unknown or other
  misc_feature (415)..(415): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatattttatatagctccaacaataagaattacttagcttggtaccagcagaaaccaggacagcctcctaagctgctcatttactgggcatcgtaccggaatccgggtcctgaccgattcagtggcagcgggtctgggacagtactttcactactcaagtattagcacgcctgcnggctgaagatgngcctatttatactgtcagcaatatatactactcccgacgtcgccaggacgaaggtggagatacgaacgtaagagtaggacgtcgacaccatcg

SEQ ID NO: 155896 - DNA, 559 bp, Homo sapiens
  misc_feature: GYAE6OF02IK5UC.29.67.G01.1.454.CMB.1.raw
  modified_base (414)..(414): a, c, t, g, unknown or other
  misc_feature (414)..(414): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaattattttatatagctccaacaataagaactacttagcttggtaccagcagaaaccaggacagcctacctaagctgctcatttactgggcatctacccgggaatccggggtcctgaccgattcagtggcaggcgggtctgggacaggtatttcacactcagtattagcacgctgcaggctgaagntgtggctatttactactgtacagctaattattaactaaccgttacccgttccccggtaacgttccggaccgtaacggggtaaccgtaacgggtacggaacgactaaccgaacgtaacgtggtacggaccgtgaccgacctatccg

SEQ ID NO: 155897 - DNA, 501 bp, Homo sapiens
  misc_feature: GYAE6OF02GE9WM.29.67.G01.1.454.CMB.1.raw
  modified_base (238)..(238): a, c, t, g, unknown or other
  misc_feature (238)..(238): n is a, c, g, or t
  modified_base (410)..(410): a, c, t, g, unknown or other
  misc_feature (410)..(410): n is a, c, g, or t
  modified_base (418)..(418): a, c, t, g, unknown or other
  misc_feature (418)..(418): n is a, c, g, or t
  modified_base (427)..(427): a, c, t, g, unknown or other
  misc_feature (427)..(427): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatattttanatagctaccaacaataagaattacttagcttggtaccagcaagaaaccaggacagcctacctaagctgctcatttactggcatcctacccggaatcccgggtcctgaccgtatcagtgcagcgggtctgggacagacttcacactcagtatagcagctgcagctagagatgngctatttntactgtcantaatattatactactcccgtacgttcgccgacggaccgaggtggagatacgaacgacgtgacgctgacacatcg

SEQ ID NO: 155898 - DNA, 498 bp, Homo sapiens
  misc_feature: GYAE6OF02FKUJ5.29.67.G01.1.454.CMB.1.raw
  modified_base (471)..(471): a, c, t, g, unknown or other
  misc_feature (471)..(471): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatattttatatagctccaacaataagaattacttagcttggtaccagcagaaccaggacagcctcctaagctgctcatttactgggcatctacccgggaatccggggtccctgaccgattcagtggcagcggtctgggacagatttcacactcagtattagcagcctgcaggctgaagatgtggcctatttattactgtcagcaatattatactactcccgagttcgccaggacaggtgganagtcaacgactagtggcgtgcacatcg

SEQ ID NO: 155899 - DNA, 509 bp, Homo sapiens
  misc_feature: GYAE6OF02IJ4YF.29.67.G01.1.454.CMB.1.raw
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaattattttatatagctaccaacaataaagaattacttagcttggtaccagcagaaaccaggacagcctcctaagctgctcatttactgggcatctacccggaatccgggtcctgaccgattcagtggcagcgggtctgggacagatttcacactcagtatagcagcctgcaggctgaagatgtggcctatttatactgtcagctaatattatactactccccggacgttcgccagggaccaaggtggagagtacaaacgaactgtaggctgcaccatccg

SEQ ID NO: 155900 - DNA, 571 bp, Homo sapiens
  misc_feature: GYAE6OF02JMCYL.29.67.G01.1.454.CMB.1.raw
  modified_base (238)..(238): a, c, t, g, unknown or other
  misc_feature (238)..(238): n is a, c, g, or t
  modified_base (314)..(314): a, c, t, g, unknown or other
  misc_feature (314)..(314): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatattttanatagctccaacaataagaattacttagcttggtaccagacagaaaccaggacagcctcctaagctgctcatttacnggcatcctacccgggaatccgggtccctgaccgattcagtggcacggcgggtcgtgggacaggtactttcactactcgaagtattagcacggtctagcgaggcctgaaggatgtcggtctaagtttatactgtaccagtactaataatttactaaccgtaccgtacccggtagttccggaccgtaggaaccgtaacggtacgggtacacgtaaccgaaacgtaacgtacgtcggtaccgtcgactaccgagttaccg

SEQ ID NO: 155901 - DNA, 137 bp, Homo sapiens
  misc_feature: GYAE6OF02G0C93.29.67.G01.1.454.CMB.1.raw
  modified_base (130)..(137): a, c, t, g, unknown or other
  misc_feature (130)..(137): n is a, c, g, or t
tcagatagagtactcacgaccggtgctcgatttagagtatacatattgggtttgggcacagcggccctgggctgcctggtcaaggactacttccagtactctatctgagcgggctggcaaggcgcatagnnnnnnnn

SEQ ID NO: 155902 - DNA, 508 bp, Homo sapiens
  misc_feature: GYAE6OF02F16MX.29.67.G01.1.454.CMB.1.raw
  modified_base (238)..(238): a, c, t, g, unknown or other
  misc_feature (238)..(238): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatattttanatagctccaacaataagaattacttagcttggtaccagcagaaaccaggacagcctcctaagctgctcatttactgggcatctacccgggaatccggggtccctgaccgattcagtggcagcgggtctgggacagatttcacactcagtattagcagcctgcaggctgaagatgtggccatttattactgtcagcaatattatactacctcccggacgttcgccaggacacggtaggagatacaacgaactagtcgacgtgcacgatacg

SEQ ID NO: 155903 - DNA, 520 bp, Homo sapiens
  misc_feature: GYAE6OF02GU6JU.29.67.G01.1.454.CMB.1.raw
  modified_base (238)..(238): a, c, t, g, unknown or other
  misc_feature (238)..(238): n is a, c, g, or t
  modified_base (313)..(313): a, c, t, g, unknown or other
  misc_feature (313)..(313): n is a, c, g, or t
  modified_base (362)..(362): a, c, t, g, unknown or other
  misc_feature (362)..(362): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatattttanatagctccaacaataagaattacttagcttggtaccagcagaaaccaggacagcctcctaagctgctcatttacngggcatctacccgggaatccgggtccctgaccgatcagtgcagcgggtntgggacagatttcacactcatattagcagcctgcaggctgaagtatgtgccatttatactgtcagctaaatattatactaccgtcccgacgttcgaccgacggaccgaacggtaggagaagtaccgaaacgaacgtacgtggactacgacaccatacg

SEQ ID NO: 155904 - DNA, 542 bp, Homo sapiens
  misc_feature: GYAE6OF02IELEK.29.67.G01.1.454.CMB.1.raw
  modified_base (326)..(326): a, c, t, g, unknown or other
  misc_feature (326)..(326): n is a, c, g, or t
  modified_base (380)..(380): a, c, t, g, unknown or other
  misc_feature (380)..(380): n is a, c, g, or t
  modified_base (393)..(393): a, c, t, g, unknown or other
  misc_feature (393)..(393): n is a, c, g, or t
tcagatagagtactcacgaccggtgctcgatttagagtatacatattgggtttgggggagctacaacaggcaggcaggggcagcaagatggtgttgcagacccaggtacttcatttctctgttgctctggatctctggtgcctacggggacatcgtgatgacccagtctccagactcccgtggctgtgtttctgggcgaggagggccacgatcaactgcaacgtccagccagaaactattttactatacgccttaccaacaataacgaattacttagcttggtaccagcagaaaccaggacacgcctcctaagctgctcatttacnggcatctacccggaatccgggtcctgacccgtatcagtgcgagcggtctggacngatttcactactnagtatagcagctgcaggctagaagatgtcgacctatttatactgtcagctaatattatacttaccgtaccccggtagtcggaccaggggaccgtaagggtggacgtagtacgtaaacgaacgtggtacggtcgtacggtcaccattccg

SEQ ID NO: 155905 - DNA, 571 bp, Homo sapiens
  misc_feature: GYAE6OF02ILIO7.29.67.G01.1.454.CMB.1.raw
  modified_base (423)..(423): a, c, t, g, unknown or other
  misc_feature (423)..(423): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaattattttatatagctaccaacaataagaattacttagcttggtaccagcagaaaccaggacagcctacctaagctgctacatttactggcatccgtaacccgggagtcccgggtccctgaccgtattacagtcggcaggcgggtcgtaggacagtactttcactactcagtattagcagcctgcagctagaanagtgacgtacctatttactactgtacagtactaagttaattactacctaccgtccccggtacgttcggtaccgaacgggtaaccgtaagggtacggaaggactaacgaacgaaacgttcggtaggtcgtacgacgtacctacttaccg

SEQ ID NO: 155906 - DNA, 518 bp, Homo sapiens
  misc_feature: GYAE6OF02GZFIK.29.67.G01.1.454.CMB.1.raw
  modified_base (238)..(238): a, c, t, g, unknown or other
  misc_feature (238)..(238): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatattttanatagctccaacaataagaattacttagcttggtaccagcagaaaccaggacagcctcctaagctgctcatttactggcatctaccgggaatccggggtcctgaccgatcagtggcaggcgggtctgggacagattttacactcagtatagcagcctgcaggctagagatgtggcctagttattactgtcagctaatagttatactacctcccggtacgttcgccgaaggacgaggtaggagtacgtacaaacgacgtagtcgtctcgacactactctacg

SEQ ID NO: 155907 - DNA, 591 bp, Homo sapiens
  misc_feature: GYAE6OF02HXN6G.29.67.G01.1.454.CMB.1.raw
  modified_base (239)..(239): a, c, t, g, unknown or other
  misc_feature (239)..(239): n is a, c, g, or t
  modified_base (380)..(380): a, c, t, g, unknown or other
  misc_feature (380)..(380): n is a, c, g, or t
tcagatagagtactcacgaccggtgctcgatttagagtatacatattgggtttgggggagctacaacaggcaggcaggggcagcaagatggtgttgcagacccaggtcttcattttctctgttgctctggatctctggtgcctacggggacatcgtgatgacccagtctccagactccctggctgtgtttctgggcgagaggccaccatcaactgcaagtccagccagaattattttanatagctaccaacaaataagaaattacttagtcttaggtaccagcaagaaaccaggacagcctacctaagctgcctctatttactgggcatccgtaacccgggtatcccggggtccctcgaccgattcagtgcgagcgggtntgggacagatttcacactcagtatagcacgtcctgcaggctagaagagtggtaggtccctagtttacttacgttgtactagactaaattacttaactaccttaccgtaccccggtacgttcgacccgaacgggtaccgtaacgggtacggtaaggtaactaacgtaaacgtacgtacgtacggtccgtacgtaccgtacccgtattacccg

SEQ ID NO: 155908 - DNA, 506 bp, Homo sapiens
  misc_feature: GYAE6OF02IPK13.29.67.G01.1.454.CMB.1.raw
  modified_base (237)..(237): a, c, t, g, unknown or other
  misc_feature (237)..(237): n is a, c, g, or t
  modified_base (311)..(311): a, c, t, g, unknown or other
  misc_feature (311)..(311): n is a, c, g, or t
  modified_base (391)..(391): a, c, t, g, unknown or other
  misc_feature (391)..(391): n is a, c, g, or t
  modified_base (400)..(400): a, c, t, g, unknown or other
  misc_feature (400)..(400): n is a, c, g, or t
  modified_base (504)..(504): a, c, t, g, unknown or other
  misc_feature (504)..(504): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctggcgagagggccaccatcaactgcaagtccagccagaatattttanatagctccaacaataagaattacttagcttggtaccagcagaaaccaggacagcctctaagctgctcatttacnggcatctaccggaatccgggcctgaccgattcagtgcgagcgggtctgggacagatttcacactcagtatagcagctgcnggctgaagntgtggtacctatttatactgtcagtacaattattactactacctcccggacgttcgaccaggacctaaggtcggagactacgaaacgaactgtcggctgcactntc

SEQ ID NO: 155909 - DNA, 506 bp, Homo sapiens
  misc_feature: GYAE6OF02FXKR8.29.67.G01.1.454.CMB.1.raw
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatattttatatagctccaacaataagaattacttagcttggtaccagcagaaaccaggacagcctcctaagctgctcatttactgggcatctacccgggaatccggggtcctgaccgattcagtggcagcggtctgggacagatttcacactcagtattagcagcctgcaggctgaagatgtgccatttattactgtcagcaatattatactactcccggattcggaccagggaccaaggtggagatacgaacgaacgtgtcggcgtgcaccgatcg

SEQ ID NO: 155910 - DNA, 521 bp, Homo sapiens
  misc_feature: GYAE6OF02FS82F.29.67.G01.1.454.CMB.1.raw
  modified_base (238)..(238): a, c, t, g, unknown or other
  misc_feature (238)..(238): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatattttanatagctccaacaataagaattacttagcttggtaccagcagaaaccaggacagcctcctaagctgctcatttactgggcatctacccgggaatccggggtccctgaccgattcagtggcaggcgggtctgggacagattcacactcagtatagcagcctgcaggctgaagatgtgcctatttatactgtcagctaatattactactactcccggacgtcgccgacggaccgaaggtggagacgtacgaaaccgaacgttagtacggtcgtacgcacctagtcc

SEQ ID NO: 155911 - DNA, 694 bp, Homo sapiens
  misc_feature: GYAE6OF02IS7KS.29.67.G01.1.454.CMB.1.raw
  modified_base (238)..(238): a, c, t, g, unknown or other
  misc_feature (238)..(238): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacgggacatcgtgatgacccagtctccagacctccctggctgtgtttctgggcgagaggccaccatcaactgcaagtccagccagaattattttanatagctacaacaataagaattactagcttaggtaccagcaagaaaccaggacagaccctactaacgctgactctatttacgtggactatccgtaacccgggaacgtcccggggtaccctacggtaacccgacgtttaccgaggttcgggacctaagggtcccggggtacgtacggggaactaaggtacttttaccgaactaaccgttacgtaaggtttacttaacggccaacggtccgtaggtccgacgggttctacggaaagtcttcgggacggtaccctaagttttactaccgttaggtacctaaggtactaaacgtttacttaacgttaacccgttaccgtaccccggtacgttacgtacccggtaacgggaccgtaaacgggtacggtacgaacgtaaccgtaaacggtaaccgttagtacggtacggtaccgtacgtaccgtacgttaccg

SEQ ID NO: 155912 - DNA, 606 bp, Homo sapiens
  misc_feature: GYAE6OF02HQPLX.29.67.G01.1.454.CMB.1.raw
  modified_base (238)..(238): a, c, t, g, unknown or other
  misc_feature (238)..(238): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatattttanatagctaccaacaataagtaattacttagcttggtaccagacagaaaccaggacacgcctacctaagctgctctactttactgggcatccgtacccgggtaacgtccggggtcctcgaccgtattcgagtggcgaggcgggtcgtgggacagactttacactactacagttattacgcacgtcctagcgaggctaggaagtagtcggtacggtacctaatttatttaacgttgtacacgtactaattactttaataccttacccgtcccggtaaccgttccgtaccggtacggtaaccggtaacgggtaggtaacggacgtaaccgaaacgtaacgtacggtacggtcgtacggaccactacttaccg

SEQ ID NO: 155913 - DNA, 680 bp, Homo sapiens
  misc_feature: GYAE6OF02I2XVN.29.67.G01.1.454.CMB.1.raw
  modified_base (241)..(241): a, c, t, g, unknown or other
  misc_feature (241)..(241): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctggcgagacggccaccatcaactgaccaagtccacgccagaattattttanatagctaccaacaataagaattacttagacttggtaaccagcaagtaaacccaggacagaccctacctaaagctagctctaatttacgtcgggacaagttccctaacccgggggtaaccgtcccggggttcccctacggtaacccgtacttcgaaggttccggactacgggcgggttcgaggggtactagtaacgttttccaactacgtctaagttacttaacgcaggtccctgactagggcctaaggtaactagtcggttcgaccgttaacttttacttacgttcgtacgaacgttaactaatttaacttactacccgttaacccggttaccccgggacgtttaaccgaccggtaacgggtaaccgaacgggtacgtaaagtaacgtaccggaaacgttaacggtacgtcggtacctacgacccgtactacttacccg

SEQ ID NO: 155914 - DNA, 531 bp, Homo sapiens
  misc_feature: GYAE6OF02ISQR9.29.67.G01.1.454.CMB.1.raw
  modified_base (240)..(240): a, c, t, g, unknown or other
  misc_feature (240)..(240): n is a, c, g, or t
  modified_base (317)..(317): a, c, t, g, unknown or other
  misc_feature (317)..(317): n is a, c, g, or t
  modified_base (365)..(365): a, c, t, g, unknown or other
  misc_feature (365)..(365): n is a, c, g, or t
  modified_base (409)..(409): a, c, t, g, unknown or other
  misc_feature (409)..(409): n is a, c, g, or t
  modified_base (524)..(524): a, c, t, g, unknown or other
  misc_feature (524)..(524): n is a, c, g, or t
tcagatagagtactcacgaccggtgctcgatttagagtatacatattgggtttgggggagctacaacaggcaggcaggggcagcaagatggtgttgtagacccaggtcttcatttctctgttgctctggatctctggtgcctacggggacatcgtgatgacccagtctccagactccctggctgtgtttctgggcgagagggcccaccatcaactgcaagtccagccaagaatattttanatagctccaaacaataagaattacttagcttaggtaccagcagaaaccaggacagcctctaagctgctcatttacgnggcatcctacccgggatcccgggtcctcgaccatcagtgcagcggtcnggacagtattcacactcagtatagcagcctgcaggctagaagtntggtggacttatttattactgtacagactaatattataccgttaccgtcccgtacgttccgacgaacgtacgaaggtagggaatacgaacaaacgagtaggtaggctagacaccngtctacg

SEQ ID NO: 155915 - DNA, 520 bp, Homo sapiens
  misc_feature: GYAE6OF02IE14P.29.67.G01.1.454.CMB.1.raw
  modified_base (236)..(236): a, c, t, g, unknown or other
  misc_feature (236)..(236): n is a, c, g, or t
  modified_base (313)..(313): a, c, t, g, unknown or other
  misc_feature (313)..(313): n is a, c, g, or t
  modified_base (406)..(406): a, c, t, g, unknown or other
  misc_feature (406)..(406): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgttctgggcagaggccaccatcaactgcaagtccagccagaattattttanatagctaccaacaataagaattacttagcttggtaccagcaagaaccaggacagcctacctaagctgctcatttacnggcatcgtacccggatccgggtcctgaccgattcagtgcagcggtctggacagtctttcacactcagtactagcagcctgctaggctagaagntgtcgctatttatactgtcagactaatattataccttacgtcccgtacgttcgaccgtaggacctaggtaggactactacgaaacgaacgtggacgtcgtacgactaccattcg

SEQ ID NO: 155916 - DNA, 539 bp, Homo sapiens
  misc_feature: GYAE6OF02GTXSN.29.67.G01.1.454.CMB.1.raw
  modified_base (238)..(238): a, c, t, g, unknown or other
  misc_feature (238)..(238): n is a, c, g, or t
  modified_base (312)..(312): a, c, t, g, unknown or other
  misc_feature (312)..(312): n is a, c, g, or t
  modified_base (405)..(405): a, c, t, g, unknown or other
  misc_feature (405)..(405): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaacttcaagtccagccagaatattttanatagctcaacaataagaattacttagcttggtaccagcagaaaccaggacagcctcctaagctgctcatttacngggcatctacccgggaatccgggtcctgaccgattcagtgcagcggtctgggacagatttcacgactcagtatagcagcctgcaggctgaagntgtggcctatttatactgtacagactaattattatacctaccgtccccggtacgttccggaccgaacgggtaccgaaggtacggaagtacgtacgaaacgtaacctaggtacgcgtagaccaccgtatcgttcg

SEQ ID NO: 155917 - DNA, 527 bp, Homo sapiens
  misc_feature: GYAE6OF02HZ224.29.67.G01.1.454.CMB.1.raw
  modified_base (238)..(238): a, c, t, g, unknown or other
  misc_feature (238)..(238): n is a, c, g, or t
  modified_base (402)..(402): a, c, t, g, unknown or other
  misc_feature (402)..(402): n is a, c, g, or t
  modified_base (407)..(407): a, c, t, g, unknown or other
  misc_feature (407)..(407): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatattttanatagctcaacaataagaattactagcttggtaccagcagaaaccaggacagcctcctaagctgctcatttactggcatctaccggatccgggtcctgaccgattcagtcggcaggcggtctgggacagtattcacactcagtattagcagctgcaggctagaanagtgngcctatttactactgtcagctaatattactactaccgtacccggacgttccgacgacggacgtaagggtacgacggactaacgaaacgacgtacggtcggtactcggacaccgtataccg

SEQ ID NO: 155918 - DNA, 550 bp, Homo sapiens
  misc_feature: GYAE6OF02H6WF4.29.67.G01.1.454.CMB.1.raw
  modified_base (239)..(239): a, c, t, g, unknown or other
  misc_feature (239)..(239): n is a, c, g, or t
  modified_base (321)..(321): a, c, t, g, unknown or other
  misc_feature (321)..(321): n is a, c, g, or t
  modified_base (425)..(425): a, c, t, g, unknown or other
  misc_feature (425)..(425): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaattattttanatagctaccaaacaataagtaattaacttagcttggtaaccagcaagaaaccaggacagcctcctaagctgctcatttacgnggcatccgtaaccgggaagtccgggtcctaggacctatttcaggtggcaggcgggtcgtcgggaacagtactttcactactcagtatagcagctgcagctagantgcgtctatttactactgtcagctaattattactacttaacccgtcccggtacgttccggaccgacgggtaccaagggtggaacgataacgaaacgtaacgtgtacggcctagacctacctatcg

SEQ ID NO: 155919 - DNA, 539 bp, Homo sapiens
  misc_feature: GYAE6OF02F1XF9.29.67.G01.1.454.CMB.1.raw
  modified_base (314)..(314): a, c, t, g, unknown or other
  misc_feature (314)..(314): n is a, c, g, or t
  modified_base (369)..(369): a, c, t, g, unknown or other
  misc_feature (369)..(369): n is a, c, g, or t
  modified_base (410)..(410): a, c, t, g, unknown or other
  misc_feature (410)..(410): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatattttatatagctccaacaataagaattacttagcttggtaccagcagaaaccaggacagcctacctaagctgctcatttacnggcatctacccggggaactccggggtccctgaccgtattcagtggcaggcgggtngggacagtatttcacactctagtattagcagctgcaggtcnggaagatgtggacctatttatacttgtcatcaattattactactactaccccggtagttccgccgacggacgaacggtggaacgtataaccgtaaacgacgtgtcggtaccgtaggaccaccgtatccg

SEQ ID NO: 155920 - DNA, 705 bp, Homo sapiens
  misc_feature: GYAE6OF02JFVOI.29.67.G01.1.454.CMB.1.raw
  modified_base (199)..(199): a, c, t, g, unknown or other
  misc_feature (199)..(199): n is a, c, g, or t
tcagatagagtactcacgaccggtgctcgatttagagtatacatattgggtttgggggtagctacaacaggcaggcaggggcagcaagatggtgttgcagacccaggtcttcatttctctgttgctctggatctctggtgcctacggggacatcgtgatgacccagtctccagactcctggctgtgtttctgggcgagngggccaccatcaactgcaagtccagccagaatattttatatagctaccaacaactaaagaattacttagtacttggtaccagacagaaaccaggacagacctactaacgctgctactatttactacggtcatccgtacccgggtaacgtcccggggtccctacggaccgtacgttacgaggttacggcgaacggtccggggtctagggggacctacgggtacttttccaactacgtaccgtagttaaactttaggactacggtacccgttagccgtagggcttacggtaacgtagtcggttacgggccttaagtttacgttaccgttagtaccgtacgtaacctaaattaacgtttaaccttaacgttaacccgttacccccgggttaaccgttaccggtacccgtaaccgggtaaccggaaccgggtaacgggtaacggtaacgtaacgtaaacccggaacgttaacgggttcggtacgtacggtaccgtaccgtaacttcccgg

SEQ ID NO: 155921 - DNA, 637 bp, Homo sapiens
  misc_feature: GYAE6OF02H6PK8.29.67.G01.1.454.CMB.1.raw
  modified_base (195)..(195): a, c, t, g, unknown or other
  misc_feature (195)..(195): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgccgtacggggacatcgtgatgacccagtctccagactcccgtggctgttgtttcgnggcgagagggccaccatccaactgcagtccagccagaatattttatatagcttaccaacaataagaattacttagcttggtaccacagaaccaggacagccctactagctgctctactttacgtgggctactccgtaacccgggtaagtcccggggtccctgaacccgtattccgaaggttcggaccacggtccgggttcgtaggggtaactaggtacgtttaccacgtacgttacgagttaagttacggacgtagtcccttgcgtacggctaggaagtagtcggtagaccttagttttactacgtagttccgagacgtaattattaactaccgttaccgtccccggtagttccgaccgaacgggacccgtaggtacgggcgtaacgtaaccgtaaacgtacgtacggttcggacgtcgacccgtaacctaccgtgttaccg

SEQ ID NO: 155922 - DNA, 131 bp, Homo sapiens; identical to SEQ ID NO: 155600
  misc_feature: GYAE6OF02I3ZCD.29.67.G01.1.454.CMB.1.raw
  modified_base (130)..(131): a, c, t, g, unknown or other
  misc_feature (130)..(131): n is a, c, g, or t

SEQ ID NO: 155923 - DNA, 609 bp, Homo sapiens
  misc_feature: GYAE6OF02JU714.29.67.G01.1.454.CMB.1.raw
  modified_base (191)..(191): a, c, t, g, unknown or other
  misc_feature (191)..(191): n is a, c, g, or t
  modified_base (311)..(311): a, c, t, g, unknown or other
  misc_feature (311)..(311): n is a, c, g, or t
  modified_base (387)..(387): a, c, t, g, unknown or other
  misc_feature (387)..(387): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttcngggcgagagggccaccatcaactgcaagtccagccagatatttaatagctccaacataagattactagcttaggtaccagcaagaaccaggacagcctacctaagctgctctatttacgnggcagtccgacccgggaatcccggggtccctagacccgtatcgagtggacaggcggtcgtgggactagtattcacnctacagtagtacgcagccgtgacgaggtctagaagtacgtgtcggtacccttaagttttacttacgttgtacacgttaacgtaacgttatttaaccgtaaccgttacccgttaccccggtaaccggtttaccggacccgtaacgggaccgtaacgggtacgtaacggtaacgtaacgtaaccggtaaccgtagggtcggtaccaggtaccacctagttaccg

SEQ ID NO: 155924 - DNA, 777 bp, Homo sapiens
  misc_feature: GYAE6OF02HXS45.29.67.G01.1.454.CMB.1.raw
tcagatagagtactcacgaccggtgctcgatttagagtatacatattgggtttgggggagctacaacaggcaggcaggggcagcaagatggtgttgcagacccaggtcttctatttctctgttgctcgtggatctcgtggtcgccgtacgggacagtcgtgatcgaccctagtcctccgagtacctcccgtggtcttgttcgtttcgcgggacgaggacggcccaaccgtactacaactgacgtaacgtccacgacctaagtaatttattttaatagtacgcctaaccaaactaaagtaagtaactttaacgtagttcgttacggtaaccagacgtaacgaaaccgaggaccacgtaccctacgtaagtcgtcgtacctacgttactttacggtcggacttaaccgttacccgggtaacccgggtaacggtccccgggttcctaacggtacccgttagttacgacggttcggaccgtacggggtccgggttcggtacgggaaccttacggttagtttaccaaccgttacttacgtaacgtttaacgttaccggacgtaacggtcccgttaggaccgaacggttcgaagtaacggttagttcgggtacgtaccttttaagttactaacgttcgaacgagtaactaagttaacttacgtaacccttacccggtacccgtagttacccggaacgtaccgggtaaccgtaagggtccggtaagtacgaaaccgtaaacggacttacgggtccgtaacgcccgtaactaccgtacgttaccg

SEQ ID NO: 155925 - DNA, 535 bp, Homo sapiens
  misc_feature: GYAE6OF02F8STG.29.67.G01.1.454.CMB.1.raw
  modified_base (243)..(243): a, c, t, g, unknown or other
  misc_feature (243)..(243): n is a, c, g, or t
tcagatagagtactcacgaccggtgctcgatttagagtatacatattgggtttgggggagctacaacaggcaggcaggggcagcaagatggtgttggcagacccaggtcttcagtttctctgttgctctggatctctggtgcctaacggggacatcgtgatgacccagtctccagactccctggctgtgtttctgggcgagagggccaccagtcaactgcaagtccaggccagaatattttanatagctcacataagaatactagcttggtaccagcagaaaccaggacagcctcctaagctgctcatttactgggcatctaccggaatcggggtcctgaccgattcagtgcagcggtctgggacagattcacactcagtattagcagcctgcaggctgaagatgtaggacctaattttaattacttgttcagcaatattatactaacgtacccggacgttacggtaccaacgggtaccaacgggggtgaaggacgtacaaacgaacgtacgtacggtcgtagtctaccgatacg

SEQ ID NO: 155926 - DNA, 579 bp, Homo sapiens
  misc_feature: GYAE6OF02F6XVT.29.67.G01.1.454.CMB.1.raw
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatattttatatagctccaacaataagaattacttagcttaggtaccagcagaaccaggacagcctctaagctgctcattctggcatctacccgggatccgggtcctcgaccgattcagtcggcaggcggtctgggacagatttcacactcagtatagcagctgcaggctagaagtatggtacgcctaattttacttacgttgtacgacgtactaaatttattaacttaccgttaaccgttaccccggtaccggtttaccgacccgtaacgggtaccgtaacgggtcgggaagtaacgtaccgtaaaacgaaccgttaggtcggtaccgtaggtaccgtacctagttaccg

SEQ ID NO: 155927 - DNA, 566 bp, Homo sapiens
  misc_feature: GYAE6OF02GIDRN.29.67.G01.1.454.CMB.1.raw
  modified_base (240)..(240): a, c, t, g, unknown or other
  misc_feature (240)..(240): n is a, c, g, or t
  modified_base (287)..(287): a, c, t, g, unknown or other
  misc_feature (287)..(287): n is a, c, g, or t
  modified_base (315)..(315): a, c, t, g, unknown or other
  misc_feature (315)..(315): n is a, c, g, or t
tcagatagagtactcacgaccggtgctcgatttagagtatacatattgggtttgggggagctacaacaggcaggcaggggcagcaagatggtgttgtagacccaggtcttcatttctctgttgctctggatctctggtgcctacggggacatcgtgatgacccagtctccagactccctggctgtgtttctgggcgagagggccaccatcaactgacaagtccagccagaattattttanatagctaccaacaataagaattacttagcttggtaccagcagaaccnggacagcctctaagctgctcatttacgnggcatccgtaccgggaatcccggggtcctgaccgtattcgagtggcaggcgggtctgggactagactttcacactcagtatagcagccgtgcaggtctagaagattggcgtaccttatttactctagtccagtacaattattactacctacgtaccccggtacgttaccgaccgaacggtaccgaaggtcggaacgtaactaccgaaacgtaacgttggacggtcgttacgacgtaccctagttattacgg

SEQ ID NO: 155928 - DNA, 631 bp, Homo sapiens
  misc_feature: GYAE6OF02G2XLN.29.67.G01.1.454.CMB.1.raw
  modified_base (239)..(239): a, c, t, g, unknown or other
  misc_feature (239)..(239): n is a, c, g, or t
  modified_base (321)..(321): a, c, t, g, unknown or other
  misc_feature (321)..(321): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaattattttanatagctaccaacaataagaattacttagcttggtaaccagcaagaaaccaggaccagccctacctaagctgctctatttacngggctattccgtacccggggtacttcccggggtccctagaccgtattccgaggtcggccagggtcgggtctggggacagtactttaccactacgtactaggttattacgcacgtccgtgacgaggtccgtaggaagtgttggtcggaccttaagttttacttactgtacgtagactaatttaatttaaccttaccgtaacccgttccccggtaaccgtttccgggaacccgttaaggggacccgttaagggtacgggtactaacgtacgaaaccggtactgggtacggacttacgaccaccttagtcccg

SEQ ID NO: 155929 - DNA, 614 bp, Homo sapiens
  misc_feature: GYAE6OF02H8DWO.29.67.G01.1.454.CMB.1.raw
  modified_base (239)..(239): a, c, t, g, unknown or other
  misc_feature (239)..(239): n is a, c, g, or t
  modified_base (349)..(349): a, c, t, g, unknown or other
  misc_feature (349)..(349): n is a, c, g, or t
tcagatagagtactcacgaccggtgctcgatttagagtatacatattggggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatattttanatgctaccaacaataagaattacttagcttggtaccagcagaaaccaggacagcctacctaagctgctctatttactggcatcgtacccggaatccgggtcctcgaccgnttcagtggcagcgggtctggacagtacttcactactacagtattagcacgcctagcaggctagaatgtgtgaccgtatttactacgttgtactaagctaaattactttaaacttaaccgtaaccgttacccccgggtaaccggtttaccggacccggtaaacggggacccgtaaccggggttaacgggaacggtaaacgttaacccgaaaaccgtaacggtacggtttacggggtaccctaggtaaccgtaccccaagttacccg

SEQ ID NO: 155930 - DNA, 771 bp, Homo sapiens
  misc_feature: GYAE6OF02FIHY9.29.67.G01.1.454.CMB.1.raw
  modified_base (508)..(508): a, c, t, g, unknown or other
  misc_feature (508)..(508): n is a, c, g, or t
  modified_base (537)..(537): a, c, t, g, unknown or other
  misc_feature (537)..(537): n is a, c, g, or t
tcagatagagtactcacgaccggtgctcgatttagagtatacatattgggtttgggggagctacaacaggcaggcagggcagcaagatggtgttgcagaccccaggtccttcatttctctgttgctctggactctcgtggtacgccctacggggacatccgtagactccgacccctagttcctccacgtaccctccccgtggtccttggttcgtttcggcgggaccgacgggaaccggccccaacctacttacccaaccgttgaccgtaaccggttccccaacgtaccctagtaacttttacttataccgtacaccctaaacaaactaagtaacgtacttaccgtgccgttaacggaccagaaccgaaccgaccgactacgactcctacagtctacgtactaacttcggttaccgcggtacctaacccggttaccccggtaacccggggttactccccggggtacacggtaccttagcgtacggtcgacgacggtcgtacgacgtacncttaccgacacctagtacgacgtagtccncgacgtcgacggtacaccggtactaaggtaccgtgttaccggtaccttaccgttacttcgtaccgtaacgtactaacttaacttaaccgtttaaccgtaacccggttaccccggtaacccctacccgggtacgtaacccggtaaccggtaaccgaacggtacggttaaacccgctaaaaccggtaccgtaacgtggtaccgttacggacctccgtacacgtttccttaacccgg

SEQ ID NO: 155931 - DNA, 615 bp, Homo sapiens
  misc_feature: GYAE6OF02HGEE3.29.67.G01.1.454.CMB.1.raw
  modified_base (241)..(241): a, c, t, g, unknown or other
  misc_feature (241)..(241): n is a, c, g, or t
  modified_base (428)..(428): a, c, t, g, unknown or other
  misc_feature (428)..(428): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactcccctggctgtgtttctgggcgagagggccaccgatcaactgcaagtccagccagaattattttanatagctccaacaataagaattacttagacttgtacctagctacgaaaccaggtacacgcctacctaagctacgctcatttactgggactataccgacccggaagtcccggggtccctaggacccgtatcgaggttcgcgagcgggtctagggacagtatttcgacctactacgtagtaattacgganacgtcctcgacgtaggccgtaagaagtagtgtacggacctagtttacttacgtcgttacgtaacgtactaacgttaagttactaaccgttaacccgtacccggtacgtccgtaccgaacgtacggtaacggtacgggacgtacgtacgaacgtacgtacgtacggacgttcgacgtccgagttaccg

SEQ ID NO: 155932 - DNA, 572 bp, Homo sapiens
  misc_feature: GYAE6OF02G37S6.29.67.G01.1.454.CMB.1.raw
  modified_base (360)..(360): a, c, t, g, unknown or other
  misc_feature (360)..(360): n is a, c, g, or t
  modified_base (370)..(370): a, c, t, g, unknown or other
  misc_feature (370)..(370): n is a, c, g, or t
  modified_base (390)..(390): a, c, t, g, unknown or other
  misc_feature (390)..(390): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgttctgggcgagagggccaccatcaactgcaagtccagccaagaattattttatatagctaccaacaataagaattacttagcttggtaccagcagaaaccaggacagcctctaagctgctcattacgtggcatccgtacccgggaatcccggggtcctgaccgtatcgagtgcncggcggtcgngggacagtacttcactactnagtatagctagcctgcaggctagagtatgtcgacttatttactacgtgtcagtctaattacttaactacctaaccgtcccggtacgttaccggaccgtaacgggaccgtaaggtacggtaacgtacgtaaccgtaaaccgtaacgtacggtacggtacgttacgacccgtactacgttaccg

SEQ ID NO: 155933 - DNA, 511 bp, Homo sapiens
  misc_feature: GYAE6OF02FIFEG.29.67.G01.1.454.CMB.1.raw
  modified_base (496)..(496): a, c, t, g, unknown or other
  misc_feature (496)..(496): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatccctggtgcctacggggacatcgtgatgacccagtctccagactccctggctgtgtttctgggcgagagggccaccatcaactgcaagtccagccagaatattttatatagctccaacaataagaattacttagcttggtaccagcagaaaccaggacagcctcctaagctgctcatttactgggcatctacccgtgaatccggggtccctgaccgattcagtggcagcgggtctgggacaggattttcacactcagtattagcagcctgcaggctggaagatgtggccatttattactgtcagcaattattatactactcccggacgttcgccacggaccgaggtcggagatacgaacgaacgngtaggctgcacatcg

SEQ ID NO: 155934 - DNA, 740 bp, Homo sapiens
  misc_feature: GYAE6OF02H7SFB.29.67.G01.1.454.CMB.1.raw
  modified_base (184)..(184): a, c, t, g, unknown or other
  misc_feature (184)..(184): n is a, c, g, or t
  modified_base (197)..(197): a, c, t, g, unknown or other
  misc_feature (197)..(197): n is a, c, g, or t
  modified_base (729)..(729): a, c, t, g, unknown or other
  misc_feature (729)..(729): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgccgtacggggacagtcgtgatcgacccagtctccagacctcccgnggctgtgtttcgngggacgaggacgggcccaccatccaaacgtgaccaaacggtccagacccaagaaactttattttaatatacggaccttaccaaactaaataaagtaaatttaacgttagtacttacggtaaccagactaacggaaaaccgaggaaccacggtaccctaccgtaaacgctacgtactactactttacgtcgggtactaacgttaacccggtaaccccggggtaacgttccccggggttaccctaccggaaccgtacgttccgaaggttcggcgtaacgggccgggttcgtcgggaactacggtaactttcgaccgtacgtcgaagttgtaacgcacgtccgtgtacgacggtcgtagaagttacgtacggtacggtacccttaagttttaacgtaccgtttaggtaccgtaagaccttaaagttaattaacccttaaaccgttacccggtacccgttacgtaccgtccggtaactaccgggtaacggtaaggacgtacgtaacgtaacgaacggtaggtacgtagaccggtanaccgtataccg

SEQ ID NO: 155935 - DNA, 683 bp, Homo sapiens
  misc_feature: GYAE6OF02IOIZU.29.67.G01.1.454.CMB.1.raw
tcagatagagtactcacgaccggtgctcgatttagagtatacatattgggtttgggggagctacaacaggcaggcaggggcagcaagatgggtgttgcagacccaggtcttcatttctctgttgctctggatctctggtgccgtacggggacatcgtgatgacccagtctccagactccctggctgttgtttcgtgggcgaggacgggccaccatcaactgacaagtccacgccagtaattattttatatagcctaccaaacaataaagtaacttaacttagtcttcggtaaccagacaacgaaaccaggacacgcctacctaagcctgcctactatttacgtgggcacgtaccgtacccgggaacgtcccgggtacccgtacggtaccgtacttacgtacggtcggacgaggccggggtacgtacggggaacgtaaggtactttaccaactaccttacgacgttaagttacgacacggtcctcggacgacgggactaggaacgtagttacggtggtacccttaattttacttacgtgttacaagtactaattatttactaccgttacccgtacccggtaccgttccgggaccgtacgggtaccggtaacgggtacggtaaccggtaactacgtaaaccggtaacgttacggtacggtaccgtacgacctacccgtataccgg

SEQ ID NO: 155936 - DNA, 573 bp, Homo sapiens
  misc_feature: GYAE6OF02FKU34.29.67.G01.1.454.CMB.1.raw
  modified_base (239)..(239): a, c, t, g, unknown or other
  misc_feature (239)..(239): n is a, c, g, or t
  modified_base (318)..(318): a, c, t, g, unknown or other
  misc_feature (318)..(318): n is a, c, g, or t
  modified_base (421)..(421): a, c, t, g, unknown or other
  misc_feature (421)..(421): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaattattttanatagctaccaacaataagaattacttagcttggtaccagcaagaaaccaggacagcctcctaagctgctctatttacgngggcatccgtacccggggaatccggggtcctgaccgtatcagtggcaggcgggtctgggacagtatttcacactcagtattagcagcctgcaggctagaagtntggtcggacctatttatacgtgtacagtacaattattaactacctaccgtaccccggtacgttccggaccgtaacgggaccgtaagggtacggaagtaacgtaccgaaacgtaacgttacggtacggtaccgtagaccctacctacgttacg

SEQ ID NO: 155937 - DNA, 130 bp, Homo sapiens; identical to SEQ ID NO: 155561
  misc_feature: GYAE6OF02IXSF2.29.67.G01.1.454.CMB.1.raw
  modified_base (130)..(130): a, c, t, g, unknown or other
  misc_feature (130)..(130): n is a, c, g, or t

SEQ ID NO: 155938 - DNA, 559 bp, Homo sapiens
  misc_feature: GYAE6OF02JGU9O.29.67.G01.1.454.CMB.1.raw
  modified_base (352)..(352): a, c, t, g, unknown or other
  misc_feature (352)..(352): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatattttatatagctccaacaataagaattacttagcttggtaccagcaagaaaccaggacagcctcctaagctgctcatttactgggcatctacccgggaatccgggtccctgaccgattcngtggcagcggtctgggacagatttcacactctagtattagcagcctgcaggctagaagagtgtaggcctatttactactgtcagactaattattaacttacctaccgttaccccggtacgttccgaccgtacggaccgtaacgggtaggtaacgtaacgtaccgaaacgaacgttacggtcggtacgtcggacctaccgacttaccg

SEQ ID NO: 155939 - DNA, 668 bp, Homo sapiens
  misc_feature: GYAE6OF02HTGJU.29.67.G01.1.454.CMB.1.raw
  modified_base (237)..(237): a, c, t, g, unknown or other
  misc_feature (237)..(237): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgttcgtggcgagaggccacatcaactgacaagtccagccagaattattttanatagctaccaacaataagaattactagtacttggtaccagcagaaaccaggaccagcctactaagctagctctagtttactgggcagtcctacccgggtagtcccggggtcctagaccgtattcaggtgcgaggcgggtcgtgggactagtctttacactacgtacagttattaagactacgtacgtggccgtagggcctaggaacgttagttacggttcggtacccttaattttacgttttaccgttacggttaccgttaaacggacttaaaacttaagtttaaccttaacccgtttaacccggttaccccggttaaccggtttacccggaaccggtaaccggggtaaccgaacggggttaaggaacggtaagaaccgtaaaaccggtacgttacggacgggtccgtacggtaacccgtacgtacttacg

SEQ ID NO: 155940 - DNA, 138 bp, Homo sapiens
  misc_feature: GYAE6OF02JQXP4.29.67.G01.1.454.CMB.1.raw
  modified_base (126)..(138): a, c, t, g, unknown or other
  misc_feature (126)..(138): n is a, c, g, or t
tcagatagagtactcacgaccggtgctcgatttagagtatacatattggtttggcacagcggcctgggctgcctggtcaaggactacttccagtactctatctgagcggctggcaaggcgcatagnnnnnnnnnnnnn

SEQ ID NO: 155941 - DNA, 618 bp, Homo sapiens
  misc_feature: GYAE6OF02HSQGM.29.67.G01.1.454.CMB.1.raw
  modified_base (238)..(238): a, c, t, g, unknown or other
  misc_feature (238)..(238): n is a, c, g, or t
  modified_base (319)..(319): a, c, t, g, unknown or other
  misc_feature (319)..(319): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatattttanatagctaccaacaataagaattacttagcttggtaccagacaagaaaccaggacagcctactaagctgctacattttacgnggcatcctaacccgggaatccggggtcctgaccgtattcgagtggacaggcgggtctgggaacagtactttacactactcagttattaggctagcctgcgaggctagaagattggcgtacctaagttttattaccgtagttaccaaggtacctaaagttactttaactaacccgttaccgtacccccggtaacgtttccggaaccgtaaccgggtaacggtaaacgggtggtaacggtaacgtaacccgaaaacgtaacgttacggttacgggaccttaggaacctaccagtttacccg

SEQ ID NO: 155942 - DNA, 599 bp, Homo sapiens
  misc_feature: GYAE6OF02IH573.29.67.G01.1.454.CMB.1.raw
  modified_base (239)..(239): a, c, t, g, unknown or other
  misc_feature (239)..(239): n is a, c, g, or t
  modified_base (320)..(320): a, c, t, g, unknown or other
  misc_feature (320)..(320): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaattattttanatagctacaacaataagaattacttagcttcggtaccagcaagaaaccaggacagcctacctaagctgctactatttacgngggacattaccgtaaccccggggaattcccggggtaccctggaccgtacttcgagtggcgaggcgggtcgtagggacagtactttcactactacgagttaattacgcacgctgcgacggtctagaacgattggtacggaccttaatttattacgtgtacagtactaattattaactaccttaccgtacccggtaccgttacgaccgacggaaccgtacgggtaggacggtactaacgtaaccgaacgtcggtacggtacgtacgaccaccgtactaccg

SEQ ID NO: 155943 - DNA, 630 bp, Homo sapiens
  misc_feature: GYAE6OF02H47E8.29.67.G01.1.454.CMB.1.raw
  modified_base (239)..(239): a, c, t, g, unknown or other
  misc_feature (239)..(239): n is a, c, g, or t
tcagatagagtactcacgaccggtgctcgatttagagtatacatattgggtttgggggagctacaacaggcaggcaggggcagcaagatggtgttgcagacccgaggtcttcatttctctgttgctctggatctctggtgccgtacggggacatcgtgatgacccagtctccagactccctggctgtgtttctgggcgagagggccaccatcaactgcaagtccagccagaatatttanatagctacaacaataagaattacttagcttggtaccagcagaaaccaggacagtcctcctaagctgctctatttacgtggacatcgtacccgggaactccggggtcctcgaccgtattcagtggcgacggcgggtcgtacgggactaggtattcgacctacgtcgtaagttactacgacgtacggtccgtacgcgaacggtcgtagaagtacgtggtacgtaccttaagtttactactcgtcaagtactaaattacttaacgtaaccgtaccgtacccggtacgttaccgggaaccgaccgggtaaccggtaacgggtaacgggtaacgtaacggtaacgaaacccgttaacggtcgttacgggtctaccggtaccttaccgagttacccg

SEQ ID NO: 155944 - DNA, 631 bp, Homo sapiens
  misc_feature: GYAE6OF02H6SB8.29.67.G01.1.454.CMB.1.raw
  modified_base (238)..(238): a, c, t, g, unknown or other
  misc_feature (238)..(238): n is a, c, g, or t
  modified_base (314)..(314): a, c, t, g, unknown or other
  misc_feature (314)..(314): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatattttanatagctaccaacaataagaattacttagcttggaccagcagaaaccagacacgcctacctaagctgctcatttacnggacatctacccgggaatccgggtcctgaccgattcagtgcagcggtctagggacagtacttcacctactcagtattacgcacgccttggcaagggtctaggaaacgtagttcgggtcggtaccttaagtttttacgttaacgttgttaccgaaggtacctaaagtttaattaacttaacccgttaacccgtaccccccgggtaacgttccgggtaacccgaaccggggtaacccggtaaacggggtaaggtaacggtaagtaaccgtaaaaccgtaacgtaggttacggtcgtacgtacccgtacctaccgttccg

SEQ ID NO: 155945 - DNA, 849 bp, Homo sapiens
  misc_feature: GYAE6OF02ITIRD.29.67.G01.1.454.CMB.1.raw
  modified_base (116)..(116): a, c, t, g, unknown or other
  misc_feature (116)..(116): n is a, c, g, or t
tcagatagagtactcacgaccggtgctcgatttagagtatacatattgggtttggggagctacaacaggcaggcaggggcagcaagatggtgttgcagacccaggtcttcatttcnctgttgctctggatctctggtacgcctacgggacagtcgtgactgaccctagtcctccagactccgtggctgtcgtttcgtgggcgtagacgggccaccgatcaacgtgactaacgtccaggtaccaaggtaacttagttttacacgtacgtacctaccaaacgtaaataaacggtaattaccgttaagccgttttacgggtaacccaaggtaccgtaacggtaaaacccgtacgggtaaccgtaacggtaccccgttaacccgttaaaacgggtccttacgggtccctttacggtaacgtttttaaccggtcggggtaaccctaacgttacccggttaaccccgggggttaaacgttccccgggggttaccccgtaggtaaccccggttacgtttaccgaacgggttcggtaccgtaacggggttccgggttaccgtagggggtaacctacgggtaaaccgtttttcccgaacgttaccgtttacgtaacggtttaacgttaacggtaccgtaagtcccgttacggacgtacggtcgtaaggaacgttgtcgtacggtaccgttatttacgtcgttacgttacgtacgtacttaagttacgtttaacgaacccgtttaccgaccggttaaccgttacgggtaccgaacgggttaccgtaacgggtacgtaacggtaccgttaaccggaacgtacgtacggttaccgcgtaccgtacgtaccgtacgtaaccg

SEQ ID NO: 155946 - DNA, 589 bp, Homo sapiens
  misc_feature: GYAE6OF02F50EP.29.67.G01.1.454.CMB.1.raw
  modified_base (199)..(199): a, c, t, g, unknown or other
  misc_feature (199)..(199): n is a, c, g, or t
  modified_base (315)..(315): a, c, t, g, unknown or other
  misc_feature (315)..(315): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagngggccaccatcaactgcaagtccagccagaatattttatatagctaccaacaataagaattacttagcttaggtaccagcagaaccaggacagcctacctaagctgctcatttacnggcatctaccgggaatccgggtcctgaccgatcagtggcagcgggtctgggacagattcacactcagtattacgcacgcctgctaggctaggaagtagtcggtaggccttaagtttacttacttaggtcaggtaccaaattacttaacttaaccttaacccgtacccccggtacgtttacggcccggtaacgggacccggaagggttacgggaagtacgtaacgaaaccgtaacgttggttacgggccgttacggcctacccgtagttacccgg

SEQ ID NO: 155947 - DNA, 716 bp, Homo sapiens
  misc_feature: GYAE6OF02HI5DL.29.67.G01.1.454.CMB.1.raw
  modified_base (242)..(242): a, c, t, g, unknown or other
  misc_feature (242)..(242): n is a, c, g, or t
tcagatagagtactcacgaccggtgctcgatttagagtatacatattgggtttgggggagctacaacaggcaggcaggggcagcaaggatggtgttgcagacccaggtcttcatttctctgttgctctggatctctggtgccgtacggggacatcgtgatgacccagtctccagactccctggctgtgtttcgtgggcgagacggccacatacactgcaacgtccacgccagaatattttanatagctacaacaataagaactttacgttagtacgttggtaccagtcaagaaaccgaggacagcctactaagctgctactattacgtggcactacgtacccggaacgtcccggggttacctacgaccgtattacgacgtggcgacggtcgggtcgtagggaactaggtactttacaccgtacttacgaacgtttacgtaacggacctaacgggtcccgtacggtacgacggggttaccacgggttaaaaggtcttagggggtaccgttaacccgttaaagtttttaccgttaaccggttaggtttaacccgaaggttacctaaaagtttaacggttaaccttaacccgtaccccgggttaccccggttaaccgggttacgtacccggaacggggtaaccaaggggttacggaacggtaacaacgtaaaccggtaagtacgggtacgtacgttacggaaccctacggtacttaccg

SEQ ID NO: 155948 - DNA, 565 bp, Homo sapiens
  misc_feature: GYAE6OF02GNTGO.29.67.G01.1.454.CMB.1.raw
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatattttatatagctaccaacaataagaattacttagcttggtaccagcagaaaccaggacagcctcctaagctgctcatttactgggcatctacccgggaatccggggtccctcgaccgattcagtggcaggcgggtctgggacagtatttcacactcagtattagcacgcctgcaggctgaagtagtgtgcctaatttattacgtgtcagtactaatattactacttaaccgtccccggtagttccggtaccgaacgggaaccgtaacgggtacggtaacggacgtaacgtaaacgtaacgtaggtacggtacgtacggacctaccgattaccg

SEQ ID NO: 155949 - DNA, 660 bp, Homo sapiens
  misc_feature: GYAE6OF02IDLGU.29.67.G01.1.454.CMB.1.raw
  modified_base (193)..(193): a, c, t, g, unknown or other
  misc_feature (193)..(193): n is a, c, g, or t
  modified_base (242)..(242): a, c, t, g, unknown or other
  misc_feature (242)..(242): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgccgtacgggacatcgtgatgacccagtctccagacctcccgtggctgtgttcgngggcgaggaggccacatcaacgtgacaagtccagccagaattattttanatacgctacaaactaaataagtaattactagtcttacggtaccagcaagaaaccaggaacacgacctactaaggctagctactatttaccgtgggactaacgttaccgtaaccccggggaagtccccggggtacctacggacccgtattcgaggtcggcgaggccgggtctagggactagtactttacaaccgtactacgagttaattacgcaacgtcctacggacgaacggtctaaggaaacgtgttggtacggtaccttaattttacgtacgttgtaccaagtactaaattacttaactaaccgttacccgtaccggtacgtaccgtacggaacggtacggtacggtaacggaagtaacgtaaccgtaaacggtaacgtacggtacggtacgtacgtaccgtaccgtagttaccgg

SEQ ID NO: 155950 - DNA, 591 bp, Homo sapiens
  misc_feature: GYAE6OF02F0CPB.29.67.G01.1.454.CMB.1.raw
  modified_base (236)..(236): a, c, t, g, unknown or other
  misc_feature (236)..(236): n is a, c, g, or t
  modified_base (246)..(246): a, c, t, g, unknown or other
  misc_feature (246)..(246): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagatatttanatagctcaanaataagaattactagcttggtaccagcagaaccaggacagcctccaagcctgctacatttacagggcatccgtaacccgggtaatcccggggtaccctcggaaccgtacttcgacggttaggacgaggccgggtactcggggaactaggtattttcactactcagtattagcagcctgacaggctagaagagtgtcggcctagtttatttacgtgttcgagctaaattacttaataaccgttaccgacccgtacgttaccgaccgaacgggacccgtaacgggtcggtaacggacgtaacgtaaacgtaacttacggtcgtaccgtgaccgtaccgtacgttacg

SEQ ID NO: 155951 - DNA, 804 bp, Homo sapiens
  misc_feature: GYAE6OF02JZDFL.29.67.G01.1.454.CMB.1.raw
  modified_base (249)..(249): a, c, t, g, unknown or other
  misc_feature (249)..(249): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgccgtacggggacatcgtgatgacccagtcctccagacctcctggctgtgtttcgtggcgagacgggccaccgtatcgaactggcaaggtccagccagtaacttattttanatacgtcctaccaaactaataaagtaacttaacttagtcgtttacggacctagactaacgaaacccgtaggaacctacgacccgttaaccgtaaagtcctacgtaccttactaaacgtttttacggacgggtacctacgttacccgtaaaccccgggggtaacgttccccgggggttacccctacggaacccgttaagtttccgaacggttcgggaccctaaggggtccgggttacgttaccgggaacgtaacggtacttttaccgaacgtaaccgttaccgtaaggttaacgttaacgaccggtacgtaaccgttcgaacgtacggtaccgtaagtaacgtcgttacggtacggtaccctagttttaaccgtacttacgacgtaacgtacgttaaacgttacttaaccgttaaccttaacccggtacccggtaaccgttacgggtacccgtaacggtaaccggtaacgggtacggtaacggttacggtaaacccgtaaacgtaacccggttaggttaaccggcgttaaccggacttacccgtacgttaacccgg

SEQ ID NO: 155952 - DNA, 541 bp, Homo sapiens
  misc_feature: GYAE6OF02I765Q.29.67.G01.1.454.CMB.1.raw
  modified_base (315)..(315): a, c, t, g, unknown or other
  misc_feature (315)..(315): n is a, c, g, or t
  modified_base (367)..(367): a, c, t, g, unknown or other
  misc_feature (367)..(367): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatattttatatagctaccaacaataagaattacttagcttggtaccagcagaaaccaggacagcctacctaagctgctcatttacnggcatccgtacccgggaatccgggtccctgaccgattcagtggcagcgggtntgggacagtacttcacactcagtatagcagcctgcaggctagaagatgtagcctaatttactactgtacagcaaattattactacttacctcccggtacgttcgtaccgacggaccgaaggtggtaacgtacgtaacgaacgtaacgtagtcggacgttcgacctaccgatacg

SEQ ID NO: 155953 - DNA, 522 bp, Homo sapiens
  misc_feature: GYAE6OF02HQAHR.29.67.G01.1.454.CMB.1.raw
  modified_base (238)..(238): a, c, t, g, unknown or other
  misc_feature (238)..(238): n is a, c, g, or t
  modified_base (312)..(312): a, c, t, g, unknown or other
  misc_feature (312)..(312): n is a, c, g, or t
  modified_base (345)..(345): a, c, t, g, unknown or other
  misc_feature (345)..(345): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatattttanatagctccaacaataagaattacttagcttggtacagcagaaaccaggacagcctcctaagctgctcatttacngggcatctacccgggaatccgggtcctgaccgnttcagtgcaggcggtctgggactagtatttcactactcaagtattagcacgcctgcgaggctagaagatggtcgcctatttattactgtcagactaattattaatacctaccgtcccggacgttccgacgacgggacaagggtggagactaacgaacgaatggtgtctgacacatcg

SEQ ID NO: 155954 - DNA, 594 bp, Homo sapiens
  misc_feature: GYAE6OF02GMJGN.29.67.G01.1.454.CMB.1.raw
  modified_base (239)..(239): a, c, t, g, unknown or other
  misc_feature (239)..(239): n is a, c, g, or t
  modified_base (265)..(265): a, c, t, g, unknown or other
  misc_feature (265)..(265): n is a, c, g, or t
  modified_base (427)..(427): a, c, t, g, unknown or other
  misc_feature (427)..(427): n is a, c, g, or t
tcagatagagtactcacgaccggtgctcgatttagagtatacatattgggtttgggggagctacaacaggcaggcaggggcagcaagatggtgttgcagacccaggtcttcattttctctgttgctctggatctctggtgcctacggggacatcgtgatgacccagtctccagactccctggctgtgtttctgggcgagagggccaccatcaactgcaagtccagccagaatattttanatagctcaacaataagaattacttancttggtaccagcaagaaccaggacagcctcctaagctgctactatttactgggacataccgtacccggggaatcccggggtccctcgaccgtattccgagtggcaggccgggtctgggacaggtatttcacactcagtattagcagctgcgaggactgaagngtgtacggtcctaatttacttctgttccaggtctaaattacttaattacctaccgtaccccgggtaacgttccggacctaacgggacccgtaaagggtcgggaagtaccgttaaccgaaacggtaaccttacgggtacggtaccggtacgaccgtaccacgttaccg

SEQ ID NO: 155955 - DNA, 539 bp, Homo sapiens
  misc_feature: GYAE6OF02HAGZI.29.67.G01.1.454.CMB.1.raw
  modified_base (242)..(242): a, c, t, g, unknown or other
  misc_feature (242)..(242): n is a, c, g, or t
  modified_base (319)..(319): a, c, t, g, unknown or other
  misc_feature (319)..(319): n is a, c, g, or t
  modified_base (406)..(406): a, c, t, g, unknown or other
  misc_feature (406)..(406): n is a, c, g, or t
  modified_base (420)..(420): a, c, t, g, unknown or other
  misc_feature (420)..(420): n is a, c, g, or t
  modified_base (452)..(452): a, c, t, g, unknown or other
  misc_feature (452)..(452): n is a, c, g, or t
tcagatagagtactcacgaccggtgctcgatttagagtatacatattgggtttgggggagctacaacaggcaggcaggggcagcaagatggtgttgcagacccaggtcttcattttctctgttgctctggatctctggtgcctacggggacatcgtgatgacccagtctccagacctccctggctgtgtttctgggcgagagggccaccatcaactgcaacgtccagccagaattattttanatagctaccaacaataagaattacttaagcttggtaccagcagaaaccaggacagctcctaagcctgctcatttacngggcatcctaccggggaatccggggtccctggaccgattcagtggcagcgggtctggggacagtatttcgacactcagttattacgnacgcctgcaggtcngaagatgtcggacctatttaattactgtcagntaactattatacctacgtccccgagttaccgaccgtaggaccgaaggtcggacacgtacgaacgaactgcggctagacaccattccg

SEQ ID NO: 155956 - DNA, 518 bp, Homo sapiens
  misc_feature: GYAE6OF02F1SBE.29.67.G01.1.454.CMB.1.raw
  modified_base (239)..(239): a, c, t, g, unknown or other
  misc_feature (239)..(239): n is a, c, g, or t
  modified_base (413)..(413): a, c, t, g, unknown or other
  misc_feature (413)..(413): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaattattttanatagctccaacaataagaattacttagcttggtaccagcagaaaccaggacagcctcctaagctgctcatttactggcatctacccgggatccggggtccctgaccgattcagtggcagcgggtctgggacagtatttcacactcagtataagcacgctgcaggcctggaacgntcgtgcctatttattactgtcagcaatattatactactcccggacttcgaccgaggacgaaggtggagactcgaaacgtaacgtgtacggctgacgacctatccg

SEQ ID NO: 155957 - DNA, 590 bp, Homo sapiens
  misc_feature: GYAE6OF02HOSSQ.29.67.G01.1.454.CMB.1.raw
  modified_base (243)..(243): a, c, t, g, unknown or other
  misc_feature (243)..(243): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgaggacgggccaccatcaactgacaagtccagccaagaattattttanatagctaccaacaataagaatttacttagcttggtaccagcagaaaccaggacagccctcctaagctgctcatttacgtgggcatcctacccggggaatcccggggtcctgaccgtattcgagttcggcacggcgggtctcggggaactaggtactttacaccactacgacgtagtttacgcagccttagacagggtactaggaagtagtcggtcggtaccttaattttattaccgttagtacaagtactaattattactaaccttaccgtcccggacgttacgaccgacgggacgtaagggacggagtactacaaaccgagtaggtcggacgtacgacactatccg

SEQ ID NO: 155958 - DNA, 582 bp, Homo sapiens
  misc_feature: GYAE6OF02JAWB5.29.67.G01.1.454.CMB.1.raw
  modified_base (240)..(240): a, c, t, g, unknown or other
  misc_feature (240)..(240): n is a, c, g, or t
  modified_base (258)..(258): a, c, t, g, unknown or other
  misc_feature (258)..(258): n is a, c, g, or t
  modified_base (310)..(310): a, c, t, g, unknown or other
  misc_feature (310)..(310): n is a, c, g, or t
  modified_base (393)..(393): a, c, t, g, unknown or other
  misc_feature (393)..(393): n is a, c, g, or t
  modified_base (564)..(564): a, c, t, g, unknown or other
  misc_feature (564)..(564): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacgggggacatcgtgatgacccagtctccagactccctggctgtgtttctgggcgagagggccaccatcaactgcaagtccagccagaattattttanatagctaccaacaataanaattacttagcttggaccagacaagaaccaggacacgcctcctaagctgctnatttactggcactcgtacccgggaatccggggtccctgacccgattcaggtgcgaggcgggtcgtgggacagtattcacactntagtattagcagcctgcaggactagaagtagtgtcggtacccttaatttacgttacgtgtacgtagtactaattatttaactaacccgttaccgtccccggttaacgttccggacccgtaacgggaccgtaagggtcggaagacgtaaccgaaacgtaccgtagtcggtanaccgtacaccgtcttacg

SEQ ID NO: 155959 - DNA, 534 bp, Homo sapiens
  misc_feature: GYAE6OF02FYGO7.29.67.G01.1.454.CMB.1.raw
  modified_base (238)..(238): a, c, t, g, unknown or other
  misc_feature (238)..(238): n is a, c, g, or t
  modified_base (313)..(313): a, c, t, g, unknown or other
  misc_feature (313)..(313): n is a, c, g, or t
  modified_base (346)..(346): a, c, t, g, unknown or other
  misc_feature (346)..(346): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatattttanatagctaccaacaataagaattacttagcttggtaccagcagaaccaggacagcctcctaagctgctcatttacngggcatctacccgggatccgggtcctgaccgtnttcagtggcaggcgggtctggggacagtactttcacactcagtattagcagtcctgccaggctaggaagtagtgtgcctattttatacgttgtacagctaattattactaactacctccccggtagttccgaccacgggaccgaaggtggagtataaccgaacgacgtgtcggcgtgctaccattccg

SEQ ID NO: 155960 - DNA, 617 bp, Homo sapiens
  misc_feature: GYAE6OF02GD8HX.29.67.G01.1.454.CMB.1.raw
  modified_base (244)..(244): a, c, t, g, unknown or other
  misc_feature (244)..(244): n is a, c, g, or t
  modified_base (335)..(335): a, c, t, g, unknown or other
  misc_feature (335)..(335): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttcgtgggcgaggacgggccaccatcaactgacaagtccagccagtaattattttanatagcctaccaaacaataaagtaattaacttagtacttacggtaccagacaagaaaccaggacacgcctacctaagctgctctatttacgnggcagtccgtaaccgggaacgtccgggtccctaggaccgtattcgaggtcggacgcggtcgggtcgtgggactaggttactttacacgttacgtagttatacgctacgtcctgcgtaggctagaagtagttcggtacgtacttaatttacgttactgtacgagtactaatttattacctaccgttaccgtaccccggtacgttccggacccgaacgggtaccgagggtacggaacgtaactaacgaaacgtaacgtggtcggacgtacgaccactagtctcg

SEQ ID NO: 155961 - DNA, 638 bp, Homo sapiens
  misc_feature: GYAE6OF02HZBOS.29.67.G01.1.454.CMB.1.raw
  modified_base (346)..(346): a, c, t, g, unknown or other
  misc_feature (346)..(346): n is a, c, g, or t
  modified_base (477)..(477): a, c, t, g, unknown or other
  misc_feature (477)..(477): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgccgtacggggacatcgtgatgacccagtctccagacctccctggctgttgtttcgtgggcgagacgggcccaaccatacaactgacaacgtccacgccaagaattattttatatagcctaccaaacaataaagtaattacttagtcgttaggtaccagacaagaaaccgaggacacgacctaccgtaagtctgctactactttacgngggcctacgtaccgtaacccgggacgttcccggggtccctacggaccgtacttacgaggtcggacgaggcgggtcgtacgggactacgtactttaccacgtactacgtagttactacgctacgcgtgacgnggtactaggagagtcggtcggtaccttagtttactactagtcaagtactaatattactaccttaccgtcccggtacgttccggaccgtacggaccggtaacgggtaggtacgaacgtaccgaaacggtactcggtacggtccgacgacctaccgtacttcg

SEQ ID NO: 155962 - DNA, 657 bp, Homo sapiens
  misc_feature: GYAE6OF02FM4Q4.29.67.G01.1.454.CMB.1.raw
  modified_base (238)..(238): a, c, t, g, unknown or other
  misc_feature (238)..(238): n is a, c, g, or t
  modified_base (310)..(310): a, c, t, g, unknown or other
  misc_feature (310)..(310): n is a, c, g, or t
  modified_base (412)..(412): a, c, t, g, unknown or other
  misc_feature (412)..(412): n is a, c, g, or t
tcagatagagtactcacgaccggtgctcgatttagagtatacatattgggtttgggggagctacaacaggcaggcaggggcagcaagatggtgttgcagacccaggtcttcattttctctgttgctctggatctctggtgcctacggggacatcgtgatgacccagtctccagactccctggctgtgtttctgggcagagggccaccatcaactgcaagtccagccagaatattttanatagctcaacaataagaattactagcttggaccagcaagaaccaggacagcctactaagctgctcatttacnggcacgtctaacccgggatccggggtccctagaccgatacgagtcggcgaggtcgggtcgtgggactagtactttaccagtacctacgtagtattagcgtanccgtacgacgacggctaaggaagaattgggtacggtaccctaaagttttttacgtaaccgtcggttacgaacgtaaccgttaaaattacgttttaaaccttaaccgttaacccgttaccccgggttaacggttacccggttaacccggaacgggtaacccgtaagggtccgggtaacgtaacgtaacccggtaaaaccgtagttccggtacggtaccgttacgacccgtaaccgttattacccgg

SEQ ID NO: 155963 - DNA, 526 bp, Homo sapiens
  misc_feature: GYAE6OF02F3KMT.29.67.G01.1.454.CMB.1.raw
  modified_base (312)..(312): a, c, t, g, unknown or other
  misc_feature (312)..(312): n is a, c, g, or t
  modified_base (352)..(352): a, c, t, g, unknown or other
  misc_feature (352)..(352): n is a, c, g, or t
  modified_base (415)..(415): a, c, t, g, unknown or other
  misc_feature (415)..(415): n is a, c, g, or t
  modified_base (436)..(436): a, c, t, g, unknown or other
  misc_feature (436)..(436): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaattattttatatagctaccaacaataagaattacttagcttggtaccagcagaaccagacagcctctaagctgctcatttacnggcatcctaccgggaacgtccgggtcctcgaccgtattcncgtggacaggcgggtcgtagggacagatttcacactcagtattagcagcctgcagctagagtntgtcgctattattactgtacngactaattattactactaccgtccccgtagttccgaccgagggacctaagggtcgaagtactacaacggatgtcggctcgacactctacg

SEQ ID NO: 155964 - DNA, 670 bp, Homo sapiens
  misc_feature: GYAE6OF02HDP9C.29.67.G01.1.454.CMB.1.raw
  modified_base (240)..(240): a, c, t, g, unknown or other
  misc_feature (240)..(240): n is a, c, g, or t
  modified_base (325)..(325): a, c, t, g, unknown or other
  misc_feature (325)..(325): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgaggagggccaccatcaactgcaagtccagccagaattattttanatagctaccaacaataagtaattacttagcttaggtaccagacaagaaaccaggacagcctacctaagcctgctactatttacgngggacataccgtaccccggggtaagtcccggggtccctaggaccgtattcaggttgcgaggccgggtactggggacagtactttcacactctagtattagacgtacgtcctgacgaggtacctaggaagtagttacggtacggtaccttaagtttactttaaccgtgtaccgaagtactaaagtttacttttaacgtaacccgttacccgtacccccgggttaacgttacccgggtaaccgaacggggtaacccgtaaggggtaacgggtaacgtaagtaacccgtaaacggtaaccggttacggtaccgggtccgtaaccggacctaaccgtacgtttacccgg

SEQ ID NO: 155965 - DNA, 582 bp, Homo sapiens
  misc_feature: GYAE6OF02G358V.29.67.G01.1.454.CMB.1.raw
  modified_base (239)..(239): a, c, t, g, unknown or other
  misc_feature (239)..(239): n is a, c, g, or t
  modified_base (316)..(316): a, c, t, g, unknown or other
  misc_feature (316)..(316): n is a, c, g, or t
  modified_base (351)..(351): a, c, t, g, unknown or other
  misc_feature (351)..(351): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaattattttanatagctccaacaataagaattacttagcttggtaccagcaagaaaccaggacagcctacctaagctgctcatttacnggcatccgtacccgggaatccgggtccctgaccgnttcagtggcacggcgggtcgtgggaacagtactttcactactctagttattagcagcctgcgaggtcctagaagtgtggtacggcctaattttacttactgtacagtactaattaatttaactaccttaccgtccccggtagttccggaccgtaacggaccgtaaggtacggaagtaacgtaccgtaaacgtacgttacggtacggtacttacggacctaccgtattaccg

SEQ ID NO: 155966 - DNA, 132 bp, Homo sapiens; identical to SEQ ID NO: 155630
  misc_feature: GYAE6OF02GI0JG.29.67.G01.1.454.CMB.1.raw
  modified_base (130)..(132): a, c, t, g, unknown or other
  misc_feature (130)..(132): n is a, c, g, or t

SEQ ID NO: 155967 - DNA, 649 bp, Homo sapiens
  misc_feature: GYAE6OF02H4OUA.29.67.G01.1.454.CMB.1.raw
  modified_base (238)..(238): a, c, t, g, unknown or other
  misc_feature (238)..(238): n is a, c, g, or t
  modified_base (299)..(299): a, c, t, g, unknown or other
  misc_feature (299)..(299): n is a, c, g, or t
  modified_base (311)..(311): a, c, t, g, unknown or other
  misc_feature (311)..(311): n is a, c, g, or t
  modified_base (358)..(358): a, c, t, g, unknown or other
  misc_feature (358)..(358): n is a, c, g, or t
tcagatagagtactcacgaccggtgctcgatttagagtatacatattgggtttgggggagctacaacaggcaggcagggggcagcaagatggtgttgcagacccaggtcttcatttctctgttgctctggatctctggtgcctacggggacatcgtgatgacccagtctccagactccctggctgtgttctgggcgaggagggccaccatcaactgcaagtccagccagaatatttanatagctcaacaataagaattactagcttggaccagcagaaaccaggacagcctactaagcngctctatttacnggcatcgtacccgggatccgggtcctgacctatcagtgcgagcggtnggacagtacttcactactcgtagtatacgcacgctacgcgacgggactacggaagtaacgttggtacggtacccttaagttttacttaacgttcggttacgaacggtacctaaaagtttaacttttaacgttaaacccttaacccggttacccccgggttaacggttacccgggtaccggttaaccggggaacccgggttaacgggtaagggtaacggttaacggtaaaccgtaaaccggttaaccggtaacggttcgggtaccgtcggtaacccttacgaccgttaacgg

SEQ ID NO: 155968 - DNA, 652 bp, Homo sapiens
  misc_feature: GYAE6OF02GJ9AO.29.67.G01.1.454.CMB.1.raw
  modified_base (239)..(239): a, c, t, g, unknown or other
  misc_feature (239)..(239): n is a, c, g, or t
  modified_base (318)..(318): a, c, t, g, unknown or other
  misc_feature (318)..(318): n is a, c, g, or t
tcagatagagtactcacgaccggtgctcgatttagagtatacatattgggtttgggggagctacaacaggcaggcaggggcagcaagatggtgttgcagacccaggtcttcattttctctgttgctctggatctctggtgcctacggggacatcgtgatgacccagtctccagactccctggctgtgtttctgggcgagagggccaccatcaactgcaagtccagccagtaatatttanatagctacaacaataagaattacttagcttaggtaccagcagaaccagacagcctacctaagctgcctctattttacgngggtcacgtaccgtaaccccggggtaactcccggggtaccctaggaacccgtatttccgaggtcggcgtaacggtcgggtacgtaggggtacaggtaacttttccaacctacgttactaagtagttaacgacgacgtccgtagcgacggcgtagaagtacgtcggtacggtaccttagtttacttacgtcgtacgtagtactaaattacgtttaactaacccttaccggtaccccggtagttacccgggacgaacgggtacggaagggtcggtacgtaaccgtaacgtaaccgtaacgtcggtacggtaccctagtacccgtacgtcttaccgg

SEQ ID NO: 155969 - DNA, 711 bp, Homo sapiens
  misc_feature: GYAE6OF02I061I.29.67.G01.1.454.CMB.1.raw
  modified_base (166)..(166): a, c, t, g, unknown or other
  misc_feature (166)..(166): n is a, c, g, or t
  modified_base (357)..(357): a, c, t, g, unknown or other
  misc_feature (357)..(357): n is a, c, g, or t
  modified_base (398)..(398): a, c, t, g, unknown or other
  misc_feature (398)..(398): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgccgtacgggacatcgtgagtcgacccngtctccagtacctcccgtggcctgttcgtttcgtgggcgaggacggcccaccatcgaactgacacgtccagaccagaattattttagatacgcctaaccaaactaataaagtaacttacttacgtcgttacggtaccaagccaaaggaaccgaggaccacgtcctacctaagctgactacttactttacgnggactacgttaccggtaaccggggtaacgtcccgggtaccncgtaccgtacttacgacgggtcgacgacggtcggtcgaacgggataacggtcttacgaactactcgtaagtacttacgcacgtccgtgacgacgtgtaacggaagtacgtcgtacggttacccttaagttttactaccgttagtaaccttagtaacgttaaacgtttaacttaccgttaacctaccccccgggttaccggtacccggtttaacggaacccggttaagggaacccgttaaggggtcggtaaacgtacgtaaacctaaccgggaacgttggtaccggtcctaacggacctaacggtccctaccgg

SEQ ID NO: 155970 - DNA, 596 bp, Homo sapiens
  misc_feature: GYAE6OF02GZA8J.29.67.G01.1.454.CMB.1.raw
  modified_base (240)..(240): a, c, t, g, unknown or other
  misc_feature (240)..(240): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgccgtacggggacatcgtgatgacccagtctccagactccctggctgtgttctgggcgaggaggccaccatcaactgcaagtccagccaagaattattttanatagctaccaaacaaataagtaattacttagcttggtaaccagacaagaaaccaggacagcctacctaagctgctctattacgtggcatccgtaacccgggaacgtcccggggtcctacggaccgtattcgaggtggacgaggtcgggtcgtagggacagtactttcaactactactagtagttacgcacgtcctgacgaggtctagaagacgtagtcggtaccttaatttacgttactgtactagactaaattatttaactacctaccgttaccccggagttaccggaccgaacggacgtaaggtcggaagaacgtaacgaaacgtaacgagtacggactacgactaccagtccg

SEQ ID NO: 155971 - DNA, 644 bp, Homo sapiens
  misc_feature: GYAE6OF02I2W7Z.29.67.G01.1.454.CMB.1.raw
  modified_base (331)..(331): a, c, t, g, unknown or other
  misc_feature (331)..(331): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgccgtacggggacatcgtgatgacccagtctccagactccctggctgtgtttcgtgggcgaggacgggccaccatcaactgcaacgtccagccaagtaattattttatatacgctaccaaactaaataaagtaattacttagcgttaggtaccagcaagaaaccagacacgcctacaagctgctctatttcgnggacactccgtaccgggacgtccgggtcctcgaccgtattacgacgtggacgaggtcgggtcgtacgggactacggtactttccgaactacgttactacggttaattacgacgtaacgtccgtaggaccgagggtacctaggtaaacggttagtcgggttacggtaccctttaagttttaaccgttacttgtaccgaagtactaaatttacttaacttacccgttacccgtcccggtagtaccgaccgtacgggaacgtacgggtaaggactacgtaaccgaacgtacgtggtcgtacgcgacctactattcg

SEQ ID NO: 155972 - DNA, 692 bp, Homo sapiens
  misc_feature: GYAE6OF02IULKH.29.67.G01.1.454.CMB.1.raw
  modified_base (241)..(241): a, c, t, g, unknown or other
  misc_feature (241)..(241): n is a, c, g, or t
  modified_base (246)..(246): a, c, t, g, unknown or other
  misc_feature (246)..(246): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtcgcctacggggacatcgtgatgacccagtctccagacctccctggctgtgtttctgggcgagagggccaccatcaactgcaagtccagccagaattattttanatacnctaccaaacaataaagaattacttaagcttggtaccagcaagaaaccaggacagcctacctaagctgctctatttacgtgggcacttccgtaacccggggaacgtcccggggtaccctcggaccgtattcaggtggacgaggtcgggtcgtaggggactaggttactttccgaactacctacgtaaggttaacttacgctacgcccgtgaccgtagggcctaggaaagtagtcggttacggccttaattttacttactacgttacctaaggtacctaaatttaactttaacttaaacccttaacccggttacccccgggtaaccggtttccgggaacccggtaacgggtaacccggtaaacggggttacggtaaacggtaactaaccggtaaaaccggtaaccgttacggttacgggtccgtacggacccggtacctacgttaccg

SEQ ID NO: 155973 - DNA, 728 bp, Homo sapiens
  misc_feature: GYAE6OF02HT9Z3.29.67.G01.1.454.CMB.1.raw
  modified_base (151)..(151): a, c, t, g, unknown or other
  misc_feature (151)..(151): n is a, c, g, or t
  modified_base (193)..(193): a, c, t, g, unknown or other
  misc_feature (193)..(193): n is a, c, g, or t
  modified_base (247)..(247): a, c, t, g, unknown or other
  misc_feature (247)..(247): n is a, c, g, or t
  modified_base (322)..(322): a, c, t, g, unknown or other
  misc_feature (322)..(322): n is a, c, g, or t
  modified_base (355)..(355): a, c, t, g, unknown or other
  misc_feature (355)..(355): n is a, c, g, or t
  modified_base (420)..(420): a, c, t, g, unknown or other
  misc_feature (420)..(420): n is a, c, g, or t
tcagatagagtactcacgaccggtgctcgatttagagtatacatattgggtttgggggagctacaacaggcaggcaggggcagcaagatggtgttgcagacccaggtcttcatttctctgtgctctggatctctggtgccgtacgggactntcgtgatcgacccagtctccagactcccgtgtctgtgtttcncgggcgaggacggccaccataccaactgaccaagtccagcaagaatttatttanatcgactaacgaaactaaataacgtaaattacgttagtacgtttaggaccaggtacaagtaaaccgaggtaaccncgtaccttaccaagtctacgactcgtatttagnggactagttacccggtaacccggtaacggttccccgggtacctacggtaacgttcttaaccgggnggtaccggacgcgggtaccggttacgtacggtacgtacgttacgttacctaactacgtacgtataagtcgacgacgtccgtagacgtacggtagacgtaagtaggtcgtacgttactttaagttacgtagttccgtaacgttaacgtacttaaacgtttaaccgttaaccgttacccgttaaccccgggttaccggtaccgtaacccggtaaccggacggttaacggtaacgggtaacgaaccggtaacgtaacggttaaaccgttacggacggttcggaccgtaccgtaaccgtacttaccggtacg

SEQ ID NO: 155974 - DNA, 134 bp, Homo sapiens; identical to SEQ ID NO: 155740
  misc_feature: GYAE6OF02ISHF2.29.67.G01.1.454.CMB.1.raw
  modified_base (130)..(134): a, c, t, g, unknown or other
  misc_feature (130)..(134): n is a, c, g, or t

SEQ ID NO: 155975 - DNA, 670 bp, Homo sapiens
  misc_feature: GYAE6OF02GC4V2.29.67.G01.1.454.CMB.1.raw
  modified_base (317)..(317): a, c, t, g, unknown or other
  misc_feature (317)..(317): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaattattttatatagctccaacaataagaattactagcttggtaccagcaagaaaccaggacagcctccgtaagctgctctatttacgngggcactaccgtacccgggaatcccggggtcctgacccgtattccaggtgacgaggtcgggtacgtgggaacagtactttcactactcgtaagttattagcacgtcctagacgaggcctaggaagtacgttagtcggtacccttaagttttaactttaccgtacggttacaccggtaactaaagtttaacgtttaacttaacccttaacccggttaacccccggtaaccggtttaccgggtaaccccgtaaccggggtaacccgtaaggggtaacgggtaacggtaaacttaaaccggaaacccgtaacggttacggtaggtaccggttaaccgcgtaaccctagttaacccg

SEQ ID NO: 155976 - DNA, 646 bp, Homo sapiens
  misc_feature: GYAE6OF02HSFS2.29.67.G01.1.454.CMB.1.raw
  modified_base (194)..(194): a, c, t, g, unknown or other
  misc_feature (194)..(194): n is a, c, g, or t
  modified_base (242)..(242): a, c, t, g, unknown or other
  misc_feature (242)..(242): n is a, c, g, or t
  modified_base (323)..(323): a, c, t, g, unknown or other
  misc_feature (323)..(323): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagacctccctggctgttgtttcgngggcgaggaggccaccatcaactgcaagtccagccaagaattatttanatagctaccaacaataagtaattactagcttaggtaccagacaacgaaaccaggacagcctactaagctgctctatttacncgggactacgttaccgaccccggggaacgtccccgggtccctacggtaccgattcgacggtcggacgacgggtcgggtcgtacgggactaggtactttacaacgtactacgtaagtattacgacgagtccgtggacgacggtctagtaacggtagtcggtaggtaccttaaagttttacgtaacgtcgtacgaacgtactaaagttaattacgttaacccgtacccgttacccggtacgttaccgggaaccggtacggaacggtaacgggtacggaagtacgtaacgtaacgtaaggtacgtcggcgtcacgtacgtactacg

SEQ ID NO: 155977 - DNA, 613 bp, Homo sapiens
  misc_feature: GYAE6OF02GPE9I.29.67.G01.1.454.CMB.1.raw
  modified_base (337)..(337): a, c, t, g, unknown or other
  misc_feature (337)..(337): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttcgtgggcgagacgggccaccatcaactgacaacgtccagccaagaattattttaatatacgccttaccaaacaataaagtaaattaacttagcctttaggtaccagcaagaaacccgaggacagcctccgtaagctgctctatttacngggcatccgtacccgggatcccggggtcctggaccgtattcgaggtgcgaggtcgggtcgtgggacagtacttcaactactacagtattagctacgctgcgaggtctaggagtatggtacgtccttaagtttacttacgtgtacgacgtactaagttattacgttaaccgttacccgtacccggtacgttccggtaccgaacgggtaccgtaagggtggaacgtaacgtaaccgaaacgtaacgtacggtacgggcctacggacctaccgagttcg

SEQ ID NO: 155978 - DNA, 706 bp, Homo sapiens
  misc_feature: GYAE6OF02GRWLA.29.67.G01.1.454.CMB.1.raw
  modified_base (235)..(235): a, c, t, g, unknown or other
  misc_feature (235)..(235): n is a, c, g, or t
  modified_base (261)..(261): a, c, t, g, unknown or other
  misc_feature (261)..(261): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctcagactccctggctgtgtttctggcgagaggccacatcaactgcaagtccagccagaattattttanatagctacaacaataagaattactancttggtaccagacaagaaccaggacagcctacctaagctgctactatttacgtggctatccgtaaccggtaacgtccgggtcctagaccgtattcgagtcggacaggcgggttctgggaactagtactttacaactactactaaggtacttagccaaggtcctacggcgtaacgggtcgtaaggaacgtaacgttcgggtacgaacccgttaagtttttaacgttaccgttaacggttcaacggttaacctaaaatttacgttttaaaccgtaaccgttaaccccggttacccccggtaacgggtttccggaacccggttaacggggtaacccgtaaacggggttaaccggggtaaacggtaacggtaaacccgtaaaaccggttaaaccggttacggttaacgggtaccggttaacgtaccggttacccgtaacgtttacccgg

SEQ ID NO: 155979 - DNA, 814 bp, Homo sapiens
  misc_feature: GYAE6OF02HMDCL.29.67.G01.1.454.CMB.1.raw
  modified_base (196)..(196): a, c, t, g, unknown or other
  misc_feature (196)..(196): n is a, c, g, or t
  modified_base (762)..(762): a, c, t, g, unknown or other
  misc_feature (762)..(762): n is a, c, g, or t
tcagatagagtactcacgaccggtgctcgatttagagtatacatattgggtttgggggagctacaacaggcaggcaggggcagcaagatggtgttgcagacccaggtcttcatttctctgtgctctggatctctggtgccgtacggggacagtcgtgatcgacccagtctccagacctcccgtggctgtgtttcgngggcgaggacgggcccacctataccaacgtgaccgaacgtccgacgacctaagtaatttactttttaagtacgtacgcccttaaccaaaactaaaagttaaacggtaaactttacgtttaacggtccgtttacgggtaacccaaggtaaccgaaacggtaaaacccgaagggtaacctaccgtaccccgttaacctaaggtccgtaccgtacttaccgttaagttttaccggtacggggacctaaccgttaccccggttaaccccgggggtaaccggttcccccggggggttacccaccggtaaccggtaacgtttaccggacgggttccgggtacgtacgggtccgggggttacgtacggggtaacctaaacggttctttaccaccgtacgtacgtaaggttaattaccggacgtacgtccgtaggtaccgggtacgtacgtaggaacgttcggtaggtaccggttacttaaacgttttcgtacgtaggtaaccaacgtactaaagtttactaacctcccgtaacccgtccggtaacgttccgaacgtaccggtaacgtacgggngtacgactaacgtaacgtacgttacggcgtcgtacgtaccgtactacgtccg

SEQ ID NO: 155980 - DNA, 675 bp, Homo sapiens
  misc_feature: GYAE6OF02JLF8E.29.67.G01.1.454.CMB.1.raw
  modified_base (239)..(239): a, c, t, g, unknown or other
  misc_feature (239)..(239): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgttgtttctgggcgagcgggccaccatcaactgcaagtccagccagactattttanatagctccaaacaataagtaattacttagtcttcggtaccagcaacgaaaccaggacagtcctacctaagctgcctactatttacgtcgggactataccgtacccgggaacgttcccggggtccctacggacccgtattccgtacggtcggtacgacggtcgggttacgtacgggactaggtactttacaacctactcgaagtttacttacggactacggaccttgacgtacggtactacgggaacgtagttcgtacgggtaccttaagtttttacttacgtaggtaccgtaacgacttaagtttaactttaactaccgttaacccgtaccccggtacgttaccgaccggtaacgggtaaccgaacgggtacgggataacgtaccgtaaccggtaaagtcggttaacgccgttaacggccctaccgtagttacccg

SEQ ID NO: 155981 - DNA, 732 bp, Homo sapiens
  misc_feature: GYAE6OF02JVJQH.29.67.G01.1.454.CMB.1.raw
  modified_base (264)..(264): a, c, t, g, unknown or other
  misc_feature (264)..(264): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtcgccgtacggggacatcgtgatcgacccagtctcagacctccctggctgtcgtttcgtgggcgaggacggccaccgatcaacttcaacgtccagccaagtaattattttactatagcctaccaaanaataacgtaattacttaagtcttaggtaaccagtacaacgtaaaccgaaggacacgtccctactaacgtctacgcctactactttacgcgggacctactccgtaacccgggtaacgttcccggggtaccctacggaccgtacgttccgtaaggtcggaccgtaggtccgggtcgtacggggactaacggttactttccgaactaccgtacgaggttacttacgacgtacgccgtacgcgtacgtcgtagacgtagttacgtcggtaccttagtttacgttacgttaggtactacgtacctaaattacttaacgttaccgttaacccgtacccgggttaccggttaaccggtacccgtaaccgggtacccggttaacgggtacgggtaaacggttaaccgtacggttaaaacccggtaagttaacggtacgtacggtaccggtactaacccggttacgtacgttaccgg

SEQ ID NO: 155982 - DNA, 636 bp, Homo sapiens
  misc_feature: GYAE6OF02IDZTQ.29.67.G01.1.454.CMB.1.raw
  modified_base (500)..(500): a, c, t, g, unknown or other
  misc_feature (500)..(500): n is a, c, g, or t
  modified_base (617)..(617): a, c, t, g, unknown or other
  misc_feature (617)..(617): n is a, c, g, or t
tcagatagagtactcacgaccggtgctcgatttagagtatacatattgggtttgggggagctacaacaggcaggcaggggcagcaagatggtgttgcagacccaggtcttcattttctctgttgctctggatctctggtgccgtacggggacatcgtgatgacccagtctccagactccctggctgtgtttctgggcgaggaggccacatcaactgcaagtccagccagaattattttatatagctaccaaacaaataaagtaattacttagtcttaggtaccagacaagaaaccaggacacgcctacctaagctgctctatttactcgggactaactccgtaacccggggtaacgtcccgggtacctcggaaccgtattcgaggtcgcgagggcggtacgtggacaggtacttacacgacttacgaagttatacgcgaacgccgttgacgtagggctaggaaggtagtcggtcggtaccttaagtttacttacgtcgtntaacgtactaaagttattaacttaacccgttacccgttacccgggtaacgtttcggaccgaacgggtaccggaagggtcggaagtacgtaaccgaaacggtaacgtggtcggtaccncgtacccaccgtattaccg

SEQ ID NO: 155983 - DNA, 651 bp, Homo sapiens
  misc_feature: GYAE6OF02IRO7V.29.67.G01.1.454.CMB.1.raw
  modified_base (191)..(191): a, c, t, g, unknown or other
  misc_feature (191)..(191): n is a, c, g, or t
  modified_base (242)..(242): a, c, t, g, unknown or other
  misc_feature (242)..(242): n is a, c, g, or t
  modified_base (322)..(322): a, c, t, g, unknown or other
  misc_feature (322)..(322): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttcngggcgagacgggccaccatcaactgcaagtccagccaagtaattattttanatagctaccaacaataagaattactagcttggtaccagcaagaaaccaggacacgcctacctaagctgctactatttacngggactatccgtacccggggtacgtcccggggtcctcgaccgtattcgaggttcggacgacggtcgggtacgtcgggactacgtactttcacgtactcgtagtactacgcgacgcctgacgtacggcgtagaagtagtggttcggtaccttaagttttacttacgtagtactacgtactaagttaactttacgtaaccttacccggtccccggtacgttaccgggaccgtaacggggtaccgtaacgggtacgggtaacggaacgttaaccgtaaaccggtaaggttccggttacggtaccggtaccgtaccgtaccgtacgtttcccg

SEQ ID NO: 155984 - DNA, 636 bp, Homo sapiens
  misc_feature: GYAE6OF02IGCLH.29.67.G01.1.454.CMB.1.raw
  modified_base (253)..(253): a, c, t, g, unknown or other
  misc_feature (253)..(253): n is a, c, g, or t
  modified_base (331)..(331): a, c, t, g, unknown or other
  misc_feature (331)..(331): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgccgtacggggacatcgtgatgacccagtctccagactccctggctgtgttctgggcgagaggccaccatacaactgacaagtccagccaagaattattttatatgcctaccaanaataagtaattacttagcttaggtaaccagtacaacgaaaccaggacacgcctacgtaagctgctactagttttacgnggcacgttaccgtaacccggggtacgttccccgggtaccctacggacccgtatttccgacggtggacgtacgggtcgggtcgtagggactagtacttcacgtactacgattatagcacgcgtgacaggtctaaggaagtgttcggtacgtaccttagtttactacgtgtacaacgtataaagttcttaacgtacttacccgtacccggttacgtccggaccgtacgggtaaccgaagggtacggtaaggtacgtaacgaaaccggtaacgtcggtacggtccgtacggtacctaccgtacgtacg

SEQ ID NO: 155985 - DNA, 741 bp, Homo sapiens
  misc_feature: GYAE6OF02GOUVN.29.67.G01.1.454.CMB.1.raw
  modified_base (239)..(239): a, c, t, g, unknown or other
  misc_feature (239)..(239): n is a, c, g, or t
tcagatagagtactcacgaccggtgctcgatttagagtatacatattggggtttgggggagctacaacaggcaggcaggggcagcaagatggtgttgcagacccaggtcttcatttctctgttgctctggatctctggtgcctacggggacatcgtgatgacccagtctccagactcctggctgtgtttctgggcgagacggccaccatcaactgacaagtccagccagaattatttanattagactcaaacgaataagtaattactagtaccgttaggaaccctagacaacgtaaaccgaggtaaccacggtcctacctaacgcgtcgtactacgtacgtttacgtgggacctaagttaccccgtaaccggggtaacgtccccgggggttaccctacggtaacccgtagtttaccgaacggtcgggtaaccgtaaccggggtcgggttaccgttaacggggaaacccgttaggtttaaccgttttacccgaacgtaccgtttaccggtaaagtttaacgttaaacggtacgtaacggtaccgttacgtacgttaacggcgttaacgaagttacggttgtaccggtacctaagtttactaacgtgtaccgagtactaagttactacgttaacctccgtacccggtaagtcgtaccgaagggtaccggtaacgtaggtaacggtaacgtagtaaaaccgtcggtaaggttaccggtagtacgaccgtactacggttaacccg

SEQ ID NO: 155986 - DNA, 572 bp, Homo sapiens
  misc_feature: GYAE6OF02FFQGK.29.67.G01.1.454.CMB.1.raw
  modified_base (151)..(151): a, c, t, g, unknown or other
  misc_feature (151)..(151): n is a, c, g, or t
  modified_base (312)..(312): a, c, t, g, unknown or other
  misc_feature (312)..(312): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacntaacgtgatgacccagtctccagactccctggctgtgtttctgggcagagggccacatcaactgcagtccagccagaatattttatatagctacaacaataagaattacttagcttggtaccagcagaaccaggacagcctcctaagctgctctatttacnggcatccgtaacccgggaatcccggggtaccctcggaccgtacttcgaggtcggctacggcgggtctaggggacaggtactttacactactacagtattagctacgcctgcaggctagagtatgtcggactatttatactgtacagtacaattattactacctaccgtaccccggtacgttaccgaccgtacgggaccgtaaggtacggagtacgtaacgtaaacgacgtacggtacggaccgtagacctacgtactccg

SEQ ID NO: 155987 - DNA, 139 bp, Homo sapiens
  misc_feature: GYAE6OF02IUOX4.29.67.G01.1.454.CMB.1.raw
  modified_base (109)..(109): a, c, t, g, unknown or other
  misc_feature (109)..(109): n is a, c, g, or t
  modified_base (129)..(132): a, c, t, g, unknown or other
  misc_feature (129)..(132): n is a, c, g, or t
  modified_base (134)..(139): a, c, t, g, unknown or other
  misc_feature (134)..(139): n is a, c, g, or t
tcagatagagtactcacgaccggtgctcgatttagagtatacatattgggtttgggctacagcggcctgggctgcctggtcaaggactacttccagtactctatctgancggctggcaaggcgcatagnnnngnnnnnn

SEQ ID NO: 155988 - DNA, 641 bp, Homo sapiens
  misc_feature: GYAE6OF02JW0H1.29.67.G01.1.454.CMB.1.raw
  modified_base (139)..(139): a, c, t, g, unknown or other
  misc_feature (139)..(139): n is a, c, g, or t
  modified_base (165)..(165): a, c, t, g, unknown or other
  misc_feature (165)..(165): n is a, c, g, or t
  modified_base (186)..(186): a, c, t, g, unknown or other
  misc_feature (186)..(186): n is a, c, g, or t
  modified_base (191)..(191): a, c, t, g, unknown or other
  misc_feature (191)..(191): n is a, c, g, or t
  modified_base (197)..(197): a, c, t, g, unknown or other
  misc_feature (197)..(197): n is a, c, g, or t
  modified_base (205)..(205): a, c, t, g, unknown or other
  misc_feature (205)..(205): n is a, c, g, or t
  modified_base (209)..(209): a, c, t, g, unknown or other
  misc_feature (209)..(209): n is a, c, g, or t
  modified_base (227)..(227): a, c, t, g, unknown or other
  misc_feature (227)..(227): n is a, c, g, or t
  modified_base (257)..(257): a, c, t, g, unknown or other
  misc_feature (257)..(257): n is a, c, g, or t
  modified_base (503)..(503): a, c, t, g, unknown or other
  misc_feature (503)..(503): n is a, c, g, or t
  modified_base (512)..(512): a, c, t, g, unknown or other
  misc_feature (512)..(512): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtnccgtacggggacatcgtgactgaccngtctcagacctcctggctgtntttcnggcagnggccacanccangacagtccagccagattntttagacagctacaacataagattactagnttagtaccagtacagtaaaccagacagcctactaagctgacctacgtacttactcgggactactaccgtaccgggtaacgtccgggtaccctggacccgtatttcgaacggttgggacgaacggccgggttaccgtgggaaccgttaggactttaccgaaccgttaccgtacgagtttaacgttacgacctacggactcgggtacacgggtctacggtaacgtagtcggtaaggtccttaagtttntaaccgttntacgtacgactacgttaactattccgtaacgtcccggagttccgtaccgtagggaccgtaaggcggtaacggacttaaccgaacgttaacgtcggtacggtacgtaccgaccgtacggtaccttaacgg

SEQ ID NO: 155989 - DNA, 505 bp, Homo sapiens
  misc_feature: GYAE6OF02GA5LJ.29.67.G01.1.454.CMB.1.raw
  modified_base (238)..(238): a, c, t, g, unknown or other
  misc_feature (238)..(238): n is a, c, g, or t
  modified_base (357)..(357): a, c, t, g, unknown or other
  misc_feature (357)..(357): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatattttanatagctccaacaataagaattacttagcttggtaccagcagaaaccaggacagcctcctaagctgctcatttactgggcatctacccgggaatccggggtccctgaccgatcagtcggnagcgggtctgggacagatttcacactcagtattagcagcctgcaggctgaagatgtggcctatttattactgtcagcaatattatctactcccgagtcgcgagaccgaaggcgaagatacaacgaactacgtggacgtgcaccactac

SEQ ID NO: 155990 - DNA, 585 bp, Homo sapiens
  misc_feature: GYAE6OF02GYSR4.29.67.G01.1.454.CMB.1.raw
  modified_base (323)..(323): a, c, t, g, unknown or other
  misc_feature (323)..(323): n is a, c, g, or t
  modified_base (436)..(436): a, c, t, g, unknown or other
  misc_feature (436)..(436): n is a, c, g, or t
tcagatagagtactcacgaccggtgctcgatttagagtatacatattgggtttgggggagctacaacaggcaggcaggggcagcaagatggtgttgtagacccaggtcttcatttctctgttgctctggatctctggtgcctacggggacatcgtgatgacccagtctccagactccctggctgtgtttctgggcgagagggccaccatcaactgcaagtccagccagaattattttatatagctaccaaacaataagtaattacttagtcttggtaccagcaagaaaccaggacagccctacctaagctgctctatttacgngggcacgtacgtacccgggaacgtcccgggtcctcgaccgtattcaggtcggcgtaggcgggtcgtagggacagtacttcactactcagtatagcacgtctgcgagctagagntgcgtactattactactgtcagtactaattaattacttaccgtaccgtaccccggtagttaccggaccgacggaccgaagggtacggaacgtacgtaacgaaaccgtaacgttacggtacgtaccgtcgacctaccgtacttcgtaccg

SEQ ID NO: 155991 - DNA, 730 bp, Homo sapiens
  misc_feature: GYAE6OF02HXRYR.29.67.G01.1.454.CMB.1.raw
  modified_base (118)..(118): a, c, t, g, unknown or other
  misc_feature (118)..(118): n is a, c, g, or t
  modified_base (126)..(126): a, c, t, g, unknown or other
  misc_feature (126)..(126): n is a, c, g, or t
  modified_base (167)..(167): a, c, t, g, unknown or other
  misc_feature (167)..(167): n is a, c, g, or t
  modified_base (193)..(193): a, c, t, g, unknown or other
  misc_feature (193)..(193): n is a, c, g, or t
  modified_base (203)..(203): a, c, t, g, unknown or other
  misc_feature (203)..(203): n is a, c, g, or t
  modified_base (239)..(239): a, c, t, g, unknown or other
  misc_feature (239)..(239): n is a, c, g, or t
  modified_base (372)..(372): a, c, t, g, unknown or other
  misc_feature (372)..(372): n is a, c, g, or t
  modified_base (432)..(432): a, c, t, g, unknown or other
  misc_feature (432)..(432): n is a, c, g, or t
  modified_base (460)..(460): a, c, t, g, unknown or other
  misc_feature (460)..(460): n is a, c, g, or t
  modified_base (589)..(589): a, c, t, g, unknown or other
  misc_feature (589)..(589): n is a, c, g, or t
  modified_base (658)..(658): a, c, t, g, unknown or other
  misc_feature (658)..(658): n is a, c, g, or t
  modified_base (699)..(699): a, c, t, g, unknown or other
  misc_feature (699)..(699): n is a, c, g, or t
  modified_base (705)..(705): a, c, t, g, unknown or other
  misc_feature (705)..(705): n is a, c, g, or t
  modified_base (723)..(723): a, c, t, g, unknown or other
  misc_feature (723)..(723): n is a, c, g, or t
tcagatagagtactcacgaccggtgctcgatttagagtatacatattgggtttgggggagctacaacaggcaggcaggggcagcaagatggtgttgcagacccaggtcttcatttctntgttgctntggatctctggtcgccgtacggggacagtcgtgatcgaccngtctcagctcccgtggctgtgttcgngggacgaggnggccacctatccaaacgtgacaacgtccgagcgaanaattattttacatacgactaccaaataaagtaataacttaacttagtcgttacggtaccaaggacaaaacgaaaacccgaaggaaccaccggtaccttaccgtaaaagcgtcgtccttactaattttaccggnggaccagttacccggtaaccgggaaccgttccgggttacccaggacccgtaatttccggngttacgggcaagggtcccgggggtttanaggggaacctaggttaaacttttccgaacctaacgttaccgagtttaaagttacgggacccaacgtcccgttaggccggaaacgggtcgttaaaggaaaagttcgtggtacggaacctttaaacttttntaaacggcgttaacggaaactacgttaaataacttttaaccgaacttccccgggaccgtaaagttccgngtaaccgggactagggagtaggtacaacgtaaaccgaacgnggttanaccggtacgacaaccgtntaaccgg

SEQ ID NO: 155992 - DNA, 627 bp, Homo sapiens
  misc_feature: GYAE6OF02GVSSL.29.67.G01.1.454.CMB.1.raw
  modified_base (254)..(254): a, c, t, g, unknown or other
  misc_feature (254)..(254): n is a, c, g, or t
  modified_base (321)..(321): a, c, t, g, unknown or other
  misc_feature (321)..(321): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgccgtacggggacatcgtgatgacccagtctccagactccctggctgtgtttcgtgggcgaggagggccaccatcaactgcaagtccagccagaattattttatatagctaccaanaataagaattacttagcttaggaccagcaagaaaccaggacagcctactaagctgctacatttacgnggacatccgtaaccgggaagtccgggtcctagaccgtattcgagtcggacaggtcgggtcgtacgggacaggtactttcaacgtactacgtagttatagcacgtacctggacagggtacgtagaagtagtaggtcggaccttagttttaattactgtacagtactaattaacgtttataacccttaccgtaccccggtaacggttccgtaccggaacggtaccggtaaagggtcggtaacggaagttaaccgaaacggtaaaccgtacggttacggtacctaccgggtaaccaccgtacgttaccg

SEQ ID NO: 155993 - DNA, 553 bp, Homo sapiens
  misc_feature: GYAE6OF02FMJF1.29.67.G01.1.454.CMB.1.raw
  modified_base (239)..(239): a, c, t, g, unknown or other
  misc_feature (239)..(239): n is a, c, g, or t
  modified_base (267)..(267): a, c, t, g, unknown or other
  misc_feature (267)..(267): n is a, c, g, or t
  modified_base (418)..(418): a, c, t, g, unknown or other
  misc_feature (418)..(418): n is a, c, g, or t
tcagatagagtactcacgaccggtgctcgatttagagtatacatattgggtttgggggagctacaacaggcaggcaggggcagcaagatggtgttgcagacccaggtcttcattttctctgttgctctggatctctggtgcctacggggacatcgtgatgacccagtctccagactccctggctgtgtttctgggcgagagggccaccatcaactgcaagtccagccagaatattttanatagctccaacaataagaattacttagnttggtaccagcagaaaccaggacagcctctaagctgctcatttactgggctatctaccccggggaatccggggtccctgaccgagttcagtggcagcggtctcgggacagtatttcactactcagtattagacagcctgcaggcagaagangtagcctatttactactgtacagataattaacttaattacctaacctccccggtaacgtccggaccgaacggaccgaaggtcggacgaactacgaaccgacgtacgtacggaccgttaggacctaccgattaccg

SEQ ID NO: 155994 - DNA, 731 bp, Homo sapiens
  misc_feature: GYAE6OF02GLY5F.29.67.G01.1.454.CMB.1.raw
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgaggacgggccaccgatcaactgcaagtccagccagaacttattttatatagtcctaccaaacaataagtaattacttagactttggtaccagtcaagaaaccaggacagcctaccgtaagctcgtctctatttacgtgggactactaccgtaaccccggggtaacgttccccggggtccctggacccgtattcgacggttcgggccgaggtccggggtcgtacgggggacctaggtacttttaccgacctaccgttacgtaacggttaatttaacggccgtaacgtcccgttaggcccgagggtaccttaagggaacggtagttcggtcggtaccttaagttttaacgtttacgttacgttacgacgtaacgttaaatttaaacttttaaccttaaccgttacccgttacccccgggtaaccgtttcccgggacccggtaacgggtaaccggtaacggggtaacgggaacggtaacgtaaccgtaaaacgtaacgtacggtaggtaccgtaccgtactaacccgtagttacccgg

SEQ ID NO: 155995 - DNA, 590 bp, Homo sapiens
  misc_feature: GYAE6OF02GIW4N.29.67.G01.1.454.CMB.1.raw
  modified_base (241)..(241): a, c, t, g, unknown or other
  misc_feature (241)..(241): n is a, c, g, or t
  modified_base (282)..(282): a, c, t, g, unknown or other
  misc_feature (282)..(282): n is a, c, g, or t
  modified_base (305)..(305): a, c, t, g, unknown or other
  misc_feature (305)..(305): n is a, c, g, or t
  modified_base (448)..(448): a, c, t, g, unknown or other
  misc_feature (448)..(448): n is a, c, g, or t
tcagatagagtactcacgaccggtgctcgatttagagtatacatattgggtttggggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggcccacatcaactgcaagtccagccagtaattattttanatagcctaccaacaataagaattacttagcttgtacctagnagaaaccaggacagacctctaanctgctctatttactgggactactccgtaacccggggtaacgtcccggggtccctaggtacccgtacttcaggtggcaggtacggtcgtgggacagtagttcacactactagtattagctagccgtgactagggtctaggtaanagtgtacggccttaatttacgttactgtacagtactaattagttactaccttaccgtaccccgtacgtccgtacgacggacgtacggtaggtacgtacaacgtaacgtacgtacgtcggtcgtacgacgtacgtacttaccg

SEQ ID NO: 155996 - DNA, 781 bp, Homo sapiens
  misc_feature: GYAE6OF02IU9CG.29.67.G01.1.454.CMB.1.raw
  modified_base (191)..(191): a, c, t, g, unknown or other
  misc_feature (191)..(191): n is a, c, g, or t
  modified_base (334)..(334): a, c, t, g, unknown or other
  misc_feature (334)..(334): n is a, c, g, or t
tcagatagagtactcacgaccggtgctcgatttagagtatacatattgggtttgggggagctacaacaggcaggcaggggcagcaagatggtgtgccagacccaggtcttcatttctctgttgctctggatctcctggtgcctacggggtacagtcgtagatagaccagtctcagactcctgctgtgttcnggctagaggccaacatcaactcgacaacgtcacgccaagaattatttaagatagctaacgaactaataaagtaacttactagtcgtgtaacagacaagaaaccgaggacacgtacctacgtaagtcagtacctagtattacgnggctactaccgaaccggtagtcccgggtacctcggaccgtaattcgaaggtggactaggccgggtatacggggactaagtactttcgaacgtactacgaacgttaagttacgacgtaacgcgttaacgacgtaacggtaccgttaagaaacgttacggttaccggtttaacggaaccgtttttaaacttttaaacggtttaaccgtacgtttaaacctaaacgggtaacctttaaaaacgttaacgttaaaccgtttaaaccgtttacccccggttaaacccgggttaaccgttacccggtaaacccgggtaaccgggttaaaccggttaaaaccgggggtacgggttaaaacccggtaacgggttaaccgtaaaaaacccgggtaacccgtttagggtaaccgggttacccgtaaccggtaacggttacccgtaaacgttacccgg

SEQ ID NO: 155997 - DNA, 132 bp, Homo sapiens; identical to SEQ ID NO: 155630
  misc_feature: GYAE6OF02FYM4J.29.67.G01.1.454.CMB.1.raw
  modified_base (130)..(132): a, c, t, g, unknown or other
  misc_feature (130)..(132): n is a, c, g, or t

SEQ ID NO: 155998 - DNA, 511 bp, Homo sapiens
  misc_feature: GYAE6OF02G8T3L.29.67.G01.1.454.CMB.1.raw
  modified_base (509)..(509): a, c, t, g, unknown or other
  misc_feature (509)..(509): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatattttatatagctccaacaataagaattacttagcttggtaccagcagaaaccaggacagcctctaagctgctcatttactgggcatctacccggaatccgggtcctgaccgattcagtgcagcgggtctgggacagatttcactacctcagtattaagcagacctgcaggctagaagatgtaggcctatttatactgtcagcaattattactactaccgtcccgtacgtccgcgaggaccgaaggtggagacgtacaacgtactagtcgcgtgcacntc

SEQ ID NO: 155999 - DNA, 625 bp, Homo sapiens
  misc_feature: GYAE6OF02FHVKU.29.67.G01.1.454.CMB.1.raw
  modified_base (237)..(237): a, c, t, g, unknown or other
  misc_feature (237)..(237): n is a, c, g, or t
  modified_base (319)..(319): a, c, t, g, unknown or other
  misc_feature (319)..(319): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagatattttanatagctaccgaacaataagtaattacttagctttaggtaccagcaagaaacccagtacagcctcctaagctgctcatttacnggctatccgtacccggggtaatcccggggtccctcggaccgtattcgaaggtcggctaggcgggtctaggggacagtactttacacacctacagtacttacgactacgcctgactagggcctaggaacgtatcggtacgtacctattttacttacgtagtaccgaagtacgtaaattaacttaacttaccgtaaccttaccccgggtaacgtccggtaacgtaaccgggtaaccgaacgggttacggaagtaccgtaacgaaaccgtaacgtacgtacggacgtcggtacgtacccgtattacccg

SEQ ID NO: 156000 - DNA, 713 bp, Homo sapiens
  misc_feature: GYAE6OF02H1PIP.29.67.G01.1.454.CMB.1.raw
  modified_base (151)..(151): a, c, t, g, unknown or other
  misc_feature (151)..(151): n is a, c, g, or t
  modified_base (194)..(194): a, c, t, g, unknown or other
  misc_feature (194)..(194): n is a, c, g, or t
  modified_base (241)..(241): a, c, t, g, unknown or other
  misc_feature (241)..(241): n is a, c, g, or t
  modified_base (253)..(253): a, c, t, g, unknown or other
  misc_feature (253)..(253): n is a, c, g, or t
tcagatagagtactcacgaccggtgctcgatttagagtatacatattggggtttgggggagctacaacaggcaggcaggggcagcaagatggtgttgtagacccaggtcttcatttctctgttgctctggatctctggtgcctacgggganatcgtgatgacccagtcctccagacctcctggctgtgtttcgngggcgagacggccaccatcaactgcaagtccagccagtaatatttanatagctaccaanaataaagattaacttagcttggtaccagccaagaaaccaggacagcccttactaagctcgctctatttacgtggacagtccgtacccgggaactcccggggtccctggaccgtattcgagtggcgaggtcggggtctaggggacctaggtactttccaactacctagtaacgtacgttagcgtaacgtcctaggtcagggcctaggtaaagtagttacggttacggtaccttaagttttaacttacgtacgttacgtaagtaacctaaagtttaacgtttaactaacccgtttaacccgttacccccggggtaaccggtttaccgggaacccggtaaaccggggtaacccgtaaacggggttacgggtaaacggtaacggttaaacccgaaacggttaaaccgtcgggtttaaccggccgttaccggtaacccgaacccgttacggttcctttaacccgg

SEQ ID NO: 156001 - DNA, 741 bp, Homo sapiens
  misc_feature: GYAE6OF02F03MO.29.67.G01.1.454.CMB.1.raw
  modified_base (325)..(325): a, c, t, g, unknown or other
  misc_feature (325)..(325): n is a, c, g, or t
tcagatagagtactcacgaccggtgctcgatttagagtatacatattgggtttgggggagctacaacaggcaggcaggggcagcaagatggtgttgcagacccaggtcttcattttctctgttgctctggatctctggtgcctacggggacatcgtgatgacccagtctccagactccctggctgtgtttctggcgagagggccaccatcaactgcaagtccagccagtaattattttatatagcctaccaacaataaagaattacttagctttggtaccagcaagaaaccaggacagcctacctaagctcgctctattttacgngggctatcgtaccgggaacgtccgggtcccgtacgacgtacttctacgtggcgagccggggttcgtcgggacgtagtacgttacctaccgtaactcacgttaagttacgtacgacgtccgtcgtacgacggtacggtacgtaaagacgttacggttcggtaccggttaacttttaacgttttaccgttacggtttaccgaacgtacgttaaaacgttaaacttttaaccgtttaaaccgttaacccccgtttacccccggggtaacccggtttaccccgggtaaccggggtaacccgggtaaacccgggttaaacgggttaacggggtaacggaaacgtttaaccggaaaacccggttaaaccggttacggttaccgggtaccggttaccggaccgtaaccccgacgtttaacccg

SEQ ID NO: 156002 - DNA, 650 bp, Homo sapiens
  misc_feature: GYAE6OF02F5IMP.29.67.G01.1.454.CMB.1.raw
  modified_base (240)..(240): a, c, t, g, unknown or other
  misc_feature (240)..(240): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgaggagggccaccatcaactgcaagtccagtccagaatattttanatagctaccaacaataagtaattacttagctttaggtaccagcaagtaaaccagggtacacgacctaccgtaagctcgactctatttaacgtggcacgtcgtacccggaacgttccggggtccctcgaccgtattcgagttcggactacggcggtcgtcgggactaggacttttccactaccgtactaacggttaacttgacgtacgtccgtacgtcgtacggacgtacggtaagagtacggcggttaccgtaactttagttaccttaggtccgtaagtcgttaaagtacttacgttaaccttaccgtacccggtaccgttacgtacgtacggtaccggaacgttacgggaacgattaaccggaaacgttaacggtacgttacggtacgtacgtaccgtaacacgttacg

SEQ ID NO: 156003 - DNA, 790 bp, Homo sapiens
  misc_feature: GYAE6OF02G1CRO.29.67.G01.1.454.CMB.1.raw
  modified_base (248)..(248): a, c, t, g, unknown or other
  misc_feature (248)..(248): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgccgtacggggacatcgtgatcgacccagtcctccagacctcccgtggctgtgtttcgtgggcgagacgggccaccatcaactgcaagtccagccaagtaattattttanatacgcctaaccaaactaataaagtaatttaccttagctttaggtaaccagaccaaacgaaaaccgaggaaccacggtaccccttaccgtaaacgtccgtacggccttactaacgttttaccgggtagggaccctaaccgttacccggtaaccccgggggtaaccgtttacccccgggggtaccctaacgggtacccgttagttaccgagggttacggaccggtacgggtacccggggttacgtacggggtaaacctaaggtttacctttacccgaaaccgtaccgttaccgtaaacggtttacgtttaaacggaccgtaaccggtccccgttaggaccgtaagggtcccgtaaggaaggttacgttacggttaccggtaacttaagttttacgttcgtacgtactaaccgtataactttaacttacgttaacccgttacccgtacccggtacgttaccggaaccggtaacgggaccggtaagggtacggtaacgaacgtaacgaaacgtacgtggtacgtcgtacggacctactcgttacg

SEQ ID NO: 156004 - DNA, 630 bp, Homo sapiens
  misc_feature: GYAE6OF02HWUZL.29.67.G01.1.454.CMB.1.raw
  modified_base (259)..(259): a, c, t, g, unknown or other
  misc_feature (259)..(259): n is a, c, g, or t
  modified_base (419)..(419): a, c, t, g, unknown or other
  misc_feature (419)..(419): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttcgtgggcgaggagggccaccatcaactgacaacgtccagccaagtaattattttatatagcctaccaaanaaataagtaattacttagtcttaggtaccagacaagaaaccaggacagacctacctaagctgctctactttacgtggctatccgtaaccgggacgtcccggggtcctacgaccgtattcgagtggcgacggtcgggtctagggacagtacttcactactntagtattagcagtccgtgacgaggtctagaagtacgttggtacgtctttaagtttacttacgttgtaccgaagtactaactttattaaccttaccgttacccggtaccccggtacggttccggaccgaacggggaaccggtaacgggtggtaacgtaacgtaccgtaaaccggtaacgttcggtacggccgttacgaccgtaccgcgttcg

SEQ ID NO: 156005 - DNA, 733 bp, Homo sapiens
  misc_feature: GYAE6OF02HNT3E.29.67.G01.1.454.CMB.1.raw
  modified_base (240)..(240): a, c, t, g, unknown or other
  misc_feature (240)..(240): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgccgtacggggacatcgtgatgacccagtctccagactccctggctgtgttctgggcgagagggccaccagtcaactgcaagtccagccagaattattttanatagctaccaacaataagaattacttagcttggtaccagcaagaaaccagaacagacctcctaagctgccttactacgtttacgtggcattccgtaacccgggtagtccggggttaccctggacccgtattaccgaggtcggaccgtaggacgggtcgtggggaacctaaggttactttacgacgtactcgtaacggttaatttaacggaccgtaagtccgtagaccgtagggtacctaaggaaaggtagttacgggacggttacccttaagtttttaaccgttaaccgtttaggtaccgtaagtaaccgttaaagttaacctttaacgttaaccccgtttaacccgggttaacccccgggtaaccgtttaccgggtaacccggtaacgggtaaccccgtaaggggttaacgggaagtaaccgtaaacgtaaacccgggtaaacgttcggtaccggggttcgtaacccggtacctaaccccgtattaccccgg

SEQ ID NO: 156006 - DNA, 739 bp, Homo sapiens
  misc_feature: GYAE6OF02G2Y3P.29.67.G01.1.454.CMB.1.raw
  modified_base (195)..(195): a, c, t, g, unknown or other
  misc_feature (195)..(195): n is a, c, g, or t
  modified_base (203)..(203): a, c, t, g, unknown or other
  misc_feature (203)..(203): n is a, c, g, or t
  modified_base (245)..(245): a, c, t, g, unknown or other
  misc_feature (245)..(245): n is a, c, g, or t
  modified_base (327)..(327): a, c, t, g, unknown or other
  misc_feature (327)..(327): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgccgtacggggacatcgtgatgacccagtctccagacctcccgtggctgtgtttcgngggcgagnggccaccatcaactgacaacgtccagccaagaattattttanatagctaccaaacaataagaattacttagcttggtaccagacaagaaaccaggacacgcctacgtaagctgctctattacgnggcagtccgtacccgggaatcccgggtacctgaccgtattcgaggtcggacacggcgggtcgtaggggacaggttacttaccgaactaccgtacgtaacgttacgtttacgacgtaaccggtccgttaggaccgtacggtaccgtaggaaagttagtttcgggacgtaaccgtttaacgttttaaacgtttcgtaacggttaccaaggtaaccttaaaacgtttacgtttaaaccgttacccgtttaaccccggtacccccgggttaaaccgtttaccccggggtaaccgtaaaccgggggtaaacccggtaaagggtttaaccggggaaacgtaacgttaaacccggtaaaaccggtaaaccgttcggtacgggtaaccggttaccggaaccgtaccccgtagttacccgg

SEQ ID NO: 156007 - DNA, 743 bp, Homo sapiens
  misc_feature: GYAE6OF02GHQOT.29.67.G01.1.454.CMB.1.raw
  modified_base (239)..(239): a, c, t, g, unknown or other
  misc_feature (239)..(239): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgagcgagagggccaccatcaactgacaagtccagccagaatattttanatacgctaccaacaataagaattacttagtcttggtaccagcagaaaccaggacacgcctacctaagctgctctaatttacgtgggctatccgtaacccgggaacgtcccgggggtccctacgaccgtattcgaggtcggacgacggcgggtcgtagggacaggtacttttaccgactaccttacgtacggttaattacggaccgtacgtacccgtcggaccgtacgggtacgtaaggtaaacggtacgttcgggtacggtacccgttaatttttaaccgtttaaccgttcggttaacgtaacgtaacttaaacgtttaacttttaaaccgttaacccgttaccccggttaaccccccggggtaaccgtttacccgggtaacccggtaaaccggggtaaacccggtaaacggggtaacggtaaccgggtaacgttaacccggtaaaaccggtaaccggttacgggtaaccgggtaccgtttacggtaccctacccggttaaccg

SEQ ID NO: 156008 - DNA, 572 bp, Homo sapiens
  misc_feature: GYAE6OF02ITF1A.29.67.G01.1.454.CMB.1.raw
  modified_base (554)..(554): a, c, t, g, unknown or other
  misc_feature (554)..(554): n is a, c, g, or t
tcagatagagtactcacgaccggtgctcgatttagagtatacatattggggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccaagaattatttatatagcctaccaacaataaagaattacttaagcttaggtaccagacaagaaaccaggacagcctcctaagctgctctatttactggcatccgtacccggggacttccgggccctgaccgtattcaggtggacagggcggtctggggacagtatttccacactcgagttatagacacgcctgcgaggactagaagagtggtcggtaccttaattttacttactgtacctagtactaattattactacctaccgtcccggtacgtcgaccgtacggaaccgtaggtcggtaagacgtacgaacgtaacgtagtcggngtcgacgtacctataccg

SEQ ID NO: 156009 - DNA, 657 bp, Homo sapiens
  misc_feature: GYAE6OF02F46K2.29.67.G01.1.454.CMB.1.raw
  modified_base (240)..(240): a, c, t, g, unknown or other
  misc_feature (240)..(240): n is a, c, g, or t
tcagatagagtactcacgaccggtgctcgatttagagtatacatattggggtttgggggagctacaacaggcaggcaggggcagcaagatggtgttgcagacccaggtcttcatttctctgttgctctggatctctggtgcctacggggacatcgtgatgacccagtctcagactccctggctgtgtttctgggcgaggagggccaccatcaactgcaagtccagccagaattattttanatagcctaccaacaataagtaattacttagcttggtaccagcaagaaccaggacagcctcaagctgctctatttactggacataccgtacccggggtaacgtcccggggtccctggaccgtattcgaggtcggcgaggcgggtcgtaggggacaggtatttccactactacgagtatacgcgagtccgtgacgtacgggtctagggaagtagtcggtacggtccttaagttttacttacgttcgtacgacgtactaaattactttaacttaacccttaacccggttccccggtaaccggttacccgggtaacccggaacggggtaacccggtaagggtaacggtaacggaacgttaacccgaaacgtaaccgttacgggttcggtaaccggtcggtacctaacccgtatttacccgg

SEQ ID NO: 156010 - DNA, 578 bp, Homo sapiens
  misc_feature: GYAE6OF02HCVES.29.67.G01.1.454.CMB.1.raw
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagacgggccaccatcaactgcaagtccagccagaattattttatatagctccaacaataagaattactagcttggtaccagcagaaccaggacagcctcctaagctgctcactttactgggcagtcgtaaccccgggaacgtcccggggtaccctcgtaacccgatttcaggtggccgaggcgggttcgtaggggacctaggtactttcgacctacctacgacgtattacgcgacgtcctgaccgaggcgtagaaggtagttcggtacggtcctaattttacttactgtctaagctaattattactacctaccgtcccgtacgttcgaccgacggtacgaggtcgaagactaacgaagacgtagtcgtacgcgacactatcc

SEQ ID NO: 156011 - DNA, 804 bp, Homo sapiens
  misc_feature: GYAE6OF02IRTXH.29.67.G01.1.454.CMB.1.raw
  modified_base (796)..(796): a, c, t, g, unknown or other
  misc_feature (796)..(796): n is a, c, g, or t
tcagatagagtactcacgaccggtgctcgatttagagtatacatattgggtttgggggagctacaacaggcaggcagggggcagcaagatggtgttgcagacccaggtcttcatttctctgttgctcgtaggatctcgtggtcgccgtaacggggacatcgtgatcgacccagtctccagacctccgtgtctgttcgtttcgtggggacgaggacgggacccaacctactaccaacgtcgacctaaacgtcccgacgaccgaagtaaactttatttttaagaatacgtacctaaccaaaacaaaattaaaacggtaactttaacgttaacgtcgtttaacggtaacccgagaacgaaacgaaaacccgaggtaacaccggtaccccttaaccgtaaacgggtccaggttacctaccgttaacgttttaccggtagggcctaaacgttcccggtaaccccgggggtaacgttcccccggggtacctaccggtaaccgtactttaccggaacggttcggaaccgtacggggtccggtcgggtaaacgggtaactacggtaacttaccgtacgaacgttactaaggtactacggcaacgcccgtgacgaggtcgaagtaggtcttggaccgtctttaaatttcgtaacctgtacgtaacgtaacttaagttaactaacgtaacccctttccgggtaccgacggtttaccgggaaccgtaaccgggtacggtaacgggtaactcggtaaccaaacgtaaacgaccggtttggaaccgttcggaaacccttcaacccggtnttttaccg

SEQ ID NO: 156012 - DNA, 672 bp, Homo sapiens
  misc_feature: GYAE6OF02G9G1D.29.67.G01.1.454.CMB.1.raw
tcagatagagtactcacgaccggtgctcgatttagagtatacatattgggtttgggggagctacaacaggcaggcaggggcagcaagatggtgttgcagacccaggtcttcatttctctgttgctctggatctctggtgccgtacggggacatcgtgatcgacccagtcctccagacctccctggctgttgtttcgtgggcgaggacgggccaccgactcaacgtcgacaacgtccagccagaattattttatatacgctaccaaactaataagtaacttactagtcgttacggtaaccagacaacggaaacacggacacgacctaccgtaagctacgctactatttacgcggtactactaccggtaacccggtacggttccgggtaccctacgtaccgtacttcgaggttcggacgtacggtcgggtcgtacgggtacgacgttacgtttaccgactacgtcgttaaggtaacttacgaccgtacggtcgtacgaccgtaggtacgtaggaaggtacgttacgggtacgtacttaagttttactagttcgacgtataactaacgttaattaacttaccgtacccgtacccgtcggtacgaccggtaggtaacggacggtacgaaggtaacgaacgtaacgtagtacgtcgacgtacgacgtactacgtacg

SEQ ID NO: 156013 - DNA, 565 bp, Homo sapiens
  misc_feature: GYAE6OF02F5K99.29.67.G01.1.454.CMB.1.raw
  modified_base (386)..(386): a, c, t, g, unknown or other
  misc_feature (386)..(386): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatattttatatagctaccaacaataagaattacttagcttggtaccagcagaaaccaggacagcctctaagctgctcatttactgggcatcctacccgggaatcccggggtcctgaccgattcagtggcaggcgggtctgggacagatttcacactnagtattagcagcctgcagctgaagtatggtaggcctatttactacgttgtacagtctaaattattaactaacttaccgtaccccggtacgttaccggaccgtaacggaccgaagggtgggaacgtacgtaacgtaaaccgaacgtacggtacggtcgtactaccgtaccgtattacccg

SEQ ID NO: 156014 - DNA, 681 bp, Homo sapiens
  misc_feature: GYAE6OF02II8UL.29.67.G01.1.454.CMB.1.raw
tcagatagagtactcacgaccggtgctcgatttagagtatacatattggggtttgggggagctacaacaggcaggcaggggcagcaagatggtgttgcagacccaggtcttcatttctctgttgctctggatctctggtgcctacggggacatcgtgactgacccagtctccagactccctggctgtgtttcgtggcggagagggccaccatcaactcgacaagtccacgaccagtaattattttaactatagacctaccaaacaaattaaagaattaactttagacctttaggtaacccagaccaaacgaaacccgaacggaacacgacccttacctaaacgtctggtaccttactaacgtttaacgtcgggactaccgttaccgtaacccggggaacgttcccgggtaccctcggaactacttcgagttcgacgtacggcgggtcgagggacagtcgtttaccagtactcgagttaacttaggactacgtcgtagccaggtctaaggaactagtcggcggtaccttagtttaattccgagtcaaggtctaaattacttaacttccttaacccggtacccggttacgtacgtaccggtaacggaaccggtaagggtacggaacgtacgtaaacggtaaacgaaacggttcggacgtaccgtaggaccctacgtactccgg

SEQ ID NO: 156015 - DNA, 664 bp, Homo sapiens
  misc_feature: GYAE6OF02I18BG.29.67.G01.1.454.CMB.1.raw
  modified_base (252)..(252): a, c, t, g, unknown or other
  misc_feature (252)..(252): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttcgtgggcgagagggccaccatcaactgcaagtccacgccagaatattttatatagctaccaanaataagaattacttagcttaggtaccagcaacgaaaccgaggacagcctaccaagcctgctactattacgtggctatccgtaccgggactcccggggtccctagtaccgtagttcgaggttcggcacggtcgggtacgtaggggaaactactttacgactacgtcctagtacttaagacacgccgtcgcgacgacgttagaaacgtagttacgtacgggtccttaatttacgttactacggttacaagtaccgtaaatacgtttaacttaaccgtaacccgtttaaccccggaccgtttacccggaacccgtacgggtaacccggtaaggtaacgggaacggttaacaaccggtaaaaccggaacgttacggtaaggccgttacggacctaaccgtactccgttttttaccg

SEQ ID NO: 156016 - DNA, 732 bp, Homo sapiens
  misc_feature: GYAE6OF02GDVDG.29.67.G01.1.454.CMB.1.raw
  modified_base (273)..(273): a, c, t, g, unknown or other
  misc_feature (273)..(273): n is a, c, g, or t
  modified_base (468)..(468): a, c, t, g, unknown or other
  misc_feature (468)..(468): n is a, c, g, or t
tcagatagagtactcacgaccggtgctcgatttagagtatacatattgggttggggagctacaacaggcaggcagggcagcaagatggtgttgcagacccaggtcttcatttctctgttgctctggatcgtctggtcgccgtaggggactatcgtagattcgaccctaggtctccgagtacctcccgtggtctagttcgtttcgagggccgtaggacggaccaactgtaccaacgttggacctacgtaccgacggccaagtaattagttttanaacgtacgctaccaataacgtaagtacttatacggtcttacggtacagactaacgaaacgtggaacctagccctacgtagcgtacgtctactaacgttttacgccgggataccgttaccggtaacccggtacgttccccggggtccctaggaacccgttagttacgaacggtcgtacgtagggtaccggttacgnggtaaccgatttaccgtttcaaccgtacgtacgtaagttacgtacgcgaacgttcggatcgggtactcgtaggaacgttcggtaacgtcggttaactacgttttacgtacgcgtttaagagttaccctaaatttcggttaacctccgtaccgtacggttaccgtacggtacgtaccggtaacgttacgggtaagtactacgttaacccggaaagttcccggttcgttaacggaccgttacggacttacccggttagttacccgg

SEQ ID NO: 156017 - DNA, 687 bp, Homo sapiens
  misc_feature: GYAE6OF02H7DG4.29.67.G01.1.454.CMB.1.raw
  modified_base (242)..(242): a, c, t, g, unknown or other
  misc_feature (242)..(242): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagacctccctggctgtgtttcgtgggcgagagggccacatcaactgcaacgtccagccaagaattattttanatagctaccaacaataagaattactagccttaggtacctagacaagaaaccgaaggacacgtacctacctaagctgcttacatttacgcggcacgtccgtaacccgggactcccggggtcctacgacccgtatttcgaggtcggacgaggtccgggtacgtagggaacaggttacttcgaacctacgtacgtaagtacgtttacgacgtaacggccgttaggccgtaacggtcgttaaggaacgtagttcggtacggtaccttaagttttactaacgttcggtacaacgtacttaaattaacttaacgttaacccgttacccgttaccccgggtacgttacccggtaacccggaacgggtaaccgtaaggggtcggaagttaacgaaccgttaaaacgacgttacggttacggaccgtacggacccgtaaccctacgttaaccgg

SEQ ID NO: 156018 - DNA, 664 bp, Homo sapiens
  misc_feature: GYAE6OF02GYOTD.29.67.G01.1.454.CMB.1.raw
  modified_base (191)..(191): a, c, t, g, unknown or other
  misc_feature (191)..(191): n is a, c, g, or t
  modified_base (237)..(237): a, c, t, g, unknown or other
  misc_feature (237)..(237): n is a, c, g, or t
  modified_base (333)..(333): a, c, t, g, unknown or other
  misc_feature (333)..(333): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactcctggctgtgttacgnggcgagaggccaccatcaactgcaagtccagccaagattattttanatagctaccaacgtaataagtaatttactaagtcgtttacgtaccagacgaagaaccgaggactagccttacgtaagccttgactctaagtttcgnggactacgtaccgtaccggggtaatccccggggttacctagtacccgtattcggtacgtacggacgtacggtcgggttacgtcgggaactagttacgttaccacgtactcgagttacgtaagtcacgtacgtacgtcgtacgtccgtagtaacggtagtacgtcggttactacgtttacgttacgtacgttacgacgttacgtaagttaacgttacttaaccgttaaccgtacccggtaacgtacggtaccggacggtaaccgtacggtacggtaacgtacgtaacgtaaccggtagtacggtacgtcgtactaccggtactacgttaccg

SEQ ID NO: 156019 - DNA, 834 bp, Homo sapiens
  misc_feature: GYAE6OF02JFVEV.29.67.G01.1.454.CMB.1.raw
  modified_base (214)..(214): a, c, t, g, unknown or other
  misc_feature (214)..(214): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacagttcgtgatgacccagtctccagactccctggctgtgtttctggcgagcgggccacatcactnacaagtccagccagaattattttaatatagctaccaactaataagaatttaacttaagtcgtttaggttaaccagaccgtaaagaaaccctaaggtaacacggtaccctaccgtaaacgccgtacgctacctagtttacgtggtaccgtataccgtaacccggggtaacgttcccggggtaccctaggtacccgtacgttccgacggtacgggtccgagggtccggttacgtggggtaaacctacggttaagttttccaacctacgttaccgtagtttaacttacggaccttaacggtacctccggtacggtacggtaccggttagtaacggtacggttcgtacgggacccctttaaaggtttttaccttaaccggtttacgtaaccgtaacgggtaccttaaagtttaacgtttaaactttacccgtttaaacccggttaccccggtaaacccggttttacccgggtaacccggttaaccccggggtaaaccgggttaaacggggtaaccggggttaacggttaaccggttaaaccggtaaaccgggttaaacccggttaacgggttaccggttaaccgggtaccggtttaaccccgaacggttaacccgttaacccgg

SEQ ID NO: 156020 - DNA, 733 bp, Homo sapiens
  misc_feature: GYAE6OF02II0Z3.29.67.G01.1.454.CMB.1.raw
  modified_base (139)..(139): a, c, t, g, unknown or other
  misc_feature (139)..(139): n is a, c, g, or t
  modified_base (195)..(195): a, c, t, g, unknown or other
  misc_feature (195)..(195): n is a, c, g, or t
  modified_base (244)..(244): a, c, t, g, unknown or other
  misc_feature (244)..(244): n is a, c, g, or t
  modified_base (294)..(294): a, c, t, g, unknown or other
  misc_feature (294)..(294): n is a, c, g, or t
  modified_base (389)..(389): a, c, t, g, unknown or other
  misc_feature (389)..(389): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtnccgtacggggacatcgtgatcgacccagtcctccagactccctggctgtgtttcgngggcgaggaggccaccatcaatgacaagtccagccagtaattattttanatacgctaccaaataataagaattctagtcttaggacagacaagaaaccnggacacgtcctactaagctcgtcctacgtattacgtcggactaactcccggtaaacccggggtaacgtccccggggttacctcggtaaacccgtntttaccggtacgggtcggaaacccgtacgggggtcccgggtttaccgtagggggtaaacctaacggttaaccgttttacccgaaccttaccgtaaccgttaaggttaaacgttaacgtacccgaaccggtaccgttacggaccggtaacggtccggtaaggaaacggtcgtacggttacggtacccttaagtttacgtaaccgttcgttaccgtaagtacctaattaacgttaacttaaccgtacccggtacccggtaccgttaccgtaccgtaaccgggacggtaacggtacggaacgtacgaacgtaacgacgttacgtacgcgtacgactacggtactacg

SEQ ID NO: 156021 - DNA, 639 bp, Homo sapiens
  misc_feature: GYAE6OF02IMKD9.29.67.G01.1.454.CMB.1.raw
  modified_base (507)..(507): a, c, t, g, unknown or other
  misc_feature (507)..(507): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgccgtacggggacatcgtgatgacccagtctccagactccctggctgtgtttctgggcgagagggccaccatcaactgcaagtccagccaagaattattttatatagcctacaaacaataaagtaatttacttagcttaggtaccagcaagaaaccaggacagccctacctaagctgtactctatttacgtggctacgtccgtacccgggtaacgttccccggggtacctcgacccgtatttcgaggtcggacgcggtacgggtcgtcgggactagtacttttacacctactactaggttaacttcgacgacgtcgtacgacgacggtacgtagaagtagtcgtacggtaccttagtttactaccgttntacgaactacgaatttaagtacttaaccgtacccgttacccggtaccgttacggaccgtaacgggtacgtaacgggtcggtaacgacgtaacgtaaacgtacgtacggtacgacggtcgactaccgtatacg

SEQ ID NO: 156022 - DNA, 664 bp, Homo sapiens
  misc_feature: GYAE6OF02IBGOI.29.67.G01.1.454.CMB.1.raw
  modified_base (243)..(243): a, c, t, g, unknown or other
  misc_feature (243)..(243): n is a, c, g, or t
  modified_base (330)..(330): a, c, t, g, unknown or other
  misc_feature (330)..(330): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttcgtgggcgaggacgggccaccatcaactgcaagtccagccaagaattattttanatacgctaccaaacaataaagtaattacttaagtcttaggtaccagacaagaaaccaggacaggcctactaagctgctctatttacngggcatccgtaaccgggaagtcccggggtcctcgaccgtattcgaggtgcaggcggtcgtagggacaggtactttcactactcgaagttaataggctaacgccttaggacgaacgggtcgtaaggaaacggtacgtacggtacggtaccttaagttttaacgttactcggtacaacggtaactaaagttaactttaacttaaccgttaccgtacccccggttaacgttaccggaaccggtaacggggtaaaccgtaagggtaacgggtaagtaaccgtaacgtaaaaccggtaacgtacggtacggaccgtaggaccgtaaccgtagttaccgg

SEQ ID NO: 156023 - DNA, 769 bp, Homo sapiens
  misc_feature: GYAE6OF02ILHQT.29.67.G01.1.454.CMB.1.raw
  modified_base (169)..(169): a, c, t, g, unknown or other
  misc_feature (169)..(169): n is a, c, g, or t
  modified_base (601)..(601): a, c, t, g, unknown or other
  misc_feature (601)..(601): n is a, c, g, or t
  modified_base (634)..(634): a, c, t, g, unknown or other
  misc_feature (634)..(634): n is a, c, g, or t
tcagatagagtactcacgaccggtgctcgatttagagtatacatattgggtttgggggagcgtacaacaggcaggcaggggcagcaagatggtgttgcagacccaggtcttcatttctctgttgctctggtatctctggtgcctacggggacagtcgtgatcgtacccngtcctccagtacctcccgtggccttggtgttttcgtgggtcgaggtacggcccaccatccaaacgttcaagttcccaggcccaagtaacttactttttaagatagtcctaccaaataaattaactaaactttacttaacggcttttaacggtaaccctagacaaacgaaaacccgaggtaaccacggtcctaccgtaacgacttgaccgttctaacgtttacgtcgggtacctaagtccctaacccggggtaacgttccccggggtcccttaaggaccccgtattaccggacggtggaccgtacgggtaccggggtcgttacggggacaacgggttactttaccgaacgtaaccgttcgtaacggttaacctttacgggaccttaaacgggtcccctggaaccgtaggggtcccttaagggaagttaacggnggttacggtaacccttaaggtttacctttacgngtttaccagtacctaattactttaacaccttacccgacccgtaggttaccacggtacgacggtaacggtcggaagtaccgtacggtaaacgaaccgttaggtacgtaccggtacgtcggtaaccctgaaccttgg

SEQ ID NO: 156024 - DNA, 682 bp, Homo sapiens
  misc_feature: GYAE6OF02F5DII.29.67.G01.1.454.CMB.1.raw
  modified_base (197)..(197): a, c, t, g, unknown or other
  misc_feature (197)..(197): n is a, c, g, or t
  modified_base (249)..(249): a, c, t, g, unknown or other
  misc_feature (249)..(249): n is a, c, g, or t
  modified_base (332)..(332): a, c, t, g, unknown or other
  misc_feature (332)..(332): n is a, c, g, or t
tcagatagagtactcacgaccggtgctcgatttagagtatacatattgggtttgggggagctacaacaggcaggcaggggcagcaagatggtgttgcagacccaggtcttcattttctctgttgctctggatctctggtcgcctacggggacagtcgtgatgacccagtcctcagacctcccgtggctgtgtttcgngggcgaggacggccacatacaacgtgacaagtccagccaagtaattatttanatagctacaacaataagaattacttagcttgtaccagtcaacgaaccgaggactacgcctacgtaagctgtctatatttacgnggctatccgtaccggacgtcccgggtcctgaccgtattacgaggttcggacgcggtacgggtcgtacgggaactaggtacttttacacgttactacgtacgtagtacgcgtacgccgtacgacgacggtacgtagaacgtacgtaggttacggtaccttagtttacgttcgtacgtacgtaacgtactaattaacgttacgttaccgttacccggtacccgggttaaccggtttaccggaccgggtaaccggtaaccgggtaacggggttacggaacggtaacgtaaccgggtaaaactaaccggttacggtacggttaccgtaccggtaccctaccgtacgttacccgg

SEQ ID NO: 156025 - DNA, 689 bp, Homo sapiens
  misc_feature: GYAE6OF02JFQYZ.29.67.G01.1.454.CMB.1.raw
  modified_base (242)..(242): a, c, t, g, unknown or other
  misc_feature (242)..(242): n is a, c, g, or t
  modified_base (408)..(408): a, c, t, g, unknown or other
  misc_feature (408)..(408): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgccgtacggggacatcgtgatgacccagtctcagactccctggctggtgtttcgtgggcgaggacgggccaccatcaactgcaagtccagccagaattatttanatagcctaccaaacaataagtaattaacgttagtactttcggtaaccagtacaacgtaaaccaggaactacgaccctacctaaagctgtacctctaatttaccggtgggctaatccggtaacccggggtaacgtccccgggggtacctcggtaaccgatttaccgnggttcggcacgggtcggtcgtaggggactaggtactttcgaactctacgaagttacgtagtaccgagcctacggcgtaacgggctaacgggtaagtactcggttacggtacctaagttttaacttaccgtgtacctaggtactaaattactaacttaccgtaaccgtcccggtaggttaccgaccgtacgggtaaccgacgggttaacggaacggtaactaaccggtaaaacgaccggttaaggtcggttaacccgttcggtaccgtacctacgttaccgg

SEQ ID NO: 156026 - DNA, 875 bp, Homo sapiens
  misc_feature: GYAE6OF02HJDMS.29.67.G01.1.454.CMB.1.raw
  modified_base (199)..(199): a, c, t, g, unknown or other
  misc_feature (199)..(199): n is a, c, g, or t
  modified_base (258)..(258): a, c, t, g, unknown or other
  misc_feature (258)..(258): n is a, c, g, or t
tcagatagagtactcacgaccggtgctcgatttagagtatacatattggggtttgggggagctacaacaggcaggcaggggcagcaagatggtgttgcagacccaggtcttcatttctctgttgctctggatctcgtggtgccgtacggggacagtcgtgatcgacccagtctccgagacctcccgtggctgtgttcgngggcgaggacggcctaaccatcaacctgcatcgtaccagtaccgagtaatttattttancgtaacggtccttaaccaaaactaaaggttaaacgtaactttacgttacgtccgttacgggtaaccaagtacgaaacgaaaccgtaacgggctaccgtacccttaacccgtaagccgttaccgacctttacgtaacgttttaccggcgggtacctaacggttaccccggaaccggggtaccgttccccgggggtacccacggaccgttattccgagggtacggccgtaacgggtcgggtacgtaggggactaacggtctttaccgaaccgtacgtattaacgttaattaccgggcacggtaccgtcggtaccggtaacggtccgttaaaggaaggtttacgggtaccggttaccggtaacccgtttaaatttttcccgggtttaaccgtcggggttaacctaaacggtacccgttttaaagttaaacccgtttaccgttaacccccggttaaacccggttcccccggtttaagggttccccgggtaaaacccggtaaccggggtaacccgggtttaacggtaaccggggtaacggtaaacccgggttaaaccggtaaaccggttaacccggtggggttacccgggtacggttaaccgcccggttaacgttaccccgg

SEQ ID NO: 156027 - DNA, 883 bp, Homo sapiens
  misc_feature: GYAE6OF02H2BC1.29.67.G01.1.454.CMB.1.raw
  modified_base (201)..(201): a, c, t, g, unknown or other
  misc_feature (201)..(201): n is a, c, g, or t
tcagatagagtactcacgaccggtgctcgatttagagtatacatatgggtttgggggagctacaacaggcaggcaggggcagcaagatggtgttcgcagacccaggtcttcatttctctgttgctcgtggatctctggtgcctacggggacatcgtgactggacccagtcctccacgacgtcccgtggctgtacgtttcgngggcgaggacgggtacccaccgattccgaaacgtggtacctaaaaggttcccaaggacccctaaaggtaaactttaagtttttaaatacttacggcctttaccgaaaacctaaaagttaaccggtaaaatttaaacccgtttagggttacctttacggggttaaaccccaacggtaaccttaacggaaaaaccccgtaagggtaaccctaacgggtccccttaacccgtaaaacggtccttaccgggtaccttaccgtaaacggttttttaccggacggggtacccgtaacgtttacccggtaaacccccgggggtaaacggttcccccggggggttaccccgttacgggtaaccccccgtaagtttttacccgggaaagggtttacggggacccttaaacggggtcccggggttacgtcgggggtaaaaccctagggtaaccttttacccggaaccgtaccgttaccgtaaggttacgtttaacggccgtaacgtcccgtagacggtaggacctagggtaaaagccgttggtaacgacccgtttaattaacgttaccgtagtaccgaagtactaacgttatacgttaccgtaaccggtacccggtagttaccgaccgtaacggtaccaagggtcgacgtagtaacctaacgacgtggacgtcctcgaccgtctacgtaccg

SEQ ID NO: 156028 - DNA, 667 bp, Homo sapiens
  misc_feature: GYAE6OF02FJHRD.29.67.G01.1.454.CMB.1.raw
  modified_base (242)..(242): a, c, t, g, unknown or other
  misc_feature (242)..(242): n is a, c, g, or t
  modified_base (254)..(254): a, c, t, g, unknown or other
  misc_feature (254)..(254): n is a, c, g, or t
  modified_base (327)..(327): a, c, t, g, unknown or other
  misc_feature (327)..(327): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgaggagggccaaccatcaacttcaagtccagccaagaattattttanatagctaccaanaataagaattacttagtcttggtacagtcaagaaaccaggacagaccctacctaaagctgctacactttacgngggacattccgtaacccgggtaacgttcccggggtaccctaggaccgtattcgagtacggcacggcgggttacgtaggggacctaaggtacttttacgaacactaccgaagttacttacggactacggccttaggactaggtactacgaaagtagttgtacgtacgttaatttacgtttacgtagtactacgaactaaattaacgttaataacccgttaccgttaccccggaacgttcggttaaccgaacggtaccgtaacgggtacggtaacggacgttaaaccgtaaaccgtaaacgttacgtcggtacgtacgtacgaaccctacgttcgttaaccg

SEQ ID NO: 156029 - DNA, 625 bp, Homo sapiens
  misc_feature: GYAE6OF02FI6OF.29.67.G01.1.454.CMB.1.raw
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatattttatatagctccaacaataagaattacttagcttggtaccagcagaaaccagacagcctcctaagctgctctatttactgggcatcctaccccggggtaactccggggtccctcggaccgacttcagtggcaggcgggtctgggacagatttcactactcagtattagcagcctgcaggctagaagatgtggaccctattttacttactgttacagtactaaattagtttaacttaccgttaacccgttacccccggtaacggttacccggtacccggtaacggggtaacccgtaaacggggttaacgggtaacggtaaacgtaaccgtaaaaccgtaaacggttacggttacgggtaccgttacggtacccgtaacccgtagttaacccg

SEQ ID NO: 156030 - DNA, 763 bp, Homo sapiens
  misc_feature: GYAE6OF02JMQY2.29.67.G01.1.454.CMB.1.raw
  modified_base (192)..(192): a, c, t, g, unknown or other
  misc_feature (192)..(192): n is a, c, g, or t
  modified_base (616)..(616): a, c, t, g, unknown or other
  misc_feature (616)..(616): n is a, c, g, or t
  modified_base (751)..(751): a, c, t, g, unknown or other
  misc_feature (751)..(751): n is a, c, g, or t
tcagatagagtactcacgaccggtgctcgatttagagtatacatattgggtttgggggagctacaacaggcaggcaggggcagcaagatggtgttgcagacccaggtcttcatttctcttgttgctctggatctctggtgcctacggggacatcgtgatgacctagtctccagactccctggctgtgtttcngggtcgagtacgggcctaccgattccaacgtgccaagtccagccagaattatttttataatagccttaccaaactaaagtaaacgtaatttaaccttaagtctttcggtaaccagcaagaaacccagggtaccaagtcctaaccgtaaaggtccctacgtctaactttacggtttaccgaggtaccgttaacgtacccggttaaaccccgggggaccgttccccgggggttacccacgggtaccctaacgttcgagggttccacgggtacggtcggggttacgtacggggactaacgtacggttttccaaccgtacttacgaagtttaactacggtaacctcgtaccggttcgaccggtacggtacgtaagtaaacgttcggttacggtaccggtacctttagtttacttacgtacgttaaccnggttaacctaagtttaagtaacccttacgtttacccgtaccggttacggtccgtaaccggtaccgaacggtaacggtcgaaacggttactaacccggtaaagtaccttacgggttacgaccggtacgtaaccccngttaacctacgg

SEQ ID NO: 156031 - DNA, 679 bp, Homo sapiens
  misc_feature: GYAE6OF02FJUDP.29.67.G01.1.454.CMB.1.raw
  modified_base (243)..(243): a, c, t, g, unknown or other
  misc_feature (243)..(243): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaattattttatatanctaccaacaataagtaattacttagtctttaggtaccagacaagaaaccaggacagccctacctaagctgctactatttactgggtctataccgtacccgggaacgtcccggggtccctcgaccgtacttcacggtggcgacggtcgggtcgtaggggtactaggtacttttcgactactacgtaacgttagttaacggtctaacggtccgtagaccgtacgggtacgtaggaaaggttacgttacggttacggtacccttaacgttttaactttacgtcggttacctacggtactaacgtttaagttaaccttaccttacccgttaccccggtacggttaccgtacccggtacgggtacccggaagggtacgggtacgaacgtaacgaaccgtaacgttcggtacggtacgtacgtaccgtaccgtacgttaccg

SEQ ID NO: 156032 - DNA, 696 bp, Homo sapiens
  misc_feature: GYAE6OF02G8M2Q.29.67.G01.1.454.CMB.1.raw
tcagatagagtactcacgaccggtgctcgatttagagtatacatattgggtttgggggagctacaacaggcaggcaggggcagcaagatggtgttgcagacccaggtcttcattttctctgttgctctggatctctggtgcctacggggacatcgtgatgacccagtctccagactccctggctgtgtttccgtgggcgagacgggccaccatccaacttcaagtccagccagtaatattttatatagctaccaacaataagaattacttagacttacggtaccagacaagaaaccaggacacgtccctaccgtaagccttcggctactatttacgtcgggactagtcccgtaaccccgggaagtcccggggttccctgaacccgtagtcgagtcggactacgggcgggtcgtagggacctaagttactttacacgaaccgtcgaacggttattaacgacgtaaccgcctacggcgaacgggcctagggaaaggtcgttggtaccggtacgttaactttttaacgttacctagtacgtaacgacccgtttaaaatacgtttaacgttaaccccgttaccgttaaccccgggtaccggttaacccggtaccggaaaccgggaccggtaacgggtaggaacggactaacggaaacccgtaagtccggtagtaccgtacggtaccaccgtctacgtccg

SEQ ID NO: 156033 - DNA, 680 bp, Homo sapiens
  misc_feature: GYAE6OF02JMQ5C.29.67.G01.1.454.CMB.1.raw
  modified_base (278)..(278): a, c, t, g, unknown or other
  misc_feature (278)..(278): n is a, c, g, or t
  modified_base (648)..(648): a, c, t, g, unknown or other
  misc_feature (648)..(648): n is a, c, g, or t
  modified_base (672)..(672): a, c, t, g, unknown or other
  misc_feature (672)..(672): n is a, c, g, or t
tcagatagagtactcacgaccggtgctcgatttagagtatacatagttgggtttggggagctacaacaggcaggcagggcagcaagatggtgttgcacgacccaggtcttcatttctctgtgctctgtatcttcgtggtcgccgtacgggactactcgtgatcgtaccccgtagttcctccaagtcccttcccgtggcttgttgtttcggtgggttacgaagggccggccacctataccaacgtgacaacgtccgagacctaagtaatttacttttanagtactacctaccaaactaaagttaagtaactttactaacgtcgttaggtaccagtacgaaacgaaaccgaggaactaccgtacccttacgaacgtcctacgactttacgttacttacggcgggtacctacgtcccgtaacccgggtaacggtcccggttccagacccgtattcgagtcggcgacggtcggtgacggtactcgtacttcacactctagtacgtacgacgtactccgagacgacgtacgtaagaagtcgtaggtcgtacttttacttacgttactcgtacgataacttaagttacttaccttaaccgtaccgtacccgagttacccgacgtaccggaacgtacggtaaggtacgacggtanaacggacgttgtcggcgtacaccncgtactcg

SEQ ID NO: 156034 - DNA, 710 bp, Homo sapiens
  misc_feature: GYAE6OF02JDFKI.29.67.G01.1.454.CMB.1.raw
  modified_base (156)..(156): a, c, t, g, unknown or other
  misc_feature (156)..(156): n is a, c, g, or t
  modified_base (177)..(177): a, c, t, g, unknown or other
  misc_feature (177)..(177): n is a, c, g, or t
  modified_base (189)..(189): a, c, t, g, unknown or other
  misc_feature (189)..(189): n is a, c, g, or t
  modified_base (238)..(238): a, c, t, g, unknown or other
  misc_feature (238)..(238): n is a, c, g, or t
  modified_base (686)..(686): a, c, t, g, unknown or other
  misc_feature (686)..(686): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtnatgacccagtctcagactccnggctgtgttcgnggacgaggacggccacatcaactgacaagtccagccagaattattttanaagtgactaccaacaataaagaacttacttagacttacggtaccagacaagaaaaccgaggaaccacggtaccctacctaaacggcttaggtcctacgtaatttaccgtagggactacgtacccgtaacccggggaaccgtcccgggggttaccctggaacccgtatttcgacggttaggacggaggtccgggtacgtacggggactaacggttacgttacgacgtaaccgtacgtaagttaactacgggtacaacgggtccttaggccgttaaggacgtacggaacggtagttacggtcggtaacttaacgtttatttaacggtacgttacgtaactaccgtaaattaagttaacttaaccgttacccgttacccggtaacgtccgggtaaccgtacggaccggtaaggtaacggtacgaaggttaaccaacgtaaccgtgtacggngtaccgaccgtactagttacccgg

SEQ ID NO: 156035 - DNA, 656 bp, Homo sapiens
  misc_feature: GYAE6OF02I9Y7F.29.67.G01.1.454.CMB.1.raw
  modified_base (193)..(193): a, c, t, g, unknown or other
  misc_feature (193)..(193): n is a, c, g, or t
  modified_base (242)..(242): a, c, t, g, unknown or other
  misc_feature (242)..(242): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatcgacccagtctccagacctcctggctgtgtttcgngggcgagacggccaccatcaactgcaagtccagaccagaattattttanatacgccttaccaaacaataaagaactttacttaagcgtttaggtaaccaggacaaacgaaaaccgaggaaccacggcccttacctaaagcctagacctacgtaacttttacgcggctactaccgtaacccggggaattccccggggtccctagacccgtatttacgaggttcggacgtacggtccgggtacgtacggggaacctaggtactttacgaccgtaactcgtaagttacgttacgcgacgtctagcgaaggctagaaagtcgtgacggtacttagtttactcgtgtcagtacgtaacttatactaccgtaccgtccggaacgttcggaccgtacggaaccggtacggtaacggtacgtacgtaactaaccggtaagtcgtacggtcgtacggtacgaccagttaccg

SEQ ID NO: 156036 - DNA, 807 bp, Homo sapiens
  misc_feature: GYAE6OF02JU8B9.29.67.G01.1.454.CMB.1.raw
  modified_base (254)..(254): a, c, t, g, unknown or other
  misc_feature (254)..(254): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtcgccgtacggggactatcgtgatcgacccagtctccagtacctccctggctgttgtttcgtggacgagacggccaccagtcaactgaccaagtccagaccaagtaattacttttanatacgaccttaccaaactaaagtaaacgtaacttaaccgttagtccgtttacggtaaccaagtaccaaacgaaaacccgtacggaacctaccggtacccttaaccgtaaagccgttacgtaccttaccttagtttaacccggtgggtaccctaacgttaaccccggtaacccgggggtaacggttcccccggggttaacctaccggtaaccgttacgttcgtaacgggtcggtaccggtacgggtccgggttacttaggggaaaccttacggtaactttaccgacgtaacgttacgtaacggttactacgtaccgtaacgtccgtacgtacggaacgttcgtaaggtactaacggttcgtacggttaaaccttgttttaactaccggtatacggtaactaacttaactttacgttacctaacccgtaccgttaccccggtaaggtacccggtaactaccgggtaaactccggggtaagtaacggttaccaacccgttaaacggtaacgttaccggtacgtacccgtacgggtaccttaccggacctttaccgg

SEQ ID NO: 156037 - DNA, 709 bp, Homo sapiens
  misc_feature: GYAE6OF02HN9PG.29.67.G01.1.454.CMB.1.raw
  modified_base (139)..(139): a, c, t, g, unknown or other
  misc_feature (139)..(139): n is a, c, g, or t
  modified_base (191)..(191): a, c, t, g, unknown or other
  misc_feature (191)..(191): n is a, c, g, or t
  modified_base (238)..(238): a, c, t, g, unknown or other
  misc_feature (238)..(238): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtncctacggggacatcgtgatgacccagtctccagactccctggctgtgtttcngggcgagacggccaccatcaactgcaagtccagccagaattatttanatagctaccaacaataagaattactagcttaggtaccagacaagaaccgaggacacgacctactaagctagactacgtaactttacgtcgggactacgtacccggtaaccccggggaagttccccggggtaccctacggtacccgtatttaccgaacggttcggacgtacgggtccgggtctacggggacctaaggtactttaccgacctacgtactaaggttacttacggtaccgtacgtcccgttaggacgtacgggtaccttaggaaacgttacgttacgtacggttaaccctttaagttttacgttaccgttagtaccgtaagtactttaaacgttaattaccgttaccgttacccggtacccggtaccgttaccggacgtaaccgggacgtaagggtacggtaaccgtacgtaaacgaacccggtaagttcggtaggaccgttaccgaccgtacgtacgttacccg

SEQ ID NO: 156038 - DNA, 727 bp, Homo sapiens
  misc_feature: GYAE6OF02G52OB.29.67.G01.1.454.CMB.1.raw
  modified_base (195)..(195): a, c, t, g, unknown or other
  misc_feature (195)..(195): n is a, c, g, or t
  modified_base (243)..(243): a, c, t, g, unknown or other
  misc_feature (243)..(243): n is a, c, g, or t
  modified_base (255)..(255): a, c, t, g, unknown or other
  misc_feature (255)..(255): n is a, c, g, or t
tcagatagagtactcacgaccggtgctcgatttagagtatacatattgggtttgggggagctacaacaggcaggcaggggcagcaagatggtgttgtagacccaggtcttcatttctctgttgctctggatctctggtgccgtacggggacatcgtgatgacccagtcctccagacctccctggctgtgtttcgngggcgagacggccaccatcaactgcaagtccagccagaattatttatntagctaccaaanaataagtaattacttagcttacggtaccagcaagaaaccgaggaacacgaccctaccgtaaagtcgtcgcctactacgttttacgtagggactacgtaccgtaacccggggtaacgttcccgggggtacccctacggaaccgtacgttacgaacgggttcggaccgtaacgggtccgggttcggttacggggaaccggtagttaacgtttaccgacgtaccttaccgaaggtttaacgtttaacgaccggtacggtacccttcgggaaccgacgggttacgtaacgggagttaacggttcggtacggttaccttaagtttacttacgtagtccaaggtaccttaaagtacttaacgtacttaacccgttcccggtaacggttaccgacgtaaccgggtacgaacgggaggtaacgacgtaacgaaaccggtacgttacggcggttcaccggttactaactcgtaccgttacg

SEQ ID NO: 156039 - DNA, 630 bp, Homo sapiens
  misc_feature: GYAE6OF02IHD3I.29.67.G01.1.454.CMB.1.raw
  modified_base (244)..(244): a, c, t, g, unknown or other
  misc_feature (244)..(244): n is a, c, g, or t
  modified_base (256)..(256): a, c, t, g, unknown or other
  misc_feature (256)..(256): n is a, c, g, or t
  modified_base (411)..(411): a, c, t, g, unknown or other
  misc_feature (411)..(411): n is a, c, g, or t
  modified_base (419)..(419): a, c, t, g, unknown or other
  misc_feature (419)..(419): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagacctcccgtggctgtgtttctgggacgagaggccaccagtcaactgacaagtccagccaagaattattttanatgctaccaaanaagtaagtaattacttagctttggaaccagacaagaaacccagggaacacggacccttaccgtaagctagcttacgtactttacgtcgggactacgttccgtaacccgggagttcccgggtcctagactcgtattcgagtcgacgaggtcgggtntagggacncggttattccgaactacctgtaattacttagcgtacgtcccgtagcgaggtactagaagtgtgtacgtacttatttactacgtgttacacgtataattacgttaacttccgtaaccgtacccgggttgtaccggtacgtaaacgggtaccggaaggtacggaacgtaacgtaacgtaacgacgttacgggtctccggatacctacccgtac

SEQ ID NO: 156040 - DNA, 613 bp, Homo sapiens
  misc_feature: GYAE6OF02FFL8O.29.67.G01.1.454.CMB.1.raw
  modified_base (366)..(366): a, c, t, g, unknown or other
  misc_feature (366)..(366): n is a, c, g, or t
  modified_base (401)..(401): a, c, t, g, unknown or other
  misc_feature (401)..(401): n is a, c, g, or t
tcagatagagtactcacgaccggtgctcgatttagagtatacatattgggtttgggggagctacaacaggcaggcaggggcagcaagatggtgttgcagacccaggtcttcattttctctgttgctctggatctctggtgcctacggggacatcgtgatgacccagtctccagactccctggctgtgtttctgggcgagagggccacatcaacctgcaagtccagccagaattattttatatagcctccaacaataagaattacttagctttggtaccagcaagaaacccaggacagcctcctaagctgctcatttactggcatccgtacccggggaatcccggggtcctgaccgattcagtggcnggtcggtgtgggacagatttcacactcatagtacntacgtcctgccgaggacgtagaacgtagtggtcggtcccttaattttactttaccgttgtaccaagtactaaatttattaacttaccgtaacccgttaccccggtaaccggttccggtacccgtaacgggaacccgaagggtacggaacggtaactaaccgtaaaccgtaacgtacggttacgggtcgtaccggccgtaccgtacttacccg

SEQ ID NO: 156041 - DNA, 532 bp, Homo sapiens
  misc_feature: GYAE6OF02F15AP.29.67.G01.1.454.CMB.1.raw
  modified_base (309)..(309): a, c, t, g, unknown or other
  misc_feature (309)..(309): n is a, c, g, or t
  modified_base (341)..(341): a, c, t, g, unknown or other
  misc_feature (341)..(341): n is a, c, g, or t
  modified_base (364)..(364): a, c, t, g, unknown or other
  misc_feature (364)..(364): n is a, c, g, or t
  modified_base (374)..(374): a, c, t, g, unknown or other
  misc_feature (374)..(374): n is a, c, g, or t
  modified_base (402)..(402): a, c, t, g, unknown or other
  misc_feature (402)..(402): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgaccagtctcagactccctggctgtgtttctgggcgagagggccacatcaactgcaagtccagccagaatattttatatagctccaacaataagaattacttagcttggtacagcaagaaccaggacagtcctctaagctgctcatttacngggcatcgtaccggaagtccgggtcctgacgnttcagtggagcggtctggacagnttcgactctntagtatagactagctgacaggctgaagngtaggcggtcttaagtttacttacgtgtacagactaatatataccttacgacccgtacgtcgacgaacggacgagtacggtggtagagtaacgaaacgtacgtagtacggtcgtacggctaccgattacg

SEQ ID NO: 156042 - DNA, 667 bp, Homo sapiens
  misc_feature: GYAE6OF02FSDYX.29.67.G01.1.454.CMB.1.raw
  modified_base (267)..(267): a, c, t, g, unknown or other
  misc_feature (267)..(267): n is a, c, g, or t
  modified_base (346)..(346): a, c, t, g, unknown or other
  misc_feature (346)..(346): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatcgacccagtctccagacctcccgtggcttgttgtttcgtgggcgaggcgggccaccatcaacttcaacgtccagaccaagtaacttattttataatacgcctaccaaanaataaagtaattacttagtcttacggtaccagacaagaaaccgaggacacgccctactaacgctgacctctatttacgngggactacgtaccgtacccgggacgttcccggggtcctacggaccgtagttcgagtcggacgaggtccgggtacgtgggactaggtactttccgactcgtacgtagttatacgacgacgtccgtagtacgaggtcgtagagtacgttgtcggtacttatttacttacgtgtactagacttaagttacttaactaccgttaccgtaccccggtacggttaccggaccgtaacgggtaccgtaacgggtaggaacgtaaccgttaaccggaaacgtaaccgttcggtacggtccgtacggtaccaccgttacctcggttaccg

SEQ ID NO: 156043 - DNA, 826 bp, Homo sapiens
  misc_feature: GYAE6OF02IJU4W.29.67.G01.1.454.CMB.1.raw
tcagatagagtactcacgaccggtgctcgatttagagtatacatattgggtttgggggagctacaacaggcaggcaggggcagcaagatggtgttgcagacccaggtcttcattttctctgttgctctggatctctggtcgccgtacggggactatcgtgatcgacccagtctccacgactcccgtggctgttgtttcgtgggcgaggacggccaccatcaactgccaacgtccacgaccaagtaattattttatatacgctaccaaacaaataaagtaactttaacttagtcgttacggtaaccagacaacggaaaaccgaggaacacgtcctaccgtaagctcgctactaactttcgtaggaccagtaccgtaacccggggtacggttcccgggtcctacgtaccgtagttacgaggtcggacacgggtcgggttcgacgggtaactacggtacttttcgaccctaactttccgtaagtttaaacgttcgaaccgtaccggtccgtttacggaccgaacgggttccgtaaaggtaaacggttaggttacgggtcccgtttaaaccgttaagttttttaaaccgtttaaccggtaccggtttaataaacggttaaaccttaaaagttttaactttttaaaccgtttaacccgttttaaaccccgggtccccccgggtttaacggttacccgtaacccggggttaaccgggaaccggttaaaccgggggtaaggtaaaccgggtaaccgttaaaaccggaaacccggttaaaacggtttcgggttaacggtccgtttaaccgtaaccgtaacccgtactttaccgg

SEQ ID NO: 156044 - DNA, 687 bp, Homo sapiens
  misc_feature: GYAE6OF02FI7Y1.29.67.G01.1.454.CMB.1.raw
tcagatagagtactcacgaccggtgctcgatttagagtatacatattggggtttgggggagctacaacaggcaggcaggggcagcaagatggtgttgcagacccaggtcttcatttctctgttgctctggatctctggtgccgtacggggacatcgtgatcgacccagtctccagacctccctggctgttgtttcgtgggcgaggagggccaccatcaactgacagtccacgaccaagaattattttatatacgcctaccaaactaaataagtaattacttagactttacggtaccagccaagaacgaccgaggaccacgccctaccaacgtctgctactatttaccgtggcctagtacccggtaacccgggaacgttcccggggtccctacggaccgtacgttcgaggtcgggcagggtccgggtcgtgggaacgtaggtactttacgacgacgtactaagtagttacgcgtagccgtaggtcgaacgggtctaacgggaagtacggttcggtacggtacctttaacgttttacgtttaacgtcggtacgtaacgaacgtttaaattaacgtttaactaccctaaccccggttaccccggttacggtcccgtacgggaacccgggtaaccgtagggtaacggacgtacgtaacgtaacgacgtcggtaggactcggtaccacgtac

SEQ ID NO: 156045 - DNA, 141 bp, Homo sapiens
  misc_feature: GYAE6OF02FU129.29.67.G01.1.454.CMB.1.raw
  modified_base (130)..(141): a, c, t, g, unknown or other
  misc_feature (130)..(141): n is a, c, g, or t
tcagatagagtactcacgaccggtgctcgatttagagtatacatattgggtttgggcacagcggccctgggctgcctggtcaaggactacttccagtactctatctgagcgggctggcaaggcgcatagnnnnnnnnnnnn

SEQ ID NO: 156046 - DNA, 856 bp, Homo sapiens
  misc_feature: GYAE6OF02F07GC.29.67.G01.1.454.CMB.1.raw
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctgctgtgtttctgggcgagagggccaccatcaactgcagtccagccagtaattattttataatagctaccaacaataaagtaatttacttagctttagggtaccctagaccaagaaacccacggaactacgcccttactaaagccttcgaccttcgtaattttaccgtgggtactaacgtaccgtaaaccccggggaagtccccggggttaccctacgtacccgtaagtttccgacggttacggaccgtagggtccgggggtaccgttacgggggaaccgaaggttaacgttttacccgaaccgttaacccgttaccgtaaacggttaacttaaccggtaccgtacgggtaccccgtttacggaccgtaaccggggtacctagggttaaaaccgggtagttacggttaccgggttacccttaaacgtttttaacgttaaccggttacgtaaccgaacgttaaccgtaaaacgtttaaagttttaacccgttaaacccggttaaccccgttacccccggggtaacgtttaccccgggtaacccggtaaacccggggtaaccggtaaaccggggtaacgggtaaacggtaaacccgttaaaccggtaaacccggtaaacggttacggttaaccggggtacccgttaaccggtaccccgtaaccggtaccgttaaccccgg

SEQ ID NO: 156047 - DNA, 572 bp, Homo sapiens
  misc_feature: GYAE6OF02HW96Y.29.67.G01.1.454.CMB.1.raw
  modified_base (238)..(238): a, c, t, g, unknown or other
  misc_feature (238)..(238): n is a, c, g, or t
  modified_base (387)..(387): a, c, t, g, unknown or other
  misc_feature (387)..(387): n is a, c, g, or t
tcagatagagtactcacgaccggtgctcgatttagagtatacatattggggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagaggccaccatcaactgcaagtccagccagaatattttanatagctaccaacaataagaattactagcttgtaccagcagaaacagacagcctctaagctgctctatttactgggcatcctacccgggaagtccggggtccctacgaccgattcagtggcaggcggtcgtgggacagtattcacactanagtatacgctagcctgcgagcgtagaagatggtgtacctatttatactgtactagtctaattaattaacttactaccctacccggtacgttaccggaccgtaacgggaaccgtaacgggtaacggtacgtaacgtaaccgtaaacgtaacgtcggtaggtaccgtcggtaccaccgtagttaccg

SEQ ID NO: 156048 - DNA, 700 bp, Homo sapiens
  misc_feature: GYAE6OF02HDFIJ.29.67.G01.1.454.CMB.1.raw
  modified_base (249)..(249): a, c, t, g, unknown or other
  misc_feature (249)..(249): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagacctcccgtggctgttgtttcgtgggcgaggacgggccaccatcaactgacaacgtccagccaagtaattattttanatagcctaccaaactaaataagtaattacgtagtcttagtaaccagcaaacgaaaccaggacacgacctactaagctgcctactatttacgtgggacctagtaccgtaacccgggtacgtcccgggtaccctacggacctacgttcgtacggtcggaccgacgggtccgggttacgtacggggtactaggttactttaccgaccgtactacgtaagttacgttagaccgtcgtcctagacggtacggacgtaggtaagttagtacggttcgtacctttaagttttacttacgttcgtacgattacttaaatttaccttaacgttacccgttaccggtacccggttacgtacccggtacgtaaccgggaacggtaccgggaaggtacgtaacgtaaccgtaaaccggttaagccggttacggacgtacccggtactacccgtaggttacccc

SEQ ID NO: 156049 - DNA, 736 bp, Homo sapiens
  misc_feature: GYAE6OF02FZQMQ.29.67.G01.1.454.CMB.1.raw
  modified_base (511)..(511): a, c, t, g, unknown or other
  misc_feature (511)..(511): n is a, c, g, or t
  modified_base (516)..(516): a, c, t, g, unknown or other
  misc_feature (516)..(516): n is a, c, g, or t
tcagatagagtactcacgaccggtgctcgatttagagtatacatatttggggtttgggggagctacaacaggcaggcaggggcagcaagatggtgttgcagacccaggtcttcatttctctgtgctctggatctctggtgtccgtacggggactatcgtgatcggacccagtcctccacgtacctcccgtggcttgttgtttcgtgggcgtaggacggccacctatacaactgacaagtccagaccaagtaatttatttaatatacgctaccaaataataaagtaatttacttagtcttacggtaaccagtacaacgtaaaccgaggaccacgtcccgttacgtaacgtacctcgttacctcgtaactttacggaccgggacttacgttaacccgggtacccgggggttaaccgtcccggggttaccctaggtaacccgtcgttacgacgggtacgcggaggtcgggttacgacgggactacgtactacgacctacgtacgtatacgtacncgtcnccgtagccggtactcggtagaagtcgttcggtaacgtcctttaagtttacgtccgtagtactaggttaacctaattttacgtaaccttaccccggttaaccggttccccgggttaagttacccgggacggtaacccgggtgtaaccgggttaagggaacgtttaccaaacccggtaaggaccgttcggaccggtccggtactacccaccgtacgttcccg

SEQ ID NO: 156050 - DNA, 657 bp, Homo sapiens
  misc_feature: GYAE6OF02H3ZDE.29.67.G01.1.454.CMB.1.raw
  modified_base (192)..(192): a, c, t, g, unknown or other
  misc_feature (192)..(192): n is a, c, g, or t
  modified_base (239)..(239): a, c, t, g, unknown or other
  misc_feature (239)..(239): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgccgtacggggacatcgtgatcgacccagtctccagactcctggctgtgttcgnggcgagaggccacatcaactgactaacgtcagcagtaattattttanatacgctaccaaacaataagtaacttaactagtcttacggtaccagacaagaaaccaggaacacgtaccctacgtaagcctagtcctactacgttttacgcgggtactacgttaccggaacccgggtacgtcccggggtccctagaccgtattacgaggtcggacgacgggtcggtacgtagggactaggttacttccaacctacgtcgaagttacgttacgctacgccgtgaccgagggtctaaggaagtacgttggacgtacttaatttacgtacgttgtacagtactaagtttacttacgtaccgttacccgtacccggttacgtaccggtaccgaacggtaccggtaaggtcggaacgtaacgtaaccgaaacggtacgtacggtcgggacctacgaccgtacctacgttaccg

SEQ ID NO: 156051 - DNA, 135 bp, Homo sapiens
  misc_feature: GYAE6OF02F6LEW.29.67.G01.1.454.CMB.1.raw
  modified_base (130)..(135): a, c, t, g, unknown or other
  misc_feature (130)..(135): n is a, c, g, or t
tcagatagagtactcacgaccggtgctcgatttagagtatacatattgggtttgggcacagcggccctgggctgcctggtcaaggactacttccagtactctatctgagcgggctggcaaggcgcatagnnnnnn

SEQ ID NO: 156052 - DNA, 606 bp, Homo sapiens
  misc_feature: GYAE6OF02HGG5Z.29.67.G01.1.454.CMB.1.raw
  modified_base (319)..(319): a, c, t, g, unknown or other
  misc_feature (319)..(319): n is a, c, g, or t
  modified_base (365)..(365): a, c, t, g, unknown or other
  misc_feature (365)..(365): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatattttatatagctaccaacaataagtaacttacttagcttggtaccagcagaaaccaggacagcctacctaagctgctcacttttacngggtcattcctacccggggtaacgtcccggggtccctcggaccgtnttacacgtggcacggcgggtctagggacagtactttcactacgtactacgtattacgcacgtcctagccgtagctaggaagtagtggtcggtacctaattttactacttgttacctaagtctaaattacttaactaccttaccgtacccggtacgttccggaccgacgggtaccgtaagggtcggtaacggaactaccgaaacgtaacgtagttacgggcttacggacgtaccgagttacg

SEQ ID NO: 156053 - DNA, 591 bp, Homo sapiens
  misc_feature: GYAE6OF02IYSTZ.29.67.G01.1.454.CMB.1.raw
  modified_base (235)..(235): a, c, t, g, unknown or other
  misc_feature (235)..(235): n is a, c, g, or t
  modified_base (312)..(312): a, c, t, g, unknown or other
  misc_feature (312)..(312): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactcctggctgtgttctgggcgagagggccaccatcaactgcaagtccagccagatattttanatagctaccaacaataagaattacttagcttggtaccagcagaaaccaggacagcctctaagctagctcatttacgnggcatcgtaccgggaatccggggtcctgacgtatcagtggcaggcgggtactgggactaggtactttcaacactcgtagttatacgcacgcctagacgaggtctaggaacgtattggtacgcctaatttacttacgtgtactagactaaagttattaactaaccgttacctaccccggtaacgttaccgggtaccgtaacgggaaccgtaacgggttacggaacgtaacgtaacgaaaccgtaacggtacgtaggtactacggacctaccgtagtaccg

SEQ ID NO: 156054 - DNA, 686 bp, Homo sapiens
  misc_feature: GYAE6OF02F5H63.29.67.G01.1.454.CMB.1.raw
  modified_base (237)..(237): a, c, t, g, unknown or other
  misc_feature (237)..(237): n is a, c, g, or t
  modified_base (312)..(312): a, c, t, g, unknown or other
  misc_feature (312)..(312): n is a, c, g, or t
tcagatagagtactcacgaccggtgctcgatttagagtatacatattggggtttgggggagctacaacaggcaggcaggggcagcaagatggtgttgcagacccaggtcttcatttctctgttgctctggatctctggtgcctacggggacatcgtgatgacccagtctccagactccctgctgtgttctgggcgagagggccaccatcaactgcaagtccagccagaattatttanatagctccaacaataagaattacttagcgttggtaccagcaagaaaccaggacacggcctccaagcttggcctanatttacgtgggtactatccgtaaccgggtatcccggggtcctgaccgattcaggtggcaggcgggtctgggacaggatttcacacgtacgaagtattacggcaacgtccgtgtcgaagggtccgtaggaacgtaaacgtcgggttacggcccttaagtttttacgttaacgtttacggttcgaacggttacctaaagtttaacgtttaattaacccgttaaccccgttaccccggggtaaccgtttcccgggtaacccggtaaccggggtaaacccgttaacggggttaacgggtaaggtaacgtaaccgtaaaccggttaaaccgtacgggttcggtaaccgttccggaccgttaacccgtacgttacccggg

SEQ ID NO: 156055 - DNA, 746 bp, Homo sapiens
  misc_feature: GYAE6OF02JYUTZ.29.67.G01.1.454.CMB.1.raw
  modified_base (388)..(388): a, c, t, g, unknown or other
  misc_feature (388)..(388): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgccgtacggggacatcgtgatcgacccagtcctccagacctccctgctgtgtttcgtgggcgaggacggccaccatcaacgtgacaagtccagaccaagtaattagttttatagtacgtcctaccaaactaaagtaaagtaactttaacgttacgtaccttacgggtaaccctaaggaccgaaacgaaaaccgaacggaaccaacggtccctaaccgtaacgtactacgtcttaccgtaacgttttacgngggaacctacgtacccgtaaccggggaacgttccgggtacccgtacgaccgtacgttcgacggtcgggacgtacgggcgggtacgtagggactaacgttacgttacgacctacgttacgtaacgtaacgttacgaccgtacgtaccgtacggtacgacggtacgtaacgaggtaacgttcggtacggtacttacgtttacgttaccgttggtaactacgtaataacgttaacttaacgttaaccgttaccgtacccggtaccgttaccggtaccgacggtacggtaaccggtaggtaaccgaacgtaacctaaaccggtactacggtacggtaccgtaccggcttaaccgcgttaacg

SEQ ID NO: 156056 - DNA, 627 bp, Homo sapiens
  misc_feature: GYAE6OF02FEKHH.29.67.G01.1.454.CMB.1.raw
  modified_base (196)..(196): a, c, t, g, unknown or other
  misc_feature (196)..(196): n is a, c, g, or t
  modified_base (251)..(251): a, c, t, g, unknown or other
  misc_feature (251)..(251): n is a, c, g, or t
  modified_base (338)..(338): a, c, t, g, unknown or other
  misc_feature (338)..(338): n is a, c, g, or t
  modified_base (367)..(367): a, c, t, g, unknown or other
  misc_feature (367)..(367): n is a, c, g, or t
  modified_base (417)..(417): a, c, t, g, unknown or other
  misc_feature (417)..(417): n is a, c, g, or t
  modified_base (438)..(438): a, c, t, g, unknown or other
  misc_feature (438)..(438): n is a, c, g, or t
tcagatagagtactcacgaccggtgctcgatttagagtatacatattgggtttgggggagctacaacaggcaggcaggggcagcaagatggtgttgcagacccaggtcttcattttctctgttgctctggatctctggtagcctacggggacatcgtgatgacccagtctccagtactccctggctgtgtttacgngggcgaggagggccaccgatcaacgtgacaacgtccagccagtaacttattttanactcgcctacaaacaataaagtattacttagctttggtaccagtacaagaacctaggacacgtcctactaagtctgctactattacnggctagtccgtaccggtatcccgggtccngtaccgtatcgagtcggcaggtcggtgtcggactagtacttacacgtctntagtacttacgctacgtcgtncgtacgactggaatagtcgtacggtacctagttttactacgtacgtcgaactacgtaaatttacgttaacgttaccgtacccgtacccgggttacgtaccggtaaccgtacgggtaaccgtagggtacgtaacgaacgttaaccgaaacgtaacgttacggtcggtacgtcgaccctacgtattaccgg

SEQ ID NO: 156057 - DNA, 735 bp, Homo sapiens
  misc_feature: GYAE6OF02FQ5W3.29.67.G01.1.454.CMB.1.raw
  modified_base (237)..(237): a, c, t, g, unknown or other
  misc_feature (237)..(237): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgttcgtggcgagacgggccacatcaactgcaagtccagccagaatattttanatagctaccaacaataagaattacttagacttacggtaccagtactaacgaaaccgaggacacgacccgttacctaacgctcgcctactaatttcgcgggtctacgtaccgttaaccccggggtaacgtccggggtaccctacggacccgtacgttactacggtcggtcgacggtccgggttacgtagggacctaggtactttaccacgtaccgttcgtaacgttattacggactacggtccttggacccgttagggtccaagggtaagtccgttacggttcggtaacctttaagttttaacttacgtcgttaaccgacgttaacgtaagtttaacgttaacttaacccgtttaacccggttaccccgggttaacggttacccgggaacccggttaaccggggtaaccttaacggggtaacggttaaccggaacgtaaaccgttaaaaccgacgggtttacgtccgggttaccgaacggtccctaacgcccgtttacg

SEQ ID NO: 156058 - DNA, 739 bp, Homo sapiens
  misc_feature: GYAE6OF02FG1H8.29.67.G01.1.454.CMB.1.raw
  modified_base (352)..(352): a, c, t, g, unknown or other
  misc_feature (352)..(352): n is a, c, g, or t
  modified_base (594)..(594): a, c, t, g, unknown or other
  misc_feature (594)..(594): n is a, c, g, or t
  modified_base (733)..(733): a, c, t, g, unknown or other
  misc_feature (733)..(733): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagacctccctggctgtgtttcgtgggcgagagggccaccgatacaactcgacaagtccacgccagtaattattttatatacgctaccaaactaactaagtaattacttagactttacggtacctagacaagtaaaccaggaacacgtacctaccgtaacgtcctacgactactactttacgngggtactaacgtaccgtaacccggggtacgtccccggggttaccacggtacccgtacgttacgaacggttcgggactacgggtccgggttacggagggtaccgtaaggttaccgtttaccacgtaccttaccgaaaggtttatttaacgaccgtaccggtaccgttggaacccgttacgggtacgtaacgggttaaagtaggttcggtacccggtaactttaacgttttaatttaacccggngtaaccctaaggttactaaacgttttgttaaaccgtaccttaacccgggttaccccggtagttaccccgggaaccgtaacgggtaacggaaggtaaggaaccgaatacccgaaagtccggattaccgggatcgactacngttacg

SEQ ID NO: 156059 - DNA, 781 bp, Homo sapiens
  misc_feature: GYAE6OF02GPADG.29.67.G01.1.454.CMB.1.raw
  modified_base (192)..(192): a, c, t, g, unknown or other
  misc_feature (192)..(192): n is a, c, g, or t
  modified_base (245)..(245): a, c, t, g, unknown or other
  misc_feature (245)..(245): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagacctcctggctgtgtttcgngggcgagacggccaccatcaacgtgacaacgtccagaccaagtaattatttanatagcctaccaactaaataagtaattacgttagtctttaggaccagacaacgaaaccaggacacgacctacctaagctcgctactaacttttacgcgggactacgtaccgtaaccccggggaacgttcccggggtaccctaggacccgtattaccggaggtcgggaccgagggtccgggtacgtacggggaactaggttaacctttaccgaacgtaccgtaccgtaaacggtttactaaccggaccgtaccggtcccgttaggacccgtacgggaccgttaacggaacggttaacggttcgggttaccggttaccttaagtttttaacgtttaccgttcgttaaccgtagttaacttaaactttaacgttaaccgtttacccgttaaccccggttaccccggttacgggttaccccgggtaacccggtaaccggggtaaccggttaaggggtaaccggtaacggtaacgttaacccggaaaacgttaccggtacggttacggtaccgtaccggtaccggtacctacgtttaacccg

SEQ ID NO: 156060 - DNA, 695 bp, Homo sapiens
  misc_feature: GYAE6OF02GWTLE.29.67.G01.1.454.CMB.1.raw
  modified_base (171)..(171): a, c, t, g, unknown or other
  misc_feature (171)..(171): n is a, c, g, or t
  modified_base (198)..(198): a, c, t, g, unknown or other
  misc_feature (198)..(198): n is a, c, g, or t
  modified_base (217)..(217): a, c, t, g, unknown or other
  misc_feature (217)..(217): n is a, c, g, or t
  modified_base (247)..(247): a, c, t, g, unknown or other
  misc_feature (247)..(247): n is a, c, g, or t
  modified_base (252)..(252): a, c, t, g, unknown or other
  misc_feature (252)..(252): n is a, c, g, or t
  modified_base (269)..(269): a, c, t, g, unknown or other
  misc_feature (269)..(269): n is a, c, g, or t
  modified_base (279)..(279): a, c, t, g, unknown or other
  misc_feature (279)..(279): n is a, c, g, or t
  modified_base (296)..(296): a, c, t, g, unknown or other
  misc_feature (296)..(296): n is a, c, g, or t
  modified_base (309)..(309): a, c, t, g, unknown or other
  misc_feature (309)..(309): n is a, c, g, or t
  modified_base (471)..(471): a, c, t, g, unknown or other
  misc_feature (471)..(471): n is a, c, g, or t
tcagatagagtactcacgaccggtgctcgatttagagtatacatattgggtttgggggagctacaacaggcaggccaggggcagcaagatggtgttgcagacccaggtcttcatttctctgttgctctggatctcgtggtcgccgtaggggactagtcggtgatcgacccngtcctcagacctccgtgctgtgttcgngggacgagcggccacgtanacaacgtcgacaacgtcagccaagtaattntttanagtcgcctacgaaaatntaaagacttntaacgtcttaggaaccngacaaacaaccgngactacgtccctacaaggcctgtactacgtaattacggtcggtacaacgttacccggtaccggtaagcccccggggttctaaggtaacccgtacgttcaagggtacgccgtaggtccgggttctacgggaaatcgttatacgacacgtatacgtatacgacngtacgtcgacgtaggctaaggtagacgtgtcccgaagttatttacgtacgcgtactaagtactaacttaattaccgttacgtaacccccgttcggaagtttacccgaagggaaccggtaccgggttaaacgggtcgtaaaacgggttacgaaaccgtttaaaccggggtaaccttaggggtaccggtaccggttaacggtaccggttaccccgaagtttcccgg

SEQ ID NO: 156061 - DNA, 672 bp, Homo sapiens
  misc_feature: GYAE6OF02INH6D.29.67.G01.1.454.CMB.1.raw
  modified_base (165)..(165): a, c, t, g, unknown or other
  misc_feature (165)..(165): n is a, c, g, or t
  modified_base (479)..(479): a, c, t, g, unknown or other
  misc_feature (479)..(479): n is a, c, g, or t
tcagatagagtactcacgaccggtgctcgatttagagtatacatattgggtttgggggagctacaacaggcaggcaggggcagcaagatggtgttgcagacccaggtcttcatttctctgtgctctggatctctggtgccgtacggggacatcgtgatcgacccngtctccagctcccgtgctgtgttcgtgggcgaggacggccaccgatccaaacgtgacaacgtccagccaagtaattattttatatacgacctaccaacgtaaataaagtacttacgttaagtcttaggaccaagacgaacgaaaccgaggaacacgaccctaccgtagcgtacgtctaactacgttacgtggactacgtaccggtaacccggaagtcccgggtccacggtagtacctcgaagtcgagtacgggcggtctacgggacaggttcttacaccgtacgtacgtacgttaagtacgcacgtccgtgganacggctaggaaagtccgtgtacgtactacttttaatcggtacgttccgaattaacgtaacttaacgttaaacttcccgtaaccgcccgtaacgttccgtacccgggtaacgtaaccggaccggtaaaggtaaccgtagtaaaacgttaaaccgaccggtacgggtactaccggacctaccgaacctgtacccg

SEQ ID NO: 156062 - DNA, 615 bp, Homo sapiens
  misc_feature: GYAE6OF02INHB5.29.67.G01.1.454.CMB.1.raw
  modified_base (244)..(244): a, c, t, g, unknown or other
  misc_feature (244)..(244): n is a, c, g, or t
  modified_base (257)..(257): a, c, t, g, unknown or other
  misc_feature (257)..(257): n is a, c, g, or t
  modified_base (331)..(331): a, c, t, g, unknown or other
  misc_feature (331)..(331): n is a, c, g, or t
tcagatagagtactcacgaccggtgctcgatttagagtatacatattggggtttgggggagctacaacaggcaggcaggggcagcaagatggtgttgcagacccaggtcttcatttctctgttgctctggatctctggtgcctacggggacatcgtgatgacccagtctccagacctccctggctgtgtttcgtgggcgagacgggccaccatcaactgcaagtccagccagtaattattttanatagctaccaaanaaataaagtaattacttagcttaggtaccagacaagaaaccaggacacgcctactaagctgactctatttacgnggacagttaccgtaccgggtacgttcccgggtcctacggaccgtattcgaggttgcgaggcggtgagggacagtatttccatactacgtagttatcgacagtcctggcgtaggtctaggacgtagtggtacgtccttatttactactgtactaagactaattattactaccgttacccgtacccggtaacgttcgggaaccctaggggtaaccgaacgggtggaacggtacgtaaccgtaaggtaaccgtggtacggtacctacggtactaccggtattaccgg

SEQ ID NO: 156063 - DNA, 673 bp, Homo sapiens
  misc_feature: GYAE6OF02FMJG9.29.67.G01.1.454.CMB.1.raw
tcagatagagtactcacgaccggtgctcgatttagagtatacatattggggtttgggggagctacaacaggcaggcaggggcagcaagatggtgttgcagacccaggtcttcatttctctgttgctctggatctctggtgcctacggggacatcgtgatgacccagtcctccagactccctggctgtgtttctgggcgagagggccaaccatcaactgcaatccagccagaattattttatatagctccaacaataagtaattacttagctttggtaccagacagaaaaccgaggaacgacgacctacctaagactgacttacacttttactcgggtcactactaaccccggggtaagtccccgggggtccctcggaacccgtagttccgaggttacgggcctacggcgggtcgtacggggactagacttttacactactcgaagtagtttaccgctacggcccgtggacgagggtcgtagaacggtacttaggttcggtaccttagttttaatacttagttactaacgtacgtaaattaagttacttaacgttaacccgttaccccggtaacggttaccgtaccggaacgggtacccgtaaacgggtacggtaaccggactaacggaaaccgtaacgtacggtacggttacgtacgaccgtacctagtaccg

SEQ ID NO: 156064 - DNA, 725 bp, Homo sapiens
  misc_feature: GYAE6OF02J1II9.29.67.G01.1.454.CMB.1.raw
  modified_base (139)..(139): a, c, t, g, unknown or other
  misc_feature (139)..(139): n is a, c, g, or t
  modified_base (163)..(163): a, c, t, g, unknown or other
  misc_feature (163)..(163): n is a, c, g, or t
  modified_base (247)..(247): a, c, t, g, unknown or other
  misc_feature (247)..(247): n is a, c, g, or t
  modified_base (706)..(706): a, c, t, g, unknown or other
  misc_feature (706)..(706): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtncctacgggacatcgtgatgacccngtctcagactcctggctgtgttcgtggcaggcggccaccagtccaactcgaccgtaacggtccagacccagtaacttattttanacgtagccgtaccaaactaataacgtaatttaccgtagtcgttacggtaccagactaacgaaaccgtaggaactacgtccgtaccgtaacgtactcgtacttctaacgtttacgtacggggctacgtaccggtaacccgggtaaccgtcccgggttaccctacggaccggttaacttcggtaccgggttaggaccgtacggggtaccggggtacccggttacgggaaccgtacggttaccgtaacaccgttaacgtaccgttaagttaacgttacggacctaccggtcggacgtaaccggtgtacgtaagtaacgtcggtaccggtaacgttaccgttatttaccgtacgtacgtaccgaaagtacttaacttaacgttacccttacccgacccggtaccgtacgtacgtaccggacggaaccgttaggactacgacgtaacgacgtccgtagccgtanaccggtctacctgttaccg

SEQ ID NO: 156065 - DNA, 921 bp, Homo sapiens
  misc_feature: GYAE6OF02IGMQK.29.67.G01.1.454.CMB.1.raw
tcagatagagtactcacgaccggtgctcgatttagagtatacatattgggtttgggggagctacaacaggcaggcaggggcagcaagatggtgttgcagacccaggtcttcattttctctgttgctctggatctctggtgcccgtacggggacagtcgtgatgacccagtctccagactcccgtggtctggttgtttcgtgggcgaggacgggccaccgatacaactgacaaggtccacgaccaagtaacttattttactagacgtacctaacccaaagtaaactaaagtaactttacttaagtctttacggaacctagacgaaacgaaacccgacggaaccaaccgtacccttaccgtaacgtcgttacggtaccttacgttaacttttaacgtcggggaccttaacgtaccccggttaaccccgggggtaacggttccccgggggtacccttacggtaacccggttactttaccgggtaaggggtaccggtacgtacgggggaccggggttttacggtacgggggtaaaccttaacgggttaaccttttaccgaaaccgttacgtttaaccggtaaggtttaaccgttaacggccgtaacccggtaccggtacggtaccggtaacgggtacgttaaagggaaaggtttacgttaccggttaacggttaaccctttacgtttttaaaccgttaccgtacggttaacccgtaaaggtttaccttaaaacgtttacgttttaaacccggtacccgtttaaaccccgggtttcccccgggttaacggttaacccccgggtaccgggaacccggggttaaccggaaagggttaacgggtaaccggtaaaccgtaaaccggaaaaccggttaccggtacggttacccggttaccgtcgtaacccgttacccggtactttacccgg

SEQ ID NO: 156066 - DNA, 726 bp, Homo sapiens
  misc_feature: GYAE6OF02IL6PL.29.67.G01.1.454.CMB.1.raw
  modified_base (176)..(176): a, c, t, g, unknown or other
  misc_feature (176)..(176): n is a, c, g, or t
  modified_base (187)..(187): a, c, t, g, unknown or other
  misc_feature (187)..(187): n is a, c, g, or t
  modified_base (193)..(193): a, c, t, g, unknown or other
  misc_feature (193)..(193): n is a, c, g, or t
  modified_base (229)..(229): a, c, t, g, unknown or other
  misc_feature (229)..(229): n is a, c, g, or t
tcagatagagtactcacgaccggtgctcgatttagagtatacatattggggtttgggggagctacaacaggcaggcaggggcagcaagatggtgttgcagacccaggtcttcatttctctgttgctctggatctctggtgcctacggggacatcgtgatgaccagtctcagctccnggctgtgttcnggcagnggcacatcaactgcaagtccagccagtaatatttanatagctaccaacaataagaatacttagcttggacctagacagaaccaggacacggccacctaagctagacctctaacgttactagggactacgttcgtaacccggggaacgttccccgggggtaccctacggtacccggtactttaccgaacggtttcgggacgaacggtaccgggggttccgtagggggttaaacaccgggttaactttaccgaaccgtacgtaccgtaggttaacgtttacgaaccgtacggtacccgttcggaaccgtaacgggacccttaggaaacgttaacggttcgtacgggttaccctaaggttttaactaaccgttaggtccctaaggtaaccgtaacttaacttaacgttactaacccggttccccggacgtttaccggaccgtacgggtaaccggtaccggaacgggttaacgacgtaaccgtaaaccgtacggtaacgttacggtacccgacggtaccgttaccgacgttaaccgg

SEQ ID NO: 156067 - DNA, 736 bp, Homo sapiens
  misc_feature: GYAE6OF02HX59I.29.67.G01.1.454.CMB.1.raw
tcagatagagtactcacgaccggtgctcgatttagagtatacatattgggtttgggggagctacaacaggcaggcaggggcagcaagatggtgttgcagacccaggtcttcatttctctgttgctctggatctcgtggtgccgtacggggacagtcgtgatgaccctagtctccacgtactcccgtggcttggttgtttcgtgggacgaggacgggcccaaccactaccaactgacaacgtccagaccagtaattattttagtatacgtctaccaaactaaataagtaactttaacgttagtccgttacggtaaccagacgaacgaaaccgacggacacgaccctaccgtacgccttgccttacgtacgttttacgcgggtactacgttacccggtaacccgggaacggttccccgggtccgtacggtacccgtattaccgtaggtcggaccgacggggtccgggtcggtacgggtacgtaaggttactttaccgaccctacgttaccgttacgttacttacgtcccgtacggtactcgggacgtacgggactaggtaaactcggttaggttaccgtacctttaagtttaccttccggtagtactaacgtactttaattacgttacttacccgttaccgtacccggtcggttacggaaccgtacggaggtacggtacggataaccgtaacgtaacgtacggttcggacggttacgaacgtcccacgttcttaccgg

SEQ ID NO: 156068 - DNA, 783 bp, Homo sapiens
  misc_feature: GYAE6OF02FO7JK.29.67.G01.1.454.CMB.1.raw
  modified_base (362)..(362): a, c, t, g, unknown or other
  misc_feature (362)..(362): n is a, c, g, or t
tcagatagagtactcacgaccggtgctcgatttagagtatacatattgggtttgggggagctacaacaggcaggcaggggcagcgaagatggtgttgcagacccaggtcttcatttctctgttgctctggatctctggtgcctacggggacatcgtgatcgacccagtcctccagactccctggctgttgtttcgtgggcgaggacgggccaccatcaactgacaagtccagccaagaattattttatatagcctaccaaactaagtaaagtaatttaacttagctttaggtaaccagacaacggaaaaccaggaaccacggtccccttaccgtaagccttcgaccttactaattttaccgngggacctacgtcccgtaacccggggaacgttccccggggtccctacggtacccgtactttccgacgggttcggaccgtaagggtccgggttacgtacggggacctaaggttactttaccaacgtaccgtacgtaagttaagttacgacgtaacgtccgtacgaccggtaggtaccgtaaggtaacgtacgttagggtaccgttaaccgtttaactttttaacgtttacgttcgttaacgtaacgttaactaaacttttaacgttaaccgtttaaccgttaaccccggtcccccggtttaacgggtttacccgggaccgttaaaccggggtaccggtaaacgggttacgggaacgtaacgttaaaccgtaaacggtaaccggttcgtacgggtacccgtacgtaacacccggttacgtaccg

SEQ ID NO: 156069 - DNA, 725 bp, Homo sapiens
  misc_feature: GYAE6OF02HWRG6.29.67.G01.1.454.CMB.1.raw
  modified_base (587)..(587): a, c, t, g, unknown or other
  misc_feature (587)..(587): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggcatcgtgatgacccagtctcagactccgtgctgtgttcgtggcgagacggccacatacaacgtgactaacgtccgaagaccgtaagaaatttatttaacgtatacgctaccaaactaaagtaacgtaaactttaacgttagtacttacggtaaccagacgtaacgaaaccgagacgtacgaccgttacctaaacgtctacgtacctacgtaactttaccggtacggtactacgttaccggtaacccggggtaaccgtcccgggttaccctacgtaacccgttaacgttccggaaggttcggacgtacggtccgggtacgtacgggactagttactttaccaacgtacgtttacgaacggtttaacttaacgcgtaacgtcgacggtacgaggtaccgtaagtacgtagtacggtacgtacttaattacgtagtacgtanaacgttaataaacgtttacgtaacttacccgtaaccggttacccggtagttaccgggtacgaacgggtacgaagggtactaacggtaacaaccgtaacgtaacgtcgtacggtacctggacctaaccgtcttaaccgg

SEQ ID NO: 156070 - DNA, 699 bp, Homo sapiens
  misc_feature: GYAE6OF02F8OLQ.29.67.G01.1.454.CMB.1.raw
  modified_base (224)..(224): a, c, t, g, unknown or other
  misc_feature (224)..(224): n is a, c, g, or t
  modified_base (241)..(241): a, c, t, g, unknown or other
  misc_feature (241)..(241): n is a, c, g, or t
  modified_base (285)..(285): a, c, t, g, unknown or other
  misc_feature (285)..(285): n is a, c, g, or t
  modified_base (303)..(303): a, c, t, g, unknown or other
  misc_feature (303)..(303): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacgggacatcgtgatgacccagtctccagactccctggctgtgtttctgggcgagagggccaccagtcaactgcaagtccanccagatattttagatanctaccaacgaataagattactagcttggtaccagcaagaaaccnggacagcctcaagccttncgtactatttacgtggctatccgtaacccgggtaagttccccgggttacccgtgtaacccgtatttcgaaggttcgggccacgggtcgggtactgggggactaacggtattttccaacgtacgttccgtaaggttaacgtttaagaccgtaacgtccgtttcggaccgtaacgggtccgtaaggtaacggtacgttacgggttacgggtaacccttaagttttaaccgtttaacgttcggttaaccgtaggtaaaccttaattaacgtttaacttaacccgttaacccgttaccccggtaccggttacggacccgtaacgggtaacccgtaagggtaaccggtaacggtaacgtaccgaaacgtaacgtagtcggtaccgtcgacgtaccagttcc

SEQ ID NO: 156071 - DNA, 777 bp, Homo sapiens
  misc_feature: GYAE6OF02IVXRR.29.67.G01.1.454.CMB.1.raw
tcagatagagtactcacgaccggtgctcgatttagagtatacatattgggtttgggggagctacaacaggcaggcaggggcagcaagatggtgttgcagacccaggtcttcatttctctgttgctctggatctctggtgccgtacggggacatcgtgatcgacccagtctccagacctcccgtggctgttgttcgtgggcgaggacggcccaccagtaccaactcgacaacgtccagaccaagtaattattttaatatacgccttaaccaaacaaattaaagtaactttaacttacgtcgtttaacggtaccaagacgtaaacgaaaacccgaggaccaacgtccccttaaccgtaaacgtccgtacgtacctacgttaacttttaccggtcgggacctaacgttacccggtaaccccgggggtaacgttccccggggtacccctaaggtacccgtatttccggacggtcggaccgtacgggtaccgggtcgtaggggtaaacctaggttactttaccgaaccgtacttaccgtaagttaacgttacggacctaccggtccgttacggaccgtacggtaccgtaaggaacgttaggttgggtaccggttaccttaagtttactaaccggtgttaaccaagttactaatttaacgttacttacccgtaacccgttcccgggtaccgttaccgaccggaccgtacggtaacggtcggtaacgacgtaaaccgtaacggtaccgttacggccgttacggaccgtacgaccttacgttccg

SEQ ID NO: 156072 - DNA, 815 bp, Homo sapiens
  misc_feature: GYAE6OF02HRKUJ.29.67.G01.1.454.CMB.1.raw
  modified_base (197)..(197): a, c, t, g, unknown or other
  misc_feature (197)..(197): n is a, c, g, or t
  modified_base (234)..(234): a, c, t, g, unknown or other
  misc_feature (234)..(234): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgttctggcgagnggccaccatcaactgcagtccagccagaatattttanatagctaccaacaataagaattaacttagcttcggtaccagactaagaaaaccaggaaccaggtaccctaccgtaaagcctgctaccaattttacgtcgggtactagtccgtaaccccggggtaacgttcccgggggtacccctaggtacccgtagtttccgacggtcggacgtacggtccgggggttcgtacggggtacgtaaggttaccgttttacgaaccgtaaccgtacgttacggtttaaattaacgggcctaacgggtaccccttagtacccggaacgggtaccggttacggaaaacggttacggttacggttcggggttaacccctttaaacggtttttaagtttaacccgtttcgggttaccgtaaaccgggttaactaaacggtttaacttttaaacgttaaccccgtttaaccccggttacccccgggttaaccgggttttaacccggacccggttaaaccggggtaaacccggttaacggggtaacgggtaccggaacggttaacccgtaaaaccggttaacgttaccggtacggtacggttcggtaaccctacgtaccgtttaacccgg

SEQ ID NO: 156073 - DNA, 696 bp, Homo sapiens
  misc_feature: GYAE6OF02I1J1Y.29.67.G01.1.454.CMB.1.raw
  modified_base (191)..(191): a, c, t, g, unknown or other
  misc_feature (191)..(191): n is a, c, g, or t
  modified_base (243)..(243): a, c, t, g, unknown or other
  misc_feature (243)..(243): n is a, c, g, or t
  modified_base (352)..(352): a, c, t, g, unknown or other
  misc_feature (352)..(352): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgttcgngggcgagacggccaccatcaactgacaacgtccagccagtaattacttttanatacgcctaccaaactaaagtaaacgtaatttacttaggtacttacggtaaccagtacaagaaacccaggaaccagtaccctactaacgctcgactactattttaccgnggactagttaccgtaacccgggtaacgtcccggggtacctacgacccgtattcgaggtacgcacggcggtacgtagggactaggtactttaccgacacgtacgtaagttacgttacgacgacgtacgtcgaccgtacggtcgtaggaacgtactggttacgtacttaactttctaacgttacgtacgtaagtactaagttaacgttacttaacccgttacccgtcccggttaacggtcccggtaaccgacgggtaaccgtaacgggtaacggtaacggtacgtaacccgtaaacgaacggttaaccggtcgttaaccggtaccgtaccgtacctaaccgttccg

SEQ ID NO: 156074 - DNA, 751 bp, Homo sapiens
  misc_feature: GYAE6OF02FOIVH.29.67.G01.1.454.CMB.1.raw
  modified_base (346)..(346): a, c, t, g, unknown or other
  misc_feature (346)..(346): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctcgtggtgcctacggggacatcgtgatgacccagtctccagactccctggctgtgttcgtgggcagacggccacatcgaactgcaagtccagaccaagaattattttatagtacgctaccaaacaataaagtaagttacttagtcgtttacggtaacagtacaacgaaaccgaggacagcccgtacctaagtctcgactactaacggttttacngggtactacgttaccggtaaccccggggtattcccgggggtaccctggtaacccgtacgtttacgaaggtcggtacgagggtccgggttacgacggggtaacctaagggttacttttaccaaccgtaccgttacgtaaacggttacgttaaggcccgtaacgtccctacgggtacgaacgggtacgttaggaaacgttgttacggttcggaacctttagttttaacttacgttacggtactacggtaacttaaagtaactttaaccgttaccgttaaacccgtcccccgggttaacgtttaccgggaccgtaacgggtacggtaacggtaaggtagggaacgtaccggaagtaaaaccggtcggttaacgggtaaccggtcgtaacggaccggtacccgtaacgg

SEQ ID NO: 156075 - DNA, 858 bp, Homo sapiens
  misc_feature: GYAE6OF02FO5D7.29.67.G01.1.454.CMB.1.raw
  modified_base (262)..(262): a, c, t, g, unknown or other
  misc_feature (262)..(262): n is a, c, g, or t
  modified_base (380)..(380): a, c, t, g, unknown or other
  misc_feature (380)..(380): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtcgccgtacggggacatcggtgatcgacccagttcctccagtacctcccgtggctgttgtttcgtgggcgaggacgggtccaccatacaacgtgaccaacgtccagaccaagtaacttattttanagtagcctacaaactaataagtaatttaccgtagtcgttacggtactagaccgtaacgaaacccgtaggacctacggtaccccttacgtaactcgtacgtcctacgttatttaccggngggtacaacgttacccgggtaacccggggtaccgggttaccccggggtacccttacggaccccggttaattaccgggtacgggttacgggcccgtaacgggggtccgggtacggtaacgggtacgtaacggttacgtttacccaacgtaccgtttacgtaaggttaacttacggaacgtaccgttcccggttacgaccgtaacggtacgttacgggaaacgttggtacgggtttacgtcctttaaacgttttaccggtaagtttacggaccttaagggaaccctttaaacttttaacgtttacccttaaacccggttaccccggttacccccgggttaacggttaaccggaacccgggtaacggggtaaaccggttaccgggggttaacgtaaaccggtacccgtaaaagggtaaacccgtaagggttaccggttaacgggttaccggttacaacccgggttcctaaaccggtttcgg

SEQ ID NO: 156076 - DNA, 571 bp, Homo sapiens
  misc_feature: GYAE6OF02FPN52.29.67.G01.1.454.CMB.1.raw
  modified_base (179)..(179): a, c, t, g, unknown or other
  misc_feature (179)..(179): n is a, c, g, or t
  modified_base (191)..(191): a, c, t, g, unknown or other
  misc_feature (191)..(191): n is a, c, g, or t
  modified_base (235)..(235): a, c, t, g, unknown or other
  misc_feature (235)..(235): n is a, c, g, or t
  modified_base (303)..(303): a, c, t, g, unknown or other
  misc_feature (303)..(303): n is a, c, g, or t
  modified_base (314)..(314): a, c, t, g, unknown or other
  misc_feature (314)..(314): n is a, c, g, or t
  modified_base (320)..(320): a, c, t, g, unknown or other
  misc_feature (320)..(320): n is a, c, g, or t
  modified_base (354)..(354): a, c, t, g, unknown or other
  misc_feature (354)..(354): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactcccnggctgtgttcgnggcgagaggccacatcaactgcagtccagccagaattattttanatagcctacaaacaataagtaattactagcttggtaaccagcaagaaccaggacagccctacaagctnctctattacgnggctancgtaccggactccgggtcctgactatcagtgcgnggcggtgaggtcaggtacttacactactcagtacagcgtacgcctagcgacggtgaggtaatagtggactacgtaatttatacgtgtacaggtactaacttaattacttaacctacccgtaccggtacgttacgacccgaacggtaacgaacggtagggtacgtaccgtaacgtaaaccggagttacggcggtacgtcgaacccgactaccgttacg

SEQ ID NO: 156077 - DNA, 935 bp, Homo sapiens
  misc_feature: GYAE6OF02HCWGS.29.67.G01.1.454.CMB.1.raw
  modified_base (216)..(216): a, c, t, g, unknown or other
  misc_feature (216)..(216): n is a, c, g, or t
tcagatagagtactcacgaccggtgctcgatttagagtatacatattgggtttgggggagctacaacaggcaggcaggggcagcaagatggtgttgcagacccaggtcttcattctctgttgctactggatctcgtggtcgaccgtacggggactagttcggtgactcgaaccctagtacctaccgacgtacctcccgtggtcttggttgtttcgngggtacggtaggacgggcccaacccgtatacctaaaccgttcgtaaccgtcccacgtaccgtaacgtaaactttagttttaataatacggtaccgtaacctaaactaaaacgtttaagtaaacgttttaacgttacgtaccgttttacggaacctaacggtacctaaacggaaaacccgtacgggtaacctacggtaccccgttaaccgaaacggtctacggttccttaacgttaacgttttaccgggacggtaacctaccgtttaaacccggggtaaccccgggttaaccggttccccggggttaacccttacggggaaccccgtttaggttacccggtagggtacgggacccggttacgggtcccgggttacggtacgggaaaccggtttacgtaaccgttttacgaaccgtttaaccgttcgtaacgggtttaacgtacggaccgtaccgttaccggttacggaaccgggtacgtacgttaacggggaaactttcgggacgggttttaaccggttacctttaaaacgttttacgtttaaaccggtcggttaaccgtaaacggttaccttaaacgtttaaccttacgttaaccccggttaaccggtacccgggttacgtaacccgggtaacgtaacgggaacttacggggtaataaaccggtgaaaccgtagtaaccggacggttcgaaccgtgtaacccgctaccggttataccgg

SEQ ID NO: 156078 - DNA, 550 bp, Homo sapiens
  misc_feature: GYAE6OF02FN0UH.29.67.G01.1.454.CMB.1.raw
  modified_base (238)..(238): a, c, t, g, unknown or other
  misc_feature (238)..(238): n is a, c, g, or t
  modified_base (250)..(250): a, c, t, g, unknown or other
  misc_feature (250)..(250): n is a, c, g, or t
  modified_base (318)..(318): a, c, t, g, unknown or other
  misc_feature (318)..(318): n is a, c, g, or t
  modified_base (430)..(430): a, c, t, g, unknown or other
  misc_feature (430)..(430): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaacttcaagtccagccagaatattttanatagctaccaanaataagaattacttagcttaggtaccagacaagaaaccaggacagcctacctaagctgctcatttacngggcatcgtacccgggtaatcccggggtaccctgaccgattcgagtggtcacgcgggtctgggacagtatttccactactcgaagtatagcagtcctgacaggctagaagtntaggcgccgtaatttattactgtacagactaatattactactacctcccggattcgacgtaaggacgaggtaggaagactacgaaacgtacgtagtcggtacgtcgacgacctatctacg

SEQ ID NO: 156079 - DNA, 724 bp, Homo sapiens
  misc_feature: GYAE6OF02JV603.29.67.G01.1.454.CMB.1.raw
  modified_base (141)..(141): a, c, t, g, unknown or other
  misc_feature (141)..(141): n is a, c, g, or t
tcagatagagtactcacgaccggtgctcgatttagagtatacatattggggtttgggggagctacaacaggcaggcaggggcagcaagatggtgttgcagacccaggtcttcatttctctgttgctctggatctctggtcnccgtacggggacatcgtgatcgacccagtcttcgagtacctccgtggctgttcgtttcgtgggcgaggacgggccaaccgataccaactcgacctaaacgtccacgaccaagtaacttaattttagtaactacgacctaaccaaactaaataaacgtaattaacttagtacttacggtaaccacgactaacgaaaccgaggacacgtcctacgtaacgctacgtctacgttacgtttaacgtcgggacctacgtacccgtaacccggggtacgtcccgggtcctacgacgtactcgagttcggcgacggtcgggtcgacgggtactacgtctttaccgaacgtcctacgtagttaacgtacgacgtacgtacgttcggacgtagggactaaggtaagtaggtacggtacggtaactttaacgttttaacttcgttacgtacgtacgtaacgtaaattactttaacgtaccgttaccgtaccccgttacggtaccgtaccggacggtaacgtacgggtaacggtaacgtacgtaactaacggtaacgttacggtacggtacgtacgtacgtaccgtagttaccg

SEQ ID NO: 156080 - DNA, 689 bp, Homo sapiens
  misc_feature: GYAE6OF02FQPDY.29.67.G01.1.454.CMB.1.raw
  modified_base (140)..(140): a, c, t, g, unknown or other
  misc_feature (140)..(140): n is a, c, g, or t
  modified_base (159)..(159): a, c, t, g, unknown or other
  misc_feature (159)..(159): n is a, c, g, or t
  modified_base (183)..(183): a, c, t, g, unknown or other
  misc_feature (183)..(183): n is a, c, g, or t
  modified_base (196)..(196): a, c, t, g, unknown or other
  misc_feature (196)..(196): n is a, c, g, or t
  modified_base (213)..(213): a, c, t, g, unknown or other
  misc_feature (213)..(213): n is a, c, g, or t
  modified_base (259)..(259): a, c, t, g, unknown or other
  misc_feature (259)..(259): n is a, c, g, or t
  modified_base (343)..(343): a, c, t, g, unknown or other
  misc_feature (343)..(343): n is a, c, g, or t
tcagatagagtactcacgaccggtgctcgatttagagtatacatattgggtttgggggagctacaacaggcaggcaggggcagcaagatggtgttgcagacccaggtcttacgatttctctgttgctctggatctctggngcctacggggacatacgtnatcgacccagtctccagacctccnggctgtgtttcgngggcgagacggccaacntacaactgacagtccagccagaattattttaatacgtctaccaaanaactaagaaactacttaagctttacggaccagctaaagaaacctaggacacgtcctacaacgcttcgccttactaagtttacgngggacctacgttaccgaaccccggggtaatccccggggttaccacgggtaaccctatttaccgaacggttcggacctacggggtccggttacgtacgggacctaagtacgtttccaacgtacgtctaagttactaacgcgtacgtacctaggcctacggcttacgaagttacgtggttacgtaccgttaaatttacggtaccttacggttaccgaaggtacttaaacgttaacttaacgttaaccgttaaccggtccccggtaagttccgaaccgtacggaccgtaggtaaccgagtaaccgtagtaacccgagttacggtacgaccgttaggacctacgtattcg

SEQ ID NO: 156081 - DNA, 730 bp, Homo sapiens
  misc_feature: GYAE6OF02HF9MX.29.67.G01.1.454.CMB.1.raw
  modified_base (664)..(664): a, c, t, g, unknown or other
  misc_feature (664)..(664): n is a, c, g, or t
tcagatagagtactcacgaccggtgctcgatttagagtatacatattgggtttgggggagctacaacaggcaggcagggcagcaagatggtgttgcagacccaggtcttcgatttctctgttgctcgtggatctactggtcgaccgtacgggactagtcgtgtactcggaccctagttcctaccgaagtacccttcccgtgggtcctttcggttcgtttcgacgggcgacggtaccggaccaaccgtactaaccgtaaacgtcgaacctaacgtccgaacgaccgtaacggtaaattttaacttttaagaacgtacgtaaccctaacgaaaactaaagttaaaacggtaactttaacgtaacgtccgttaacggacgaacggaacgtaaaccgaaaccgtaggtaaccaacggtacccttaacggtaacgccgtacgtcgttacgttaaactttccggagtaccgtaacgtccggtaaacccgggtacggttcccggtacccagtaccgtagttcgaggtcgacggtacggtccggtaagtcggaactagattaccgactactagaactagtacgacaccgtagtcgaacgtgtactaacggaattcgtcggtacgtcttaatttacgcgtagataacgattaagtatactactccgacggtancggaacgagtacgaggtcacaataacgtaacgagtttaggaccgtacgactacccgtactagtccg

SEQ ID NO: 156082 - DNA, 815 bp, Homo sapiens
  misc_feature: GYAE6OF02GU9MN.29.67.G01.1.454.CMB.1.raw
tcagatagagtactcacgaccggtgctcgatttagagtatacatattgggtttgggggagctacaacaggcaggcaggggcagcaagatggtgttgcagacccaggtcttcatttctctgttgctctggatctcgtggtgcctacggggacatcgtgatgaccagtctccagacctcctggctgtgtttcgtgggcgaggacgggccaccgatacaactgactacgtaccagaccaagtaatttattttatatacgcctaccaaactaaagtaaagtatttaacgtagtacgttacggtaccagaccgtaagaaacccgaaggaacccacgtaccctaccgtaaacgtccgtacgtcgtaccttaacgtttaccggtgggtacctacgtacccggttaaccccggggacggttacccccggggtcccgtcggtaacccgtacttacggtacggtacggggaccgaacgggtccgggtttcggtacggggtacgtaacgtttaccgttaaccgtaccgtaccttacgttaaggtttaaacgtcgaacgtaccggtaccctggacggtacggtacgtaggaacgttgttaccgggtactaccgtttaagtttaccgtttacgtacgtccgtaacgttaacgtaaagttttacctaaggttaacccgtttaccccgggttaacccggttacgggttaaccccggacggtaaccgggttaaccggtaaggggtacggttaaaccgtacccggttaaaccgtaaacccggtagttaacggttcgggaccctttacggaacccgtttccgtaacttcccgg

SEQ ID NO: 156083 - DNA, 860 bp, Homo sapiens
  misc_feature: GYAE6OF02G4RRI.29.67.G01.1.454.CMB.1.raw
tcagatagagtactcacgaccggtgctcgatttagagtatacatattgggtttgggggagctacaacaggcaggcaggggcagcaagatggtgttgcagacccaggtcttcatttctctgttgctctggatctctggtcgccgtacgggacatcgtgatcgacccagtctccacgtacctcccgtggcttgttgtttcgtgggcgaggacgggccaccgtactacaacgtgaccgaacgtccgacgacctaataagtttattttatatacgtacctaccaactaaataagtaactttacttacgtaccgttacggtaaccagaccgaaacgaaaccgaacggtaacaccgtaccccgtaacgtaacgtccgtacgtccttacttaacgtttacgtccggacctaacgttaaccccgggtaaccccggggtaacccggtccccggggttaccccgtaccggttaacccgtacgtttccggtacggtccggtacggacgggttcccgggtacgaacgggtaccttacggtaacctttaccaaccgttaccttacggtaacgtttaaagttacggaccgtaccgttaccgagaccgtaggggtaacctaagggtagttacggtaccggttacggtaccttttaacgttttaaccgtaccgttacgtaccgtacgttaaccttaaacgttacctttaaaccgttcccgttaaacccggtccccggttaacggttacccgggaaccggtaaaccgggacccggtttaaggacggggttaaacggtaacccgttaaaccgtaaacgggtaaccggtttacggaacccgggttctacccggtaaccccgtaacttcggttaacccgg

SEQ ID NO: 156084 - DNA, 769 bp, Homo sapiens
  misc_feature: GYAE6OF02GVMAB.29.67.G01.1.454.CMB.1.raw
  modified_base (193)..(193): a, c, t, g, unknown or other
  misc_feature (193)..(193): n is a, c, g, or t
  modified_base (248)..(248): a, c, t, g, unknown or other
  misc_feature (248)..(248): n is a, c, g, or t
tcagatagagtactcacgaccggtgctcgatttagagtatacatattggggtttgggggagctacaacaggcaggcaggggcagcaagatggtgttgcagacccaggtcttcatttctctgttgctctggatctctggtgcctacggggacatcgtgatgacccagtctccagactccctggctgtgtttcgngggcgaggagggccaacctagtcaactgacaacgtccagccagaacttattttanactagtcctaccaacgaataagtaacttacttagtaccttagggtaccaggtaccaagaaaccgaggtaaccacgtaccctaccgtaaggcctcgccgtactaccgtttaacgtggggtacctacgtacccggtaaccggggtaaccgttccccgggggtccctacggtaccgtaatttccggaaggtccggggaaccgtagggtccggggttacgtggggaaaccgtaggttaactttccgaacttaccgtacgtaacgttacgtaacgccgtacgccgttgacgacgggtaccgtaaggaacggttcggttagggtaccggtacctttagtttaacgttcgacgtagtaaccgtacgttaacttacgtttaaccttaccgtaaccccgttacccggtaaccgggttacccggtacccggtaacgggacccgttaaggggtcggttaaacaacggttaacccgtaaaccggtacgttaacgggtccggtaaccggttacggtacgtacccgacgtttccg

SEQ ID NO: 156085 - DNA, 640 bp, Homo sapiens
  misc_feature: GYAE6OF02H7WEL.29.67.G01.1.454.CMB.1.raw
  modified_base (332)..(332): a, c, t, g, unknown or other
  misc_feature (332)..(332): n is a, c, g, or t
tcagatagagtactcacgaccggtgctcgatttagagtatacatattgggtttgggggagctacaacaggcaggcaggggcagcaagatggtgttgtagacccaggtcttcatttctctgttgctctggatctctggtgccgtacggggacatcgtgatgacccagtctccagactcccgtggctgtgtttcgtgggcgaggacgggccaccatcaacgtgacaacgtccagccaagaattattttacgatagacctacaaacaataagtaaatttactagcttaggtaccagcaagaaccaggacagccctacgtaagctgctctattacngggcatccgaacccggtagtccggggtacctgaccgtgttacgagtggacgaggtcggtacgtgggacagtactttccgactaccttcgaagttagtttacgacgtacgcctagcgacggaccgtagaaggtcgttaggtcggtaccttaagttttcttaacgtagtactaagtaaccgttataatttaactaacccgttacgttcccccggtagttacccggacgtaacgggaccgtaagggtacggtaaggactaacgaaaccgttacgtacggtcggtactaccggccaacgttactcgttaccg

SEQ ID NO: 156086 - DNA, 765 bp, Homo sapiens
  misc_feature: GYAE6OF02FHUT1.29.67.G01.1.454.CMB.1.raw
  modified_base (243)..(243): a, c, t, g, unknown or other
  misc_feature (243)..(243): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctctggtgccgtacggggacatcgtgatgacccagtctccagacctccctggctgtgtttcgtgggcgaggacgggccacatcaactgcacgtcctgccagaattattttanatagctaccaaacaataagaattacttagctttaggtaccagacaagaaaccgaggacagacctacctaaagctgcctactatttacgtgggcagtccgtacccggggaacgtcccggggttccctacggacccgtattacaggttgggccacgggtcgggtacgtacggggaacctaggtacttttaccgactaccgttaccgtaagttaacgtttacgaccgtaacggtccgtacgaccggtaacgggtccttaacgggaaagtacgttacgggttacgggtaccctttaagtttttaaccttttaaccgttcggttaccgtaacgtaaccgttaaaacttttaacgttttaaccgtttaaacccgttaaccccggttaccccccgggttaaccggtttacccgggtaacccggtaacccggggaaaccgtaacggggttaaacgggacggtaaacgtaaccgtaaaccggtaaccgttacggtacggtaccgtacggacccgtaccgtacgttacccgg

SEQ ID NO: 156087 - DNA, 626 bp, Homo sapiens
  misc_feature: GYAE6OF02GFNOR.29.67.G01.1.454.CMB.1.raw
  modified_base (159)..(159): a, c, t, g, unknown or other
  misc_feature (159)..(159): n is a, c, g, or t
  modified_base (193)..(193): a, c, t, g, unknown or other
  misc_feature (193)..(193): n is a, c, g, or t
  modified_base (237)..(237): a, c, t, g, unknown or other
  misc_feature (237)..(237): n is a, c, g, or t
  modified_base (252)..(252): a, c, t, g, unknown or other
  misc_feature (252)..(252): n is a, c, g, or t
  modified_base (348)..(348): a, c, t, g, unknown or other
  misc_feature (348)..(348): n is a, c, g, or t
  modified_base (469)..(469): a, c, t, g, unknown or other
  misc_feature (469)..(469): n is a, c, g, or t
  modified_base (521)..(521): a, c, t, g, unknown or other
  misc_feature (521)..(521): n is a, c, g, or t
tcagatagagtactcacgaccggtgctcgatttagagtatacatattggggtttgggggagctacaacaggcaggcaggggcagcaagatggtgttgcagacccaggtcttcatttctctgttgctctggatctctggtcgcctacggggacatcgtgntgacccagtctccagactcctggctgtgtttcgnggcgagacggccacatcactgcacgtccagcagaattattttanatagacctaccaaanaaattaacgaatttaccgttagtccgtttacggtactaacgcgaacgtaacccaggacctagtcccctactaagctacgcctactagttttaccgngggtctaacgttcccggtaaccggacggttccgggtaccctagaccgtatcgacggtacggcctaggtcggtacgtgggactagtctttacactactagacgttactagtccacgtccgcncgtagggactagaacggtcgtcgtacggtccttaagttttcgtacttggtanacgtattaacttatattaccgccgtacccggtagtacgacgacggtccgaggtacggataacggtacaacgtacggtagttccggacgtcgacgtactacttcgg

SEQ ID NO: 156088 - DNA, 863 bp, Homo sapiens
  misc_feature: GYAE6OF02G022Z.29.67.G01.1.454.CMB.1.raw
  modified_base (469)..(469): a, c, t, g, unknown or other
  misc_feature (469)..(469): n is a, c, g, or t
  modified_base (573)..(573): a, c, t, g, unknown or other
  misc_feature (573)..(573): n is a, c, g, or t
tcagatagagtactcacgaccggtgctcgatttagagtatacatattgggtttgggggagctacaacaggcaggcaggggcaggcaagatggtgttgcagacccaggtcttcattttctcttgttgcctctggattctgtggtgaccgtacgggatagtcgtgagtcgacctgtctaccacgtacctccgtggtcttggttacgtttcgtgggaccgaagggtacggacccaaccgtactaacctaacgtcgacgtaaaccgtccacgacctaagtaaacttatttaacgtatacctacctaccgaaactaataaacgtaaacttacgttagtacctttaggaacctagaacgtaaacgaaaccgaagtccgaacgtaccctaacaagtctaccgtctaacttaggtttaccgaggacctaaccgtaccggttaaacccgggacggttaccgggacctacggaccgtanacgtaggtacggacgaacggggtccgttagaacgggtaacttaccgtacgtttacaacccgtacgttagtaaacgtttaagtacgaccgtacggtcccgttaanacgggtaacggttagtaccgttaaaagggtattagggtacccggttaacttaaacggttttaacctcctttaacggaccttaacggtaactttaaaacgttactttttaaaccctaacccggttccccggtttaaaccgggtaaccttaaccggggttaccccgggaaaagggtttacccggtaaagggttaaccgggttaaaccggaaaccgttaaacggtaacccggttaaccgggtttacggaccgggtttaaccaacggtttaccccgtaactaggtttaacccgg

SEQ ID NO: 156089 - DNA, 832 bp, Homo sapiens
  misc_feature: GYAE6OF02HQRTO.29.67.G01.1.454.CMB.1.raw
  modified_base (208)..(208): a, c, t, g, unknown or other
  misc_feature (208)..(208): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggatctgtggtcgccgtacggggacagtcgtgagtcgaccctagtctccacgtacctcccgtgtcgttggttcgtttcggngggacgaggacggcccacgtactacgaacgtcgactaacgtccgacgacctaagttaattttaacgttttaatacgtacggtacccttaacctaaaactaaagttaaacgttaaactttaacgtttacggtaccggttttaacgggaacctacggtaaacctaaaccgggaaaccgaacgggtaaccacccggtacccgttacctaaggtacccttacgtcgttaacgttacgtttacgacggtactaaccggttaccgggtaaccggtaccggtccgggttacccacgttaccgttagccggtaagggttcaccgggtacggggtccgtacggggtacgaacgtaacggttcttaccgaacccgtagtaccgtaaggttacgtaccggacgtaccgtcgtacggtacggacggtagtagtaaccggtcgttacggtacgttaactttcgtttactacggtcgttaacacgttaacgttacgtttaacttaccgtaccgttaccccggtttacggaccggttaccggtaaccggtacggtaacggtagggtacggaactaacggtaaacgtaacggtacgttaccggtaaggtccgttacggaacttacggttaccgttaccgg

SEQ ID NO: 156090 - DNA, 792 bp, Homo sapiens
  misc_feature: GYAE6OF02HIRAN.29.67.G01.1.454.CMB.1.raw
  modified_base (188)..(188): a, c, t, g, unknown or other
  misc_feature (188)..(188): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctcgtggattctcgtggtcgccgtacggggacatcgtgatcgacccagtcctccagacctcccgnggtcctgttcgtttcgtgggcgtaggacggccaccatcaactgactaacgtccagaccgaagtaattagttttacagtacgacctacaaactaaattaaagtaactttaacttagtccgttaggtaaccacgtacgaacgaaaccgtaaggaccacgaccctacgtaacgctacgctacgtatttacgaggctacgttccgaacccggggtacgtcccgggtacctacggtaccgtagttaccggagttcggcgtacggggtaccggttcggtaacggggtacctaacgggttaccttacgaccgtaacgttactaggttaacgttacgaccgtacggtccgtcgacggtacggtacgtaagggaagttacgttacggttaccggtaacttttaacttttaacggtaccgttacggtaaacccggtagtaacgttaaaacgtttaccgtttaaataaccccgtaacccggggttacccgttaacgggttccgtaaccggaaccggggtaaaccgtagggttaccggtaaggtaccgtaaaccggtaaccgttaacggttggttaccggtaccgtaaccggtacggttacccttggttaacccgg

SEQ ID NO: 156091 - DNA, 762 bp, Homo sapiens
  misc_feature: GYAE6OF02JWUGS.29.67.G01.1.454.CMB.1.raw
  modified_base (168)..(168): a, c, t, g, unknown or other
  misc_feature (168)..(168): n is a, c, g, or t
  modified_base (181)..(181): a, c, t, g, unknown or other
  misc_feature (181)..(181): n is a, c, g, or t
  modified_base (194)..(194): a, c, t, g, unknown or other
  misc_feature (194)..(194): n is a, c, g, or t
  modified_base (354)..(354): a, c, t, g, unknown or other
  misc_feature (354)..(354): n is a, c, g, or t
  modified_base (373)..(373): a, c, t, g, unknown or other
  misc_feature (373)..(373): n is a, c, g, or t
tcagatagagtactcacgaccggtgctcgatttagagtatacatattgggtttgggggagctacaacaggcaggcaggggcagcaagatggtgttgcagacccaggtcttcatttctctgttgctctggactctctggtcgccgtacggggacatcgtgatcgacccngtctcagactccnggctgtgtttcgnggcgagacggccaccagtccaagtcgactaacgtccagccgtaagtaacttattttacagtacgtaccttaccaaaacgtaattaaagtaacgtttaacgttagtaccgtttacggtacaacgtacaaacggaaaccaggtaccacggtacctactacgntcgtctactagtttaccgnggactacgtaccgtaaccgggtaacggtcccgggtacctcggtaccgtacttcggacggtacggtcgtaacggggtccggttaggtacgggaactacgtacgtttccgacttcgtagtaacgtacgttacggctacgtctacgtcgtaaccggcgtaaggaacgttcggtcggtaccggttaaacgtttatttaaccgttccgtaagtaccgaacgttactttagttaaactttaccgaaaccccgtttcccggtaaccccgggttattacccggtaacccgggttaacggttaaccggttaccgggaacggttaacgtaacccgtaaacggtaaccggttacgttacggggtccgaccggttcaaacccgttccggtactttaacggg

SEQ ID NO: 156092 - DNA, 245 bp, Homo sapiens
  misc_feature: GYAE6OF01A5L09.45.10.A10.1.454.CMB.1.raw
  modified_base (243)..(245): a, c, t, g, unknown or other
  misc_feature (243)..(245): n is a, c, g, or t
tcagacgcgatcgacacgaccggtgctcgatttagcgtcgatctcagggtcttcgtggctcacgtccaccaccacgcatgtgacctcaggggtccgggagatcatgagggtgtccttgggtttgggggaagaggaagactgacggtcccccaggagttcaggtgctgggcacagcggccctgggctgcctggtcaaggactacttcctcgatcgcgtctgagcgggctggcaaggcgcatagnnn

SEQ ID NO: 156093 - DNA, 287 bp, Homo sapiens
  misc_feature: GYAE6OF02FU57J.45.10.A10.1.454.CMB.1.raw
  modified_base (252)..(287): a, c, t, g, unknown or other
  misc_feature (252)..(287): n is a, c, g, or t
tcagacgcgatcgacacgaccggtgctcgatttagcgtcgatctcaggggtcttcgtggctcacgtccaccaccacgcatgtgaccctcaggggtccgggagatcagtgagggtgtcctttggggttttggggggaagaggaagactgacggtccccccaggagttcaggtgctgggcacagccggcctgggctgcctggtcaaggactacttcctcgatcgcgtctgagcgggctggcaaggccgcatagnnnnnnnnnnnnnnnnnnnnnnnnnnnnnnnnnnnn

SEQ ID NO: 156094 - DNA, 302 bp, Homo sapiens
  misc_feature: GYAE6OF01BWYJG.12.87.H10.1.454.CMB.1.raw
  modified_base (297)..(302): a, c, t, g, unknown or other
  misc_feature (297)..(302): n is a, c, g, or t
tcagatacgacgtacacgaccggtgctcgatttagcagtactgcgttgggtttgggggattcctgagcgattctccggctccaactccggcaacacagccactctgaccatcagcgggacccaggctctcgatgaggctgactattactgccaggcgtgggacagctccacttcccgttatgtcttcggaggtgggaccatggtcaccgtcctaggtcagcccaagaccaaccccactgtcactctgttcccgccctcctctacgtcgtatctgagcgggctggcaaggcgcatagnnnnnn

SEQ ID NO: 156095 - DNA, 528 bp, Homo sapiens
  misc_feature: GYAE6OF01BMEMI.12.87.H10.1.454.CMB.1.raw
  modified_base (225)..(225): a, c, t, g, unknown or other
  misc_feature (225)..(225): n is a, c, g, or t
  modified_base (432)..(432): a, c, t, g, unknown or other
  misc_feature (432)..(432): n is a, c, g, or t
  modified_base (437)..(437): a, c, t, g, unknown or other
  misc_feature (437)..(437): n is a, c, g, or t
  modified_base (520)..(520): a, c, t, g, unknown or other
  misc_feature (520)..(520): n is a, c, g, or t
tcagatacgacgtacacgaccggtgctcgatttagcagtactgcgttgggtttggggctgggcctcaggaagcagcatcggaggtgcctcagccatggcatggatccctctcttcctcggcgtccttgcttactgcacaggttccgtggcctcgtatgacctgactcagccaccctctgtgtccgtcgtccccaggacagacagtcacaatctcatgctctgganatgcagttagggggaaaagtttgctttctggtatcagcagaagccaggccagtcccctgtcttggtcatctataaggatagcaggcggccctgagggacttccgtgagcgattcgtccggctaccaacgtccggacaacacacgccactctacgaccatcgacgccgggaccaggctcgtcgatgagctgactatactgcgaggcgnggacngcctcctaccgttccgttatcgtcgttcggagtcgggactagtcggtccaccgtctacggtcacgtcccaacgaccccacccngtcgtacc

SEQ ID NO: 156096 - DNA, 526 bp, Homo sapiens
  misc_feature: GYAE6OF01CY7S3.12.87.H10.1.454.CMB.1.raw
  modified_base (312)..(312): a, c, t, g, unknown or other
  misc_feature (312)..(312): n is a, c, g, or t
  modified_base (414)..(414): a, c, t, g, unknown or other
  misc_feature (414)..(414): n is a, c, g, or t
  modified_base (519)..(519): a, c, t, g, unknown or other
  misc_feature (519)..(519): n is a, c, g, or t
tcagatacgacgtacacgaccggtgctcgatttagcagtactgcgttgggtttgggctgggcctcaggaagcagcatcggaggtgcctcagccatggcatggatccctctcttcctcggcgtccttgcttactgcacaggttccgtggcctcgtatgacctgactcagccaccctctgtgtccgtgtccccaggacagacagtcacaatctcatgctctggagatgcagttgggggaaaatttgctttctggtatcagcagaagccaggccagtcccctgtcttggtcatctataagatagcaggcgccctnaggattcctgagcgattcgtcggctccaactccggacaacacacgccactctacgaccatcagccgggtacccaggctcgtcgatgaggctgactattacgngcagggcgtgggacaggcctcccacttcccgttatgtccttgggacggtcgggaccctagtcggtccaccggttcctagggtcacgccccaagaccccaaccccntcgtacc

SEQ ID NO: 156097 - DNA, 516 bp, Homo sapiens
  misc_feature: GYAE6OF01DZKNF.12.87.H10.1.454.CMB.1.raw
  modified_base (411)..(411): a, c, t, g, unknown or other
  misc_feature (411)..(411): n is a, c, g, or t
  modified_base (424)..(424): a, c, t, g, unknown or other
  misc_feature (424)..(424): n is a, c, g, or t
  modified_base (509)..(509): a, c, t, g, unknown or other
  misc_feature (509)..(509): n is a, c, g, or t
tcagatacgacgtacacgaccggtgctcgatttagcagtactgcgttgggtttggggctgggcctcaggaagcagcatcggaggtgcctcagccatggcatggatccctctcttcctcggcgtccttgcttactgcacaggttccgtggcctcgtatgacctgactcagccaccctctgtgtccgtgtccccaggacagacagtcacaatctcatgctctggagatgcagttagggggtaaaagtttgctttctggtatcagcagagccaggccagtcccctgtcttggtcatctataaggatagcaggcgcctcgagggtacttccgtgagcgtattccgtccggctacccgaacgtcccggacaacacacgccactctcgaccatcaggccggaccaggctctcgatgngctgactattacngccagcgtaggacacgcctaccgacttccgtatcgtcttggaggtcgaccagtcggcaccgtctagcacgccaacgacccacccntcgtacc

SEQ ID NO: 156098 - DNA, 302 bp, Homo sapiens
  misc_feature: GYAE6OF01AT5JT.12.87.H10.1.454.CMB.1.raw
  modified_base (296)..(302): a, c, t, g, unknown or other
  misc_feature (296)..(302): n is a, c, g, or t
tcagatacgacgtacacgaccggtgctcgatttagcagtactgcgttgggtttgggggattcctgagcgattctccggctccaactccggcaacacagccactctgaccatcagcgggacccaggctctcgatgaggctgactattactgccaggcgtgggacagctccacttcccgttatgtcttcggaggtgggaccatggtcaccgtcctaggtcagcccaagaccaaccccatgtcactctgttcccgccctcctctacgtcgtatctgagcgggctggcaaggcgcatagnnnnnnn

SEQ ID NO: 156099 - DNA, 542 bp, Homo sapiens
  misc_feature: GYAE6OF01C69GT.12.87.H10.1.454.CMB.1.raw
  modified_base (313)..(313): a, c, t, g, unknown or other
  misc_feature (313)..(313): n is a, c, g, or t
  modified_base (323)..(323): a, c, t, g, unknown or other
  misc_feature (323)..(323): n is a, c, g, or t
  modified_base (354)..(354): a, c, t, g, unknown or other
  misc_feature (354)..(354): n is a, c, g, or t
  modified_base (410)..(410): a, c, t, g, unknown or other
  misc_feature (410)..(410): n is a, c, g, or t
  modified_base (531)..(531): a, c, t, g, unknown or other
  misc_feature (531)..(531): n is a, c, g, or t
tcagatacgacgtacacgaccggtgctcgatttagcagtactgcgttgggtttggggctgggcctcaggaagcagcatcggaggtgcctcagccatggcatggatccctctcttcctcggcgtccttgcttactgcacaggttccgtggcctcgtatgacctgactcagccaccctctgtgtccgtgtccccaggacagacagtcacaatctcatgctctggagatgcattgggggaaaatttgctttctggtatcagcagaagccaggccagtcccctgtcttggtcatctataaggatagcaggcgccctnagggattccngagcgattctccggctccaactccggcaacncagccactctagaccatcagccgggacccaggctctcgatgaggctgactattacngccaggcgtgggacagcctcctacgttcccgttatcgttcgttcgggaggtcgggacctagttcgggtcctacccggtcccgtaagggtcccaacgtacccccgaaagaccccaaaccccncgttggtaccc

SEQ ID NO: 156100 - DNA, 552 bp, Homo sapiens
  misc_feature: GYAE6OF01AWW8L.12.87.H10.1.454.CMB.1.raw
  modified_base (300)..(300): a, c, t, g, unknown or other
  misc_feature (300)..(300): n is a, c, g, or t
  modified_base (327)..(327): a, c, t, g, unknown or other
  misc_feature (327)..(327): n is a, c, g, or t
tcagatacgacgtacacgaccggtgctcgatttagcagtactgcgttgggtttggggctgggcctcaggaagcagcatcggaggtgcctcagccatggcatggatccctctcttcctcggcgtccttgcttactgcacaggttccgtggcctcgtatgacctgactcagccaccctctgtgtccgtgtccccaggacagacagtcacaatctcatgctctggagatgcagttgggggaaaagtttgctttctggtatcagcagaagccaggccagtcccctgtctggtcatctataaggntagcaggcggcctcgagggtattccgngacgcgattccgtccggctccaacgtccggacaacacacgccactctacgaccatcgaggaccgggacccgaggcctcgtcgagtggacgctgactattacgtcgccgagggcggtcgggacacggcctcctaccgtttcccgttatcgtcgttcggtagggtcggaccagtcggtcctaccggtccgtacggtccacgacccaacgacccaaccctctcgtacc

SEQ ID NO: 156101 - DNA, 299 bp, Homo sapiens
  misc_feature: GYAE6OF01CAUDZ.12.87.H10.1.454.CMB.1.raw
  modified_base (296)..(299): a, c, t, g, unknown or other
  misc_feature (296)..(299): n is a, c, g, or t
tcagatacgacgtacacgaccggtgctcgatttagcagtactgcgttgggtttgggggattcctgagcgattctccggctccaactccggcaacacagccactctgaccatcagcgggacccaggctctcgatgaggctgactattactgccaggcgtgggacagctccacttcccgttatgtcttcggaggtgggaccatggtcaccgtcctaggtcagcccaagaccaaccccactgtcactctgttcccaccctcctctacgtcgtatctgagcggctggcaaggcgcatagnnnn

SEQ ID NO: 156102 - DNA, 297 bp, Homo sapiens
  misc_feature: GYAE6OF01C18TW.12.87.H10.1.454.CMB.1.raw
  modified_base (251)..(251): a, c, t, g, unknown or other
  misc_feature (251)..(251): n is a, c, g, or t
  modified_base (293)..(297): a, c, t, g, unknown or other
  misc_feature (293)..(297): n is a, c, g, or t
tcagatacgacgtacacgaccggtgctcgatttagcagtactgcgttgggtttgggggattcctgagcgattctccggctccaactccggcaacacagccactctgaccatcagcgggacccaggctctcgatgaggctgactattactgccaggcgtgggacagctccacttcccgttatgtcttcggaggtggaccatggtcaccgtcctaggtcagcccaagaccaacccatgtcactctgttccccncctcctctacgtcgtatctgagcggctggcaaggcgcatagnnnnn

SEQ ID NO: 156103 - DNA, 527 bp, Homo sapiens
  misc_feature: GYAE6OF01BGUZZ.12.87.H10.1.454.CMB.1.raw
  modified_base (472)..(472): a, c, t, g, unknown or other
  misc_feature (472)..(472): n is a, c, g, or t
  modified_base (518)..(518): a, c, t, g, unknown or other
  misc_feature (518)..(518): n is a, c, g, or t
tcagatacgacgtacacgaccggtgctcgatttagcagtactgcgttgggtttggggctgggcctcaggaagcagcatcggaggtgcctcagccatggcatggatccctctcttcctcggcgtccttgcttactgcacaggttccgtggcctcgtatgacctgactcagccaccctctgtgtccgtgtcccccaggacagacagtcacaatctcatgctctggagatgcattgggggaaaagttttgctttctggtatcagcagaagccaggccagtccccctgtcttggtcatctataaggatagcaggcggccctcagggacttccgtgagcgtattctccggctccaactccggcaacacacgccactctcgaccatcgacgccgggacccaggcctcgtcgatgagctgactatactgcaggcgtgggacagcctccacttcccgttatgtcgttcggaggtggaccngtcggtccaccggttcctaggtccacgccccaagaccccaaccccncgtgtaccc

SEQ ID NO: 156104 - DNA, 298 bp, Homo sapiens
  misc_feature: GYAE6OF01EHYO1.12.87.H10.1.454.CMB.1.raw
  modified_base (294)..(298): a, c, t, g, unknown or other
  misc_feature (294)..(298): n is a, c, g, or t
tcagatacgacgtacacgaccggtgctcgatttagcagtactgcgttgggtttgggggattcctgagcgattctccggctccaactccggcaacacagccactctgaccatcagcgggacccaggctctcgatgaggctgactattactgccaggcgtgggacagctccacttcccgttatgtcttcggaggtggaccatggtcaccgtcctaggtcagcccaagaccaaccccatgtcactctgttcccacctcctctacgtcgtatctgagcgggctggcaaggcgcatagnnnnn

SEQ ID NO: 156105 - DNA, 599 bp, Homo sapiens
  misc_feature: GYAE6OF01BNIBK.12.87.H10.1.454.CMB.1.raw
  modified_base (363)..(363): a, c, t, g, unknown or other
  misc_feature (363)..(363): n is a, c, g, or t
  modified_base (420)..(420): a, c, t, g, unknown or other
  misc_feature (420)..(420): n is a, c, g, or t
tcagatacgacgtacacgaccggtgctcgatttagcagtactgcgttgggtttggggctgggcctcaggaagcagcatcggaggtgcctcagccatggcatggatccctctcttcctcggcgtccttgcttactgcacaggttccgtggcctcgtatgacctgactcagccaccctctgtgtccgtgtccccaggacagacagtcacaatctcatgctctggagatgcagttgggggaaaagtttgcttttctggtatcagcagaagccaggccagtcccctgtcttggtcatctataaggatagcaggcgcctcgagggattccgtgagcgattcgtccggctccaacgtccggacaacacncgccactctagaccatcgagccgggacccaggcctctcgatgacgctgactattacngccgagggcgtacgggacacggcccttacccgtaccgtttcccgttagtccgttacggttacgggacgggttccggaaccgtacggttccggttaccccgacccggttccgttaaccgggtacccacccggtaacccgtaaacccgaaaccccctaaccccgtacgttccgtaaccccg

SEQ ID NO: 156106 - DNA, 572 bp, Homo sapiens
  misc_feature: GYAE6OF01EIUF3.12.87.H10.1.454.CMB.1.raw
tcagatacgacgtacacgaccggtgctcgatttagcagtactgcgttgggtttggggctgggcctcaggaagcagcatcggaggtgcctcagccatggcatggatccctctcttcctcggcgtccttgcttactgcacaggttccgtggcctcgtatgacctgactcagccaccctctgtgtccgtgtccccaggacagacagtcacaatctcatgctctggagatgcagttgggggaaaagtttgctttctggtatcagcagaagccaggccagtcccctgtcttggtcatctataaggatagcaggcgccctcagggtattccgtgagcgtattcctccggcctaccaacgtccggacaacacacgccactctagaccactacacgccgggacccagggtcctcgtacgatcggacggcttgaccttattacctcggaccgagggcggtgggaccagcctacccaccgtttcccgttatcgttcgttcgggaggttcgggacctagtcggtaccacccggttcgtacggtccgacgtacccgaaccgacccaaccccctagtcgtacccg

SEQ ID NO: 156107 - DNA, 589 bp, Homo sapiens
  misc_feature: GYAE6OF01A51GC.12.87.H10.1.454.CMB.1.raw
  modified_base (416)..(416): a, c, t, g, unknown or other
  misc_feature (416)..(416): n is a, c, g, or t
tcagatacgacgtacacgaccggtgctcgatttagcagtactgcgttgggtttggggctgggcctcaggaagcagcatcggaggtgcctcagccatggcatggatccctctcttcctcggcgtccttgcttactgcacaggttccgtggcctcgtatgacctgactcagccaccctctgtgtccgtgtccccaggacagacagtcacaatctcatgctctggagatgcagttgggggaaaatttgctttctggtatcagcagaagccaggccagtcccctgtctggtcatctataagatagcaggcgccctcagggattccgtgagcgattctccggctccaactccggacaacacacgccactctgaccatcacggccgggacccagggctcgtcgatgaggctagactattacngaccagggcgtcgggacacgtccgtaccctaccgtttaccgttacgtgttcccgtttacgggacgggttaccgggacctaacgttccgggttacccgtacccggttcccgttaacggggtcccaacgggaccccctaaacggaaccccccaaaccccctagtccggttacccc

SEQ ID NO: 156108 - DNA, 333 bp, Homo sapiens
  misc_feature: GYAE6OF01CCNZD.12.87.H10.1.454.CMB.1.raw
  modified_base (304)..(333): a, c, t, g, unknown or other
  misc_feature (304)..(333): n is a, c, g, or t
tcagatacgacgtacacgaccggtgctcgatttagcagtactgcgttgggtttgggggattcctgagcgattctccggctccaactccggcaaacacagccactctgaccatcagcgggacccaggctctcgatgaggctgactattactgccaggcgtggacagctccacttccgtatgtcttcggaggtgggaccatggtcaccgtcctaggtcagcccaagaccaaacccgcgtgtcaactctcgttccccaccctcctctaccgtcgttatcctgagcgggctggcaaggcgactatagnnnnnnnnnnnnnnnnnnnnnnnnnnnnnn

SEQ ID NO: 156109 - DNA, 299 bp, Homo sapiens
  misc_feature: GYAE6OF01BLBWA.12.87.H10.1.454.CMB.1.raw
  modified_base (295)..(299): a, c, t, g, unknown or other
  misc_feature (295)..(299): n is a, c, g, or t
tcagatacgacgtacacgaccggtgctcgatttagcagtactgcgttgggtttggggggagttcctgagcgattctccggctccaactccggcaacacagccactctgaccatcagcgggacccaggctctcgatgaggctgactattactgccaggcgtgggacagctccacttcccgttatgtcttcggaggtgggaccatggtcaccgtcctaggtcagcccaagaccaaccccatgtcactctgttcccacctctctacgtcgtatctgagcggctggcaaggcgcatagnnnnn

SEQ ID NO: 156110 - DNA, 519 bp, Homo sapiens
  misc_feature: GYAE6OF01EF4ZV.12.87.H10.1.454.CMB.1.raw
  modified_base (294)..(294): a, c, t, g, unknown or other
  misc_feature (294)..(294): n is a, c, g, or t
  modified_base (299)..(299): a, c, t, g, unknown or other
  misc_feature (299)..(299): n is a, c, g, or t
  modified_base (312)..(312): a, c, t, g, unknown or other
  misc_feature (312)..(312): n is a, c, g, or t
  modified_base (318)..(318): a, c, t, g, unknown or other
  misc_feature (318)..(318): n is a, c, g, or t
  modified_base (325)..(325): a, c, t, g, unknown or other
  misc_feature (325)..(325): n is a, c, g, or t
  modified_base (332)..(332): a, c, t, g, unknown or other
  misc_feature (332)..(332): n is a, c, g, or t
  modified_base (354)..(354): a, c, t, g, unknown or other
  misc_feature (354)..(354): n is a, c, g, or t
  modified_base (367)..(367): a, c, t, g, unknown or other
  misc_feature (367)..(367): n is a, c, g, or t
  modified_base (398)..(398): a, c, t, g, unknown or other
  misc_feature (398)..(398): n is a, c, g, or t
  modified_base (408)..(408): a, c, t, g, unknown or other
  misc_feature (408)..(408): n is a, c, g, or t
  modified_base (424)..(424): a, c, t, g, unknown or other
  misc_feature (424)..(424): n is a, c, g, or t
  modified_base (512)..(512): a, c, t, g, unknown or other
  misc_feature (512)..(512): n is a, c, g, or t
tcagatacgacgtacacgaccggtgctcgatttagcagtactgcgttgggtttggggctgggcctcaggaagcagcatcggaggtgcctcagccatggcatggatccctctcttcctcggcgtccttgcttactgcacaggttccgtggcctcgtatgacctgactcagccaccctctgtgtccgtgtccccaggacagacagtcacaatctcatgctctggagatgcattgggggaaaagtttgctttctggtatcagcagagccaggccagtcccctgtcttggtcatctanaaggntagcaggcgcctnagggtntccgtgngcgatcncggctccaactccggcaacacngccactctgaccntacagccgggacccagggctcgcgatgagcngactattacngccagggcggtggacngcctacctacttcccgttatcgtcgttcggagggtccggactagtcggtacacccggtctacggctacgcccaaagaccccaaccccntcgtacc

SEQ ID NO: 156111 - DNA, 684 bp, Homo sapiens
  misc_feature: GYAE6OF01BYMT9.12.87.H10.1.454.CMB.1.raw
tcagatacgacgtacacgaccggtgctcgatttagcagtactgcgttgggtttggggctgggcctcaggaagcagcatcggagttgcctcagccatggcatggatccctctcttcctcggcgtccttgcttactgcacaggttccgtggcctcgtatgacctgactcagccaccctctgtgtccgtgtcccaggacagacagtcacaatctcatgctctggagatgctagttagggggtaaaagtttgtctttcgtggtatcgagcgaagaacgccgaggcctacgtccccgtgtcgttggtctactcgtaagtaacggatacgcgacggccggccctacgacgggtacttccgtaggacgcgtacgttccgtcccgtcgtacccaaccgtccggacctaacaccgacgacctactcgtacgacctatccgacggtccgggaacccagggtccctacgtcggagtcggacggtctacgaacttacgttccgtcggaccggtagggtcggtacgggtacctacggtcccttaccgtaaccgttttcccgttacgttcggttacggttaccggggtacggtccgggaaaccttggttacccgggttactaccccggttccgtacgggtacccaaccgggtacccccggaaccggtaaacccccaccccgtacgttcgttacccccg

SEQ ID NO: 156112 - DNA, 560 bp, Homo sapiens
  misc_feature: GYAE6OF01EM4QX.12.87.H10.1.454.CMB.1.raw
  modified_base (337)..(337): a, c, t, g, unknown or other
  misc_feature (337)..(337): n is a, c, g, or t
  modified_base (375)..(375): a, c, t, g, unknown or other
  misc_feature (375)..(375): n is a, c, g, or t
  modified_base (399)..(399): a, c, t, g, unknown or other
  misc_feature (399)..(399): n is a, c, g, or t
tcagatacgacgtacacgaccggtgctcgatttagcagtactgcgttgggtttggggctgggcctcaggaagcagcatcggaggtgcctcagccatggcatggatccctctcttcctcggcgtccttgcttactgcacaggttccgtggcctcgtatgacctgactcagccaccctctgtgtccgtgtccccaggacagacagtcacaatctcatgctctggagatgcagttgggggaaaagtttgctttctggtatcagcagaagccaggccagtcccctgtcttggtcatctataaggatagcgaggcgccctgagggattccgtgagcgattcnccggctccacgtccggcaacacacgccactctcgaccntcgacggccgggacccaggcctcncgagtcggaggtctgaacttattactcgaccgagggtcggcgggacacggcctacccgtacctttcccgttatcgttcgtcggagggtcgggacctagtcggtaccaccggttccgtaggtcccacggacccctaacgaaccccaacccctgtcgtacccg

SEQ ID NO: 156113 - DNA, 321 bp, Homo sapiens
  misc_feature: GYAE6OF01C7CKP.12.87.H10.1.454.CMB.1.raw
  modified_base (300)..(321): a, c, t, g, unknown or other
  misc_feature (300)..(321): n is a, c, g, or t
tcagatacgacgtacacgaccggtgctcgatttagcagtactgcgttgggtttggggggagttcctgagcgattctccggctccaactccggcaacacagccactctgaccatcagccggacccaggctctcgatgagctgactattactgccaggcgtgggacagctccacttcccgttatgtcttcggaggtgggaccatggtcaccgtcctaggtccagcccaagacccaaccccatgtcactctcgttccccacctcctctacgtctatctgacgcggctggcaacggcacatagnnnnnnnnnnnnnnnnnnnnnn

SEQ ID NO: 156114 - DNA, 305 bp, Homo sapiens
  misc_feature: GYAE6OF01B5KEA.12.87.H10.1.454.CMB.1.raw
  modified_base (291)..(291): a, c, t, g, unknown or other
  misc_feature (291)..(291): n is a, c, g, or t
  modified_base (297)..(305): a, c, t, g, unknown or other
  misc_feature (297)..(305): n is a, c, g, or t
tcagatacgacgtacacgaccggtgctcgatttagcagtactgcgttgggtttgggggattcctgagcgattctccggctccaactccggcaacacagccactctgaccatcagcgggacccaggctctcgatgaggctgactattactgccaggcgtgggacagctccacttcccgttatgtcttcggaggtgggaccatggtcaccgtcctaggtcagcccaagacccaaccccactgtcactctcgttcccgcctcctctacgtctatctgagcgggctggcaaggcncatagnnnnnnnnn

SEQ ID NO: 156115 - DNA, 679 bp, Homo sapiens
  misc_feature: GYAE6OF01B43F5.12.87.H10.1.454.CMB.1.raw
tcagatacgacgtacacgaccggtgctcgatttagcagtactgcgttgggtttggggctgggcctcaggaagcagcatcggaggtgcctcagccatggcatggatccctctcttcctcggcgtccttgcttactgcacaggttccgtggcctcgtatgacctgactcagcccaccctctgtgtccgtcgtccccaggacagacagtcacaatctcatgctcgtggagatgctagttagggggtaaaattttggctttcgtggtatcgagcagaacgccaggccacgtcccctgtctgcatcatagatagcaggccgccctgaggtacttccgagtacgcgtattccgtaccggcctacccacgtcccggacaaccacacgccctactcctacggaaccctacgtaccgacgggccccgggaccccaacgggtccctaccggttacggattagggaacggtccctaaggtaacctttaacgtttaccgcgggtacccaacggggggtcgttaccgggaaccgacgtcccttacccgtacccgtttcccgttatcgggttaccgttacggggacggtccgggacctacggttcggtacccgtacccgttcccggttaggggtacccaacccggtaacccccgaaaccaaccccctaaacccccggtgttcccgtaaccccg

SEQ ID NO: 156116 - DNA, 651 bp, Homo sapiens
  misc_feature: GYAE6OF01DKBS4.12.87.H10.1.454.CMB.1.raw
  modified_base (342)..(342): a, c, t, g, unknown or other
  misc_feature (342)..(342): n is a, c, g, or t
tcagatacgacgtacacgaccggtgctcgatttagcagtactgcgttgggtttggggctgggcctcaggaagcagcatcggaggtgcctcagccatggcatggatccctctcttcctcggcgtccttgcttactgcacaggttccgtggcctcgtatgacctgactcagccaccctctgtgtccgtgtccccaggacagacagtcacaatctcatgctctggagatgctagttagggggtaaaagttttgacttttcgtggtaattcgagtcagaagccaggccacgtcccctgtcttggtcatctagtaaggatagcaggccgccctgagggtacttccgngagcgtacttccgtccggtcctcccgaacgtcccggacaaccacacgccactctagaccatccgacggtaccgggacccaggcctcgtcgagtcggacggtctacgacctattaccgtcgaccgagggtcggtacgggaacacggtcctacccgtaccgttttcccgttaacgttcggttaccgtttccggggacgggttccgggaacccgttaggttaccgggtacccgttacccggtaccgttaccgggtccgaaccggtacccccgaaacgtaacccccgaaacccccgtcgtccggttaaccccg

SEQ ID NO: 156117 - DNA, 877 bp, Homo sapiens
  misc_feature: GYAE6OF01D84OQ.12.87.H10.1.454.CMB.1.raw
tcagatacgacgtacacgaccggtgctcgatttagcagtactgcgttgggtttggggctgggcctcaggaagcagcatcggaggtgcctcagccatggcatggactccctctcttcctcggcgtcctgtcttactgcacgtggttccgtcgcctcgtatcgacctgactcacgccctaccctctgtcgtccgtcgtccccgaggacagacacgtacaactaactcctctatcgtcttcgtaggagtagtaggtacgttaagggttagggggttaaaatttcggttcgttttacggttaggttactacgacggtacgaaggtaaccgaccgaacggtacccgtaccgttccccgtacgtttccgttcggtactacgttacgttaaagtaaggtacgtacggtaccggtacggtcccggtacccgtacggtacggtaccttacgtaggacgtcgttaccgttcccgtaccggtaccctaacccgtaacccgtacccggaactaacccgtaccgaccgtaccctaacgtcctaaccgaacccgtacgtaccggaaccgggtacccgggtaccctacgggtccctaacgtaccggtagtaccgggtacgtccgtaacgttacgtttaaccgttcggtaccgggtaccgggtacgggtaccggtaccgggtaacctcccggttacccgttaccccgtttacccgttaccggtttaccggttaccgggttacccggggttaggggtaccgggttacccggtaacggtttcgggttacccggtaccgttaaccccgggttacggttacccgggaaccccaaccccgggtaaaccccgtaaccccaaacccccgtaaacccggttccgtaaccccggttaacccg

SEQ ID NO: 156118 - DNA, 631 bp, Homo sapiens
  misc_feature: GYAE6OF01E33CE.12.87.H10.1.454.CMB.1.raw
tcagatacgacgtacacgaccggtgctcgatttagcagtactgcgttgggtttgggggctgggcctccaggaagcagccatcggtaggtgcctcagccatggcatggatccctctcttcctcggcgtccttgcttactgcacaggtttccgtggcctcgtatgacctagactcagccaccctctgtgtccgtgtcccaggacaggacagtcacaactcgtcatgctctggagatgctagttagggggtaaaagtttgtctttctggtatctagctagaagtccaggccacgtcccctgtcgttggtcatctagtaaggtataagacaggcgccctagagggattccgtgacgcgattccgtaccggctaccaactccggacaacactacgccactctacgaaccaatcgacggcgggaccctagggcctacgttacgatacggacggactagaccttattacccgcgaccgtacgggcgttagggacctacgccgttacccaccgtttcccgttatcgttaccgttacgggagggtacgggaacctaggttccggttctaacccggtttcgtaacgggttaccaccggtaccccgaaacggaacccccaacccgtacgtcggttaaccccg

SEQ ID NO: 156119 - DNA, 711 bp, Homo sapiens
  misc_feature: GYAE6OF01C2MMW.12.87.H10.1.454.CMB.1.raw
tcagatacgacgtacacgaccggtgctcgatttagcagtactgcgttgggtttggggctgggcctcaggaagcagcatcggaggtgcctcagccatggcatggatccctctcttcctcggcgtccttgcttactgcacaggttccgtggcctcgtatgacctgactcagcccaccctctgtgtccgtcgtccccaggacagacagtcacaatctcatgctctggagatgcgtaggttagggggtaaagtttgtcttttcgtggtatcagacaaggaacgccgaggccacgtcccctgttcgttggtctatcttaagtaaggatagcgacggccggtcccgtcgacgggtcttccgtgacgcgtacgttccgtcccggcctacccgaaccgtccggaccaaccgacacgcctactcctacgacctataccgacggacccgggacccagggtccctacgtaccggtagtcggacgggtctacggtaaccttacgttaccgtcggcccggtagggtccgggtagggaacctacgggtaccccttacccgttacccgttttccccggtttagttccggtttccggttacggggtacgggttccgggaccgttaacgggttccgggttacccgtacccggttacccggttacggacccgaacccggtaaccccccgtaaacgacccccgtaaacccccgtcggtccgttacccccg

SEQ ID NO: 156120 - DNA, 544 bp, Homo sapiens
  misc_feature: GYAE6OF01DAYMB.12.87.H10.1.454.CMB.1.raw
  modified_base (314)..(314): a, c, t, g, unknown or other
  misc_feature (314)..(314): n is a, c, g, or t
  modified_base (324)..(324): a, c, t, g, unknown or other
  misc_feature (324)..(324): n is a, c, g, or t
  modified_base (359)..(359): a, c, t, g, unknown or other
  misc_feature (359)..(359): n is a, c, g, or t
  modified_base (422)..(422): a, c, t, g, unknown or other
  misc_feature (422)..(422): n is a, c, g, or t
  modified_base (536)..(536): a, c, t, g, unknown or other
  misc_feature (536)..(536): n is a, c, g, or t
tcagatacgacgtacacgaccggtgctcgatttagcagtactgcgttgggtttggggctgggcctcaggaagcagcatcggaggtgcctcagccatggcatggatccctctcttcctcggcgtccttgcttactgcacaggttccgtggcctcgtatgacctgactcagccaccctctgtgtccgtgtccccaggacagacagtcacaatctcatgctctggagatgcagttagggggaaaatttgcttttctggtatcagcagaagccaggccagtcccctgtcttggtcatctatagatagcaggcgccctnagggattccngagcgtattccgtccggctccgaactccggcaacncacgccactctcgaccatccacggccgggacccagggcctcgtcgatgaggctgactattacngccaggcgtgggacagcctacctaccgtttccgttaagtcgttccgttcggacggtcgggacctagtcggtcctacccgtccgtaggtccacgacccaaacgacccaacccctntcgtaccc

SEQ ID NO: 156121 - DNA, 612 bp, Homo sapiens
  misc_feature: GYAE6OF01AKI1I.12.87.H10.1.454.CMB.1.raw
  modified_base (316)..(316): a, c, t, g, unknown or other
  misc_feature (316)..(316): n is a, c, g, or t
  modified_base (328)..(328): a, c, t, g, unknown or other
  misc_feature (328)..(328): n is a, c, g, or t
tcagatacgacgtacacgaccggtgctcgatttagcagtactgcgttgggtttggggctgggcctcaggaagcagcatcggaggtgcctcagccatggcatggatccctctcttcctcggcgtccttgcttactgcacaggttccgtggcctcgtatgacctgactcagccaccctctgtgtccgtgtcccccaggacagacagtcacaatctcatgctctggagatgcagttgggggaaaatttgctttctggtatcagcagaagccaggccagtcccctgtcttggtcatctataaggatagcaggcggccctnagggacttccgngagcgattcgtccggcctaccaactccggcaacacacgcccactcgtcgaccactcgacggtccgggacccaggcctcgtcgatcggagctagaccttattacctcggaccgaggtcggtagggacctacggtcccgttccctaccgtttaccccgttagttcggttccgttacggggaggttccgggaacctagttccgggtacccgtacccggttcccgttacgggtccctaacggtacccccgaaacggaacccccaaccccccgtgttcccggttacccc

SEQ ID NO: 156122 - DNA, 294 bp, Homo sapiens
  misc_feature: GYAE6OF01A66IH.12.87.H10.1.454.CMB.1.raw
  modified_base (291)..(294): a, c, t, g, unknown or other
  misc_feature (291)..(294): n is a, c, g, or t
tcagatacgacgtacacgaccggtgctcgatttagcagtactgcgttgggtttgggggattcctgagcgattctctggctccgactctgggaacacagtcactctgaccatcagcgggacccaggctattgatgaggctgtctactactgtcaggcgtgggacagcagcgtggtgttcggcggagggaccagtctgaccgtcttaggtcagcccaaggctcgccccctcggtcactctcgttcccaccctcctctacgtcgtatctgacgcgggctggcaaggcgcatagnnnn

SEQ ID NO: 156123 - DNA, 300 bp, Homo sapiens
  misc_feature: GYAE6OF01EKC8F.12.87.H10.1.454.CMB.1.raw
  modified_base (290)..(290): a, c, t, g, unknown or other
  misc_feature (290)..(290): n is a, c, g, or t
  modified_base (296)..(300): a, c, t, g, unknown or other
  misc_feature (296)..(300): n is a, c, g, or t
tcagatacgacgtacacgaccggtgctcgatttagcagtactgcgttgggtttgggggattcctgagcgattctccggctccaactccggcaacacagccactctgaccatcagcggacccaggctctcgatgaggctgactattactgccaggcgtgggacagctccacttcccgttatgtcttcggaggtggaccagtggtcaccgtcctaggtcagcccaagacccaaccccatgtccactctcgttccccaccctctctacgtctatctgagcggctggcaaggcncatagnnnnn

SEQ ID NO: 156124 - DNA, 692 bp, Homo sapiens
  misc_feature: GYAE6OF01DG2NB.12.87.H10.1.454.CMB.1.raw
  modified_base (199)..(199): a, c, t, g, unknown or other
  misc_feature (199)..(199): n is a, c, g, or t
  modified_base (226)..(226): a, c, t, g, unknown or other
  misc_feature (226)..(226): n is a, c, g, or t
tcagatacgacgtacacgaccggtgctcgatttagcagtactgcgttgggtttggggctgggcctcaggaagcagcatcggaggtgcctcagccatggcatggatccctctcttcctcggcgtccttgcttactgcacagaatccatggcctcctatgagttgactcacgccaccctccatgtccgtcgtcccccgganagacagccagcatcacctgctctgganatgtatgactaatgagtatgtcttccgtggtatcagcaggaagcacggccacgtccccctagtccctactcactctttacaaaactccgaggccgtccctcggtcggggtcctgacgtctattccgtcgtcggcctccgactcgtacgggaaccacgacgtcacgttctcgtacccactccgacgggacccgggaccccgtaggtaccttagttacgtacgtcggacggtccgttacggttaccttaaccgttacgttccggtacggtaacgggtccgggtacggggacgtacggcggtacggtccgggttacgggttcgggtttaccgggggaccgggtaccggggtaaccgtacgggttaccggttcccgggtacccggttcgggtttacccgggtccggaaacccggtccccggaacgggtccccggttaccccgggtccccccggtttccgggttacccccg

SEQ ID NO: 156125 - DNA, 701 bp, Homo sapiens
  misc_feature: GYAE6OF01EMHXV.12.87.H10.1.454.CMB.1.raw
  modified_base (546)..(546): a, c, t, g, unknown or other
  misc_feature (546)..(546): n is a, c, g, or t
tcagatacgacgtacacgaccggtgctcgatttagcagtactgcgttgggtttggggctgggcctcaggaagcagcatcggaggtgcctcagccatggcatggatccctctcttcctcggcgtccttgcttactgcactaggttccgtggcctcgtatgacctgactcacgcccaccctctgtcgtccgtcgtcccaggacagacagtcacatctcatgctcgtggagatgcgtaggttagggggtaaaagtttgtcgttttctaggttactacgaacgcgaacggaacgccgacggaccgtaccgttccccgttggttcgttcggtactacttacgttaagtaaggagtacgacggacggccgtcccgtagtacggtacttccgtagacgtaccgtacgttccgcccggtcctacccgtaccggtacccgactaaccgaccgtaccgacctacgtccgtacgaacctcgtaaccgaccggaccgggtaccctacgggtccttacgcggtatcggagtcctacgtacgtttactacgtcgaccggngggtaccgcggaactccggtccttacccgttacctttccggttactcgggttacgtaccgggtagggttaccgacgttacggtcggttacccctaccgttcggacgtccccgtaccgtaaccccgaaccgacccctaacccgtgtaccgttaccc

SEQ ID NO: 156126 - DNA, 731 bp, Homo sapiens
  misc_feature: GYAE6OF01CTZNU.12.87.H10.1.454.CMB.1.raw
tcagatacgacgtacacgaccggtgctcgatttagcagtactgcgttgggtttggggctgggcctcaggaagcagcatcggaggtgcctcagccatggcatggatccctctcttcctcggcgtccttgcttactgcacaggttccgtggcctcgtatgacctgactcagccaccctctgtgtccgtgtccccaggacagacagtccacaatctcatgctctggagatgacgtaggttagggggtaaaagttttgtacgttttcgtggtatacgagtcaaggaacgccgtacggacccgacggttcccccttggttaccgtttcggtacctacgttacgttaagtaaagggacgttacggacgtacgggtccggtaccctacggagggtaccttccgtagacgtcgtacttcgtcccgtctaccgaacgtccgacaaccacacgacctactccgtacgacctactaccgacggtaccggacctacggcttaccgacgtaacgtcggacggtcttacgtaccgttaacgttccgacgtaccccggtagggtccgggtaccgggtaacctaccggtccttaccccgttaccgttttcccgttaacggttcgttacccggttacggggtacggggtaccggtaaccgttacgggttccggttaccgtacccggttcgttaaccgggtcccaaccgacccctaacccggacccctaaccctccgttacgtaccccg

SEQ ID NO: 156127 - DNA, 620 bp, Homo sapiens
  misc_feature: GYAE6OF01BU425.12.87.H10.1.454.CMB.1.raw
  modified_base (338)..(338): a, c, t, g, unknown or other
  misc_feature (338)..(338): n is a, c, g, or t
tcagatacgacgtacacgaccggtgctcgatttagcagtactgcgttgggtttggggctgggcctcaggaagcagcatcggaggtgcctcagccatggcatggatccctctcttcctcggcgtccttgcttactgcacaggttccgtggcctcgtatgacctgactcagccaccctctgtcgtccgtcgtccccaggacagacagtcacaatctcatgctctggagatgctaggttagggggtaaaagtttgtctttcgtggtatcagcaagaagccaggccagtcccctgtcttggtcatctaataaggatagcgaggccgccctgaggacttccgngagcgtattccgtccggcctaccgaacgtcccggacaacaccacgcccactccacgaaccctagtccgaacggacccgggaccctagggcccttacgtacgagttcggacggtcttacgacttagttaccgtcgaccgacgggtcggtacggactcgacccttacccgtaccgtttcccgttaagtcggttcggtacgggacggtcggaccctgtccgggtaccaccggttccgtaggtcccacggaccccaaacgacccccaacccgtcgtccgtaacccg

SEQ ID NO: 156128 - DNA, 666 bp, Homo sapiens
  misc_feature: GYAE6OF01ER909.12.87.H10.1.454.CMB.1.raw
tcagatacgacgtacacgaccggtgctcgatttagcagtactgcgttgggtttggggctgggcctcagggaagcagcatcggaggtgcctcagccatggcatggatccctctccttcctcggcgtccttgcttactgcactaggttccgtggcctcgtatgacctgactcacgcccaccctcgtgtcgtccgtcgtcccgaggacagacagtacacaactctcatgctcgtggagagtgcgtaagggttagggggttaaagtttggtactttcgtaggttactacgagacgagaacgaccgacggcctacgttccccgttgttcgttagtactaacttacgtaagtaaggacgtcgaccggacggcccggcccgtacgtaggtacttcgtggacgtaccgtacgttccgtcccggacctaccgaacccgtccgacaaccgtaccgaccgccgactcgtacgacctacgaccggtaccggccggacctacgggctccgaagcgtaggacgtcgtacgttactattaccgcggtaccgcgggtacggtcgggaacctcgtacccgttacttacccgtttcgtagtcggttggtcgggtacgtcgggactcggtcgttacgccgttacgacgaccgaccgtaacccaaccgacccacccttgctacccg

SEQ ID NO: 156129 - DNA, 687 bp, Homo sapiens
  misc_feature: GYAE6OF01DOP3L.12.87.H10.1.454.CMB.1.raw
  modified_base (353)..(353): a, c, t, g, unknown or other
  misc_feature (353)..(353): n is a, c, g, or t
tcagatacgacgtacacgaccggtgctcgatttagcagtactgcgttgggtttggggctgggcctcaggaagcagcatcggaggtgcctcagccatggcatggatccctctcttcctcggcgtccttgcttactgcacaggttccgtggcctcgtatgacctgactcagccaccctctgtgtccgtcgtcccaggacagacagtcacaatctcatgctcgtggagatgctaggttagggggtaaatttcgtctttcgtggtatcagacaaggaacgccgacggcctacgtcccctgttcttggtactatcgtaagtaaggatagcgacggccgcccgtagacggtacttccgngacgtcgtagttcccgtaccggctaccgtaaccgtccggaaccaaaccgaccgaccgaccctactccgtacgaccctacgtccgacccgggaccggaccccgacgggtccttccgacgtagtcgggacgtccgtagtaaccttacgttacgtcgcccggtagggtccgggtaaccggacgtaccggtcccttaccgttacccgttttaccgtttaagttccggtttaccggttacggggtacggtccgggtaacctcgggttaccggtcctacccggttcgacggtccgaaccggaccccgtaaaccgaccccaacccctgtcccgttaacccg

SEQ ID NO: 156130 - DNA, 699 bp, Homo sapiens
  misc_feature: GYAE6OF01EX0Q9.12.87.H10.1.454.CMB.1.raw
tcagatacgacgtacacgaccggtgctcgatttagcagtactgcgttgggtttggggctgggcctcaggaagcagcatcggaggtgcctcagccatggcatggatccctctcttcctcggcgtccttgcttactgcacaggttccgtggcctcgtatcgacctgactcacgcccaccctctgtcgtccgtcgtccccaggacagacagtcacaatctcatgctctggagtatgctaggttaggggtaaagtttgtactttcgtaggtatcgagtacaaggaacgccgacggcctaccgtcccctgttcgtcggtctattacgtaagtagatacgcgacggccgtccgtacgaggtactcgtgacgcgtacgttcgccgtcctaccaccgtccggacaacaccaccgacctactctaccgacctataccgacggtcccggacctaggcctacgtacggtatacgggaacgttccgttacgaaccgtttacgttaccgcggacccgtaggggtcggtacggacctacggtacccgttcccgttaccggttttaccgttagttccgggttacggttaccggggtacgggttaccggtaccgtcggttacccgggtaccctaacccggggtttccccgagggtaccccgacccgtaaaccccgtaacccgacccccttaaaccccgttgtccgttaacccccg

SEQ ID NO: 156131 - DNA, 802 bp, Homo sapiens
  misc_feature: GYAE6OF01BN7Y0.12.87.H10.1.454.CMB.1.raw
tcagatacgacgtacacgaccggtgctcgatttagcagtactgcgttgggtttggggctgggcctcaggaagcagcatcggaggtgcctcagccatggcatggatccctctcttcctcggcgtccttgcttactgcacaggttccgtggcctcgtatgacctgactcagccaccctctgtcgtccgtcgtccccaggacagacagtcacaatctcatgctctggagatgcgaggttagggggtaaaagtttgtcttttcgtggtatcgagcgaagaacgccgacggcctacgtcccctgtcgttggtctatactaagtaaggataggcgtacgggccggtcccgtacgacgggtacttccgtaggacggtcgtacgttccgtacccggtccctacccgtaacccggttcccggaaccaaacctaacccgaccggtacccctaaccgttacccgttaccggaacccctacgtacccggaaccggggaccccggggaaccccgaacggggttccccttaccggtaccggtacgtacgggtaccgggtccttaacgggttaacctttaacgtttacccggtaccggacccggtaacgggggttccggtacggggaaccctacggtcccgtttaccccgttaaccggttttccccggttaagttccggtttaccgggttaccggggtacgggttccggggtaaccctagggttcccggttacccgtaacccggttcccggttaacggttacccgaccggtaacccccgaaaccgaaccccctaaccccgttcgtacccgttacccg

SEQ ID NO: 156132 - DNA, 772 bp, Homo sapiens
  misc_feature: GYAE6OF01EAD4U.12.87.H10.1.454.CMB.1.raw
  modified_base (373)..(373): a, c, t, g, unknown or other
  misc_feature (373)..(373): n is a, c, g, or t
tcagatacgacgtacacgaccggtgctcgatttagcagtactgcgttgggtttggggctgggcctcaggaagcagcatcggaggtgcctcagccatggcatggatccctctcttcctcggcgtcctgtcttactgccacgtacggttccgtggcctcgtatcgacctgactcacgcccaccctctgtcgtccgtcgtaccccgaggacagacacgtccaactactctcatcgtctacgtaggagtagtgacgtaaggttaaggggggtaaaattttcgttacgttttcgtaggtactacgagtacgaaggaacgccgacggtcctacccgttccccgttacgttcgttcggtactacttacgtaagtaacggngtacgccgacggtccgaccgtacggtacggtactcgtgacgtcgtaccgttcgtccgcctaccgaccgtccggaacaaccgaccgaccaccgtacttcccgacgtaacccgtgtaccgggacgggaccccgaacgtccggtcttacgacggtagtaccggacgttcgttacgtaacgtttaactcccgggagtcccgggaagggttaccggtccggaccgttacccggtcccgtttaccccttaaccgtttccgggttacgttccgggttacggttaccggggtccggttaaggacccgttaccggttacccggtcccgggttaaccctccgggttaccggacccgttaaccccgaccggtaaccccgtaaacccccaacccgttcgtccccggtaacc

SEQ ID NO: 156133 - DNA, 771 bp, Homo sapiens
  misc_feature: GYAE6OF01EIEIU.12.87.H10.1.454.CMB.1.raw
tcagatacgacgtacacgaccggtgctcgatttagcagtactgcgttgggtttggggctgggcctcaggaagcagcatcggaggtgcctcagccatggcatggatccctctcttcctcggcgtccttgcttactgcacaggttccgtggcctcgtatgacctgactcacgcccaccctctgtcgtccgtcgtcccaggacagacacgtcaacaactctcatcgctcgtggagagtgacgtaggtttaagggggtaaaatttcgtctttcgtaggtactacgagacgaagaacgaccgacggacctaccgtcccgtgttcgttcggtctattacgtaagtaaggtagtacggcgacgggccggtcccgtacggacggttacttccgtacggacgtacgtacgttcccgtcccgtaccctacccgtaaccgtacccggacctaaccgaccgaccgccctaaccgtcgtaccgaacctacgtaccgggaacccgggaccccgggtaccgtacgggtcccttacggaacggtaggttcgaacgggttcccttaacgtaaccgttttacgtaccgcggtaccgggtacgggtcgggtaacggaaccctaccggttccccttacccgtttacccggttttccgtaggttccggttacggggttaccgggtagggttaaccccgacgtttacggtcccggtacccgttaacccggttacggaacccggtccaaccccggtaacccaaacccgtaaccccccgacttcggtctaccccg

SEQ ID NO: 156134 - DNA, 305 bp, Homo sapiens
  misc_feature: GYAE6OF01BC2A2.12.87.H10.1.454.CMB.1.raw
  modified_base (295)..(305): a, c, t, g, unknown or other
  misc_feature (295)..(305): n is a, c, g, or t
tcagatacgacgtacacgaccggtgctcgatttagcagtactgcgttgggtttgggggattcctgagcgattctccggctccaactccggcaacacagccactctgaccatcagcggacccaggctctcgatgaggctgactattactgccaggcgtgggacagctccacttcccgttatgtcttcggaggtggaccatggtcaccgtcctaggtcagcccaagacccaaccccatgtcactctcgttccccgcctcctctacgtctatctgagcgggctggcaaggcgcatagnnnnnnnnnnn

SEQ ID NO: 156135 - DNA, 865 bp, Homo sapiens
  misc_feature: GYAE6OF01CVH18.12.87.H10.1.454.CMB.1.raw
tcagatacgacgtacacgaccggtgctcgatttagcagtactgcgttgggtttggggctgggcctcaggaagcagcatcggaggtgcctcagccatggcatggatccctctcttcctcggcgtccttgcttactgcacaggttccgtggcctcgtatgacctgactcagccaccctctgtgtccgtgtcccccaggacagacagtcacaatctcatgctctggagatgctagttagggggaaaagttttgcttttctggtaatcagcaagaagccaggccacgtcccctgtcttggtcatctaagtaagactagcgacggccgtccctacgagggtacttcccgtggacgtcgtactttcccgtcccggtcctacccgaaaccgttcccggaacctaaacccgaccgaacggcccctaaaccgttccctacggaaccctaacgttaccggaaccgggaccccgggggaaccccctaaggggtccccttaccggtaccggtaaacgttcggtaacgggaccttaacggtaaaccgttaacgttttaccgacggaccccggtaaggggtaccggttaaccgggggaacccttaaccgggtaccccgtttaacccccgttaacccggtttttacccccgggttttaacttaccggggttttcccggtttacccggggggtaaccggggttaaccggggtaacccccgttaggggtttaccccggggttcccccgttaaacccccggggtttaccccgttttaaaccgggggtaccccttaaaacccccggggtaacccccctaaaaacccggggaaaccccccccttaaaaccccccgttaacccggttccccgggtttaaacccccg

SEQ ID NO: 156136 - DNA, 307 bp, Homo sapiens
  misc_feature: GYAE6OF01DX3ZV.12.87.H10.1.454.CMB.1.raw
  modified_base (302)..(307): a, c, t, g, unknown or other
  misc_feature (302)..(307): n is a, c, g, or t
tcagatacgacgtacacgaccggtgctcgatttagcagtactgcgttgggtttgggggattcctgagcgattctccggctccaactccggcaacacagccactctgaccatcagcgggacccaggctctcgatgaggctgactattactgccaggcgtgggacagctccacttcccgttatgtcttcggaggtgggaccatggtcaccgtcctaggtcagccccaaggccaaccccactgtccactctcgttccccgccctcctctaccgtcgtatctgagcgggctggcaaggcgcatagnnnnnn

SEQ ID NO: 156137 - DNA, 722 bp, Homo sapiens
  misc_feature: GYAE6OF01CVBV4.12.87.H10.1.454.CMB.1.raw
  modified_base (514)..(514): a, c, t, g, unknown or other
  misc_feature (514)..(514): n is a, c, g, or t
tcagatacgacgtacacgaccggtgctcgatttagcagtactgcgttgggtttggggctgggcctcaggaagcagcatcggaggtgcctcagccatggcatggatccctctcttcctcggcgtccttgcttactgcacagttccgtggcctcgtatcgactgactcacgcccaccctctgtgtccgtcgtcccaggacagacagtcacactctacatcgtctcgtggagatcgactaggttagggggtaaatttcgtctttcgtaggtatacgagtacgaagaacgaccgacggtacccacggttccccgtacgttacgttcggtactaacttacgtaagtaacggatacggaccgcggcccggtacccgtacgtacggtacttccgtaggaccgtacgtaccgttccgtacccggtacctacccgaacctcccgaacaacccgcgacgccctactcgaccacctacgaccgtacgggcccgaccgacgtccttacgacgtacgaggtaccgtnttaccgtaacttacgtaccgtaccgaccggtacggtcggtaacggtaacgccgtacccgttaccctaccgtttcccgtttaggtcccgttacggtaccgggtcgtaccgggttactaccgggtccggttaccgtacccggtaccggttacggaccctacccggaacccctaacccgaacccccgtaccccgtacgtcccgttaacccg

SEQ ID NO: 156138 - DNA, 705 bp, Homo sapiens
  misc_feature: GYAE6OF01CV5EW.12.87.H10.1.454.CMB.1.raw
  modified_base (151)..(151): a, c, t, g, unknown or other
  misc_feature (151)..(151): n is a, c, g, or t
  modified_base (247)..(247): a, c, t, g, unknown or other
  misc_feature (247)..(247): n is a, c, g, or t
  modified_base (411)..(411): a, c, t, g, unknown or other
  misc_feature (411)..(411): n is a, c, g, or t
  modified_base (436)..(436): a, c, t, g, unknown or other
  misc_feature (436)..(436): n is a, c, g, or t
  modified_base (453)..(453): a, c, t, g, unknown or other
  misc_feature (453)..(453): n is a, c, g, or t
  modified_base (458)..(458): a, c, t, g, unknown or other
  misc_feature (458)..(458): n is a, c, g, or t
  modified_base (486)..(486): a, c, t, g, unknown or other
  misc_feature (486)..(486): n is a, c, g, or t
  modified_base (554)..(554): a, c, t, g, unknown or other
  misc_feature (554)..(554): n is a, c, g, or t
tcagatacgacgtacacgaccggtgctcgatttagcagtactgcgttgggtttggggctgggcctcaggaagcagcatcggaggtgcctcagccatggcatcggactccctctccttcctcggcgtccttgcttactgcactaggttccgnggcctacgtatcgacctgactcagcccacctctggtctcccgtacgtaccccagggaccagtacaagtccaacaatcgtcatcgacttcgtggaanctacggacgtaagggttacgggggtaaattttcgtactttttcgaggtactacgaacgacgaaggaaccgccgaacgggccctacgtccccgttggtaccgttcggactacggttacctaagttaaggacgttacggccgtacggccgaccctaggaggttacnccgtagacgtcgttacgtccggacnctacccgaacgtccganaaccncgaccgtaccctactcaacgaacccganccggaaccggccgaaccgtacgtccgtaccgttaggacgtacgacgggtctacgtaccgtacgttacncggtaacgcgggacgtacgacgtaacgtccttaacccgttcgttcggttaacgtcgttcggtacggttacgggacgtaccgtaggtccgtacctaccggtacctacgtaccgtacccgacccgtaacaccccgaaccttccgtattacccg

SEQ ID NO: 156139 - DNA, 871 bp, Homo sapiens
  misc_feature: GYAE6OF01DS2GW.12.87.H10.1.454.CMB.1.raw
  modified_base (185)..(185): a, c, t, g, unknown or other
  misc_feature (185)..(185): n is a, c, g, or t
tcagatacgacgtacacgaccggtgctcgatttagcagtactgcgttgggtttggggctgggcctcaggaagcagcatcggaggtgcctcagccagtggcatggactccctctcttcctcggcgtccttgcttactgcactacggttccgtggccttcgtatcgacctgactcacgcctaccctntggtcgtccgtcgtacccaggacacgacagtaccactaatcacattcgcctcgtaggagtagtcggtagttaaggttaagggggtaaaattttcgtacgttttacgtaggttaacacgaggaccgaaaggtaccgacccgtacggacccgtaccgtccccgttggttcgttacggtaactacgtttaaccgtaaacgtaaaggtaacgttacgaccggacggtccccggtaaccttcgggaacggtttccgttacgtacggacggtacttaccgtttccgaacccgggtaccttaacccgaaccggttcccggaaactaaccgaaaccgtacgtaacccggaacctttacggtaaccacctaaggtacccggaagggaccccggtaaccgtaaggtacgttacgtaggtacgtacgggacggtttcacgttaaccccgtttagtaccgggttacgtaacgggtcgggttaacccgggtaggaaccgtacggttaacccggggtacggtttacgggggtttcggttacggggtaacccggggtaccggggtaaaccgttccgtaaaaccgggttgttaaaccccggggttacccgttagggtttacccgggaaaccgttcccggaacccgttaccgggtcccgtacccccgttaaccccgggtgttaacccctcccgggtttccccg

SEQ ID NO: 156140 - DNA, 837 bp, Homo sapiens
  misc_feature: GYAE6OF01ET9S2.12.87.H10.1.454.CMB.1.raw
  modified_base (217)..(217): a, c, t, g, unknown or other
  misc_feature (217)..(217): n is a, c, g, or t
  modified_base (229)..(229): a, c, t, g, unknown or other
  misc_feature (229)..(229): n is a, c, g, or t
  modified_base (554)..(554): a, c, t, g, unknown or other
  misc_feature (554)..(554): n is a, c, g, or t
tcagatacgacgtacacgaccggtgctcgatttagcagtactgcgttgggtttggggctgggcctcaggaagcagcatcggaggtgcctcagccatggcatggactccctctcttcctcggcgtccttgcttactgcactaggttccgtggccttcgtatcggacctgacctacacgccacccttcgttcgtcgtccgtacgtacccgagacacgcncgacagcactcncgtcgtctggtaggagtattaggtaacttagtactaagttgtagtacttcgtcgttaccttacggtaacgtccgaacggaacggacggaacggccgtaacggacccctaccggtaccccctttaccgttaccaaggtttaccttaaaccaaaaccgttttacccaaaagggttaaccccggtaccccggttaccgggtcccgggggaacccctttacgggtaccgggtcccggtaacgttccgtacgttacggttccgttcccgggtaccgttcccggtaccgggtaacctaccggtaaccgggttaaccctaaccgttaccgtnaacccgtaccgttaccgtaaccgtaacccgggtaaccccgtaacgggaccggtaccggtacggtaacgtacggtacggtacgttcgtacgtaccttacgtacgtacgtacggtccggtacgggtacggtacggtcggtacgtacgggtacggtcggtccgggtcggggtacggggttacccggtcgggttacgggtaccggtaccgggttaccggttacgggttacccggttaccggtaccccggtaccgggtacccggttacccggtacccccggtacccgg

SEQ ID NO: 156141 - DNA, 744 bp, Homo sapiens
  misc_feature: GYAE6OF01BI9X2.12.87.H10.1.454.CMB.1.raw
  modified_base (228)..(228): a, c, t, g, unknown or other
  misc_feature (228)..(228): n is a, c, g, or t
tcagatacgacgtacacgaccggtgctcgatttagcagtactgcgttgggtttggggctgggcctcaggaagcagcatcggaggtgcctcagccatggcatggatccctctcttcctcggcgtcctgcttactgcacaggttccgtggcctcgtatgacctgactcacgcccacccttctgtcgtccgtcgtccccaggacagacatcacaatctcatgctcgtgganatgctaaggttagggggtaaatttgtactttcgtggtatcgagacgaagaacgccacggacctaccgtccccgttgttccgttggtactaacgttaccgtaataaaggacgttaacggcggtaccgggtcccggtacccgtacggtacggggttactttcccgtaggaaccggtacggtaaccgtttcccggtaccccggtaccgttaaccccgaaacccgtccccggaaccaaacccgaacaccggaccctaaccgtcctaccggacctaacgtaccggaccgggaccggtaacccgacggtccctacggtacgacgtcggacggtctacgtaacttacgttacgcgaccgtacgggacggtacggacgacgtcccgtaccttaccggttttcccgttagtccggttacggtccgggtaggtccggaacgttacggtcggttaccgaaccggtccggttaacgacccgtaaccgaacccgaaacccaaccccgtaacccctggttcctaaccccg

SEQ ID NO: 156142 - DNA, 805 bp, Homo sapiens
  misc_feature: GYAE6OF01C3S5C.12.87.H10.1.454.CMB.1.raw
tcagatacgacgtacacgaccggtgctcgatttagcagtactgcgttgggtttggggcgtgggcctcaggaagcagcatcggaggtgcctcagccatggcatggactccctctcttcctcggcgtccttgcttactgcacgtacggttcccgtcggtccctcggtatcgaccctgacctcacgccctaccctcgttcgtcgtcccgtccgtacccgacggaccacgacacgtccaacaactctacagtcgcctgtgagtgtcgacgtagggttaacggggtattttggtctttcgtgtatcgagtacgaacgtacgaccgacggtccctaccgtccccttggttcgttacggtactatacgtaagtacggtacacggcgacgggtccgtccgtacgtacggtacgttacgtaggacgtcgttaccgtccgtacccggtaccctaccgtaaccgtacccgaaccgtaacgacccgtaccgaccttacgtacccgtacgtaaccctcggtaacccggaccggggttacccgacccggtaaccgtacccgtttccgacgggtacgttaccggaccgggtttacttaccgtaaccgtttacgtaccggtaccggtcgggtaaccgggttcgggtaacggaccggttacccgttacccgtacccgttttcccggttaacccggtttgttaccgggttaccggttacggggtcggtacccggtacgccggttacggttacccgtaaccggttacggtaccgaccctacccggaacccctacccgaaccccgtaccctccgtaccgttcccg

SEQ ID NO: 156143 - DNA, 796 bp, Homo sapiens
  misc_feature: GYAE6OF01AFVW2.12.87.H10.1.454.CMB.1.raw
  modified_base (335)..(335): a, c, t, g, unknown or other
  misc_feature (335)..(335): n is a, c, g, or t
  modified_base (468)..(468): a, c, t, g, unknown or other
  misc_feature (468)..(468): n is a, c, g, or t
  modified_base (498)..(498): a, c, t, g, unknown or other
  misc_feature (498)..(498): n is a, c, g, or t
tcagatacgacgtacacgaccggtgctcgatttagcagtactgcgttgggtttggggctgggcctcaggaagcagcatcggaggtgcctcagccatggcatggatccctctcttcctcggcgtccttgcttactgcacgaggttccgtggcctcgtatcgacctgactcacgcccaccctctcgtcgtccgtcgtcccaggacagacagtcacatctcatgctcgtggagctgcgtaggttaggggtaaagtttgtcgtttcgtaggtactcgagacgagaacgccgacggcctaccggtccccgttgtcgttcggtactatactaagtaacggntacggcgacgggcccggtacccgtacggtacgggtacttccgaggtacgtacgttacgttcccgtcccggtacctacccgtaaccgtacccggaactaaccgaccgaccgtacctaccgtacgaccgtaaccncgtaccggaccggtacccggggtaaccccncggttccctaccgtacggacgttacggacgttcttaaccgtaaccgttagttcccggacggtacccgggtacggggtaccggtaacggaacccgttaccggtaccccttttaccccgggtacccgtttttcccggtttacggtttccggttaccggggtttaacggggacggggttaaaccccggtcgtaccggtttacccgggtaccccgtaccggtttacccgggtacggtaccccgtaaccccgaaacccgtaacccccggtaaccccctaacccgttcggttcccgtaaccccg

SEQ ID NO: 156144 - DNA, 696 bp, Homo sapiens
  misc_feature: GYAE6OF01BTGFP.12.87.H10.1.454.CMB.1.raw
tcagatacgacgtacacgaccggtgctcgatttagcagtactgcgttgggtttggggctgggcctcaggaagcagcatcggaggtgcctcagccatggcatggatccctctcttcctcggcgtccttgcttactgcacgaggttccgtggcctcgtatgacctgactcagcccaccctctgtgtccgtcgtccccaggacagacagtcacaatctcatgctcgtaggagatgactaggttaggggtaaatttggtctttcgtggtatcgagacaacgagccgaggacccgtacgtccccgttagtccgtttggtactagttacgttaaacgtaaggtactaggcgacgggtccgtccccgtggacggtcgttacccgtaggacgtcgtacttcccggtccgtacctacccaacgtcccggaacaaccaccgacgtaccctacctacgtaccaaccgtactacccggaaccgggcccggtaccccgtacggtcctaccggtacgtaagcggaccgtacgtacgtaacctttacgtacgtcccgacgggtacgtcgggtcggacaccggtccttacccgtaccgtttaccctaggttccgttcgggtacggtagggttccggacttcgggtccgtacctaccggtaccgtaccgtacgaccctaacccacccgtaacccaccccttgcccggttaccc

SEQ ID NO: 156145 - DNA, 326 bp, Homo sapiens
  misc_feature: GYAE6OF01EKO7G.12.87.H10.1.454.CMB.1.raw
  modified_base (300)..(326): a, c, t, g, unknown or other
  misc_feature (300)..(326): n is a, c, g, or t
tcagatacgacgtacacgaccggtgctcgatttagcagtactgcgttgggtttggggggattcctgagcgattctccggctccaactccggcaacacagccactctgaccatcagcgggacccaggctctcgatgaggctgactattactgccaggcgtgggacagctccactttcccgttatgtcttcggaggtggaccatggtccaccgtcctaggtcagcccaagacccaacccactgtcactctcgtcccgcctctctacgtcgtatctgacgcgggctggacaaggcgcagtagnnnnnnnnnnnnnnnnnnnnnnnnnnn

SEQ ID NO: 156146 - DNA, 414 bp, Homo sapiens
  misc_feature: GYAE6OF01A6SV6.12.87.H10.1.454.CMB.1.raw
  modified_base (270)..(270): a, c, t, g, unknown or other
  misc_feature (270)..(270): n is a, c, g, or t
  modified_base (370)..(370): a, c, t, g, unknown or other
  misc_feature (370)..(370): n is a, c, g, or t
  modified_base (377)..(414): a, c, t, g, unknown or other
  misc_feature (377)..(414): n is a, c, g, or t
tcagatacgacgtacacgaccggtgctcgatttagcagtactgcgttggggtttgggggggattcctgagcgattctccggctccaactccggcaacacagccactctgaccatcaggccgggacccaggctctcgatggaggctgactattactgccagggcgtgggacagcctcctacttcccgttatcgtcgttcgggagggttcgggacctagttcgggtccacccggttccgtaggtccacgaccccaaagacccccaaaccccnttcgtaccaccttccgttccttacccccaccccttccttccgtaacgttccgtactcgtcggaggtcccgggctacgggcaacgggtcgactagtagctncagctannnnnnnnnnnnnnnnnnnnnnnnnnnnnnnnnnnnnn

SEQ ID NO: 156147 - DNA, 950 bp, Homo sapiens
  misc_feature: GYAE6OF01B19XV.12.87.H10.1.454.CMB.1.raw
tcagatacgacgtacacgaccggtgctcgatttagcagtactgcgttgggtttggggctgggcctcaggaagcagcatcggaggtgcctcagccatggcatggatccctctcttcctcggcgtccttgcttactgcacaggttccgtggcctcgtatgacctgactcagcccaccctctgtcgtccgtcgtcccaggacagacagtcacaatctcatcgctcgtggagagtgcgtaggttagggggtaaaagtttcgtacgttttcgtagggttattcgaacgtcgaaggtaaccggacccgtaaccgggacccctaaccggttcccccctttaggttccgttttcggggtcctaacgttaccttaaaggttaaaaggtaagttaacggccggaacggggtcccgggtacccccgttacggtaacggggttaccgttacccggttggaccggtattaaccggtttcccgttccccggggtcccctacccgtaacccggttacccgggtaacccaaaccctaacccgaccccgtacccgtaccccgtttaccgtaccgttaacccaccggtaccggtaacccgggccccgggggtaaccccccacggggtacccctttacccgggtacggtaaccgggtaccggtaacgggtacccgtttagggtaaacccgttttaaccgtttaccccgggtaacgtacccggccggggtaccggggtaacggggaccctacggttaccccttacccggtttaaccccgttttacccggtttacggtttcccggtttcggggtttaccggggtaccggggttaccgggttaaccccttaggggtcccggttaacccggtcccccgggtttacccgttaaccgggttacccgacccggttaaacccccccggaaaccgtaaacccccccgtaccccgtacccgttccccggtttacccccg

SEQ ID NO: 156148 - DNA, 852 bp, Homo sapiens
  misc_feature: GYAE6OF01BMOKU.12.87.H10.1.454.CMB.1.raw
tcagatacgacgtacacgaccggtgctcgatttagcagtactgcgttgggtttggggctgggcctcaggaagcagcatcggaggtcgcctacagccatggcatggactcctctcttccgtcggcgtcttgcttactgcacgtacggttccgtgcctacgtatcgacctgacctcgacgccctacctgtgtcgtccgtccgtacccgaggacacgacagtacactaactctcgtactcgtacgtcgtaggtactagtcgtaggttaagggttaaacggggttaactttcggtacgttttcggtacgtactaccgaagtaccgaacgtaccggcggtaccggtacccctccggtttccccgttaggttaccggttacgtaaccgtacttaacggttaacgtaacggtacgtaccgggaccggtacgggtaccccgtacggtacgggtacgttaccgtacggtacggtaacgtccgttaccgttccccgtcggtacccctaaccggtacccgacccgtaaacaaccgtaccggtaaacctcccctaacgtaccgacggtacccgtacgtacccgggtacccgggaccccggtaacggtaccgtccgtaaccggtacggtaccggtacgtacgtaccggttactaaccgttagtacccggcggtaggtccgggtacgggtacctacgacccgttccgttaaccgttaccggtttacctcgggttccgtaacggtcggggtacccgttcgggaaccgtttccgggccggttaaacccgtcccggttaaggacccgttacccgaaccccgtaaaccccggaccctaaccccggtccccttaagtcccggttaaccccg

SEQ ID NO: 156149 - DNA, 1048 bp, Homo sapiens
  misc_feature: GYAE6OF01D17Z5.12.87.H10.1.454.CMB.1.raw
  modified_base (179)..(179): a, c, t, g, unknown or other
  misc_feature (179)..(179): n is a, c, g, or t
tcagatacgacgtacacgaccggtgctcgatttagcagtactgcgttgggtttggggctgggcctcaggaagcagcatcggaggtgcctcagccatggcatggactccctcttcttcctcggccgtccttgcttactgcacgtacggttccgtggccttcgtactcgacctgactcacncccaccctcgttggtccgtccgtccgtcccgaggaccacgacacgtccaactaactctacagttcgccgtgtaggacgtacgttacggtaacggttaagggtttaaacgggggggttaaaactttttcggttaccgtttttacggttacggggttaacttaccgaaacgggtaaccggaaacggtaacccgggacccgtaaccgggtacccccgtacccggtttaccccccggtttggttttaccgggttaccggttaccgtttaacgtttaaacccggttaaaggttaaacggggtaacggttaccgggaccgggtaacccggggcccccggttaccccggttagggtaacccggtttaccggtttccggtaagggtaaccgggtaccgtttacccggttttccccggtaccccgggttaccccgtaaaccccggtaacccggtacccgaaaccgaaacccgtacccgaaccgtccccgttacgtacccgtaaccgtacctaccgaccgggtaccgggaccccgggtaccgacggttacccgtccgtaaggtaccggacgggtaccgtacccggttaaggtttaacctacgttaccggtaccggttaccggacgggttacgggaacccgtaacccgtaccggttaccccgttaccctttacccggttttacccggttacgggtttcccgggtttaaccggttaacggggggtaccgtttaaaccgggaccccgggtttacggtttaccccggggtaaccccgtttaaccgggtccgggtttaaacccccgtcgggaaacccccgttaacccccgaaaaccccccgggttaaccccttaaccccgttcgtaccccggttttaacccccg

SEQ ID NO: 156150 - DNA, 699 bp, Homo sapiens
  misc_feature: GYAE6OF01BY6TP.12.87.H10.1.454.CMB.1.raw
  modified_base (204)..(204): a, c, t, g, unknown or other
  misc_feature (204)..(204): n is a, c, g, or t
  modified_base (405)..(405): a, c, t, g, unknown or other
  misc_feature (405)..(405): n is a, c, g, or t
tcagatacgacgtacacgaccggtgctcgatttagcagtactgcgttgggtttggggctgggcctcaggaagcagcatcggaggtgcctcagccatggcatggatccctctcttcctcggcgtccttgcttactgcacaggttccgtggcctcgtatgacctgactcagccaccctctgtgtcccgtgtcccccaggacagacngtcacaatctcatgctctggagatgcagtttggggggaaaatttgtcttttctggttactctagcagaacgccaggccagtccccctggtccttggtcatctaagtaacggatagccgtaggccggccctcgagggtattccgtgagcgtacttcgccggtcctaccgactccggcaacacgtacgccacctctacgaccntacgagccgggacccagggtccctcgtggaacttgacgggtctcggtaacctacttaccgtgtaacccgtagggacgggttaccgggaacgtccgtaccccgttacctaacccgttttccccggtttacttacgggttcccgtttcgggggtaaccgggttccggggaaacccgtcgtttcggggtcccccggttaaaccccgggttccgttaacgggttacccgaacccgggaccccccttaaaacgggaacccccccgttaaaccccctacccggttccccgggttaaaccc

SEQ ID NO: 156151 - DNA, 925 bp, Homo sapiens
  misc_feature: GYAE6OF01D8M1I.12.87.H10.1.454.CMB.1.raw
tcagatacgacgtacacgaccggtgctcgatttagcagtactgcgttgggtttggggctgggcctcaggaagcagcatcggaggtgcctcagccatggcatggactccctctccttccgtcggccgttccttgcttactgcacgtacggttccgtggcctcgtatcgacctgactcacgcctaccctctgtcgtccgtcgtccccaggacacgacagtcacatctcatcgcttcgtaggacgtagtgacgtaagggtttaagggggttaaaagttttcgttcgttttacgttaggtaactcgtacgacgaacggaaccgaccgaccggtcccgtaccgttccccgttcgtttcgttggttacctacgttaccgttaaaggttaaaggacgtacggaccgaacgggtcccgccgtacggacggttacttccgagtacggcttacgttccgtccggtacctaacccgaaccgtccgaaccaaccgactacccgtacctacgtacctacgtaacccacggtaccgacccggggtaccccggtaccgtaccgggtcttccggtaccggtagtaccgggtactacccgttaacggttaacctttccgttaacggcccggaaacgggttccgggggtaccgggtaaaccggggttaccacccggtttacccctttaaccccgggttttacccgttttaccccgggtttaaggtttaccggggtttcccggggtttaacgggggtaccccgggggttttaccgggtaaacccctttacgggggtttacccgggtttaacccccggtttaaccccggggttcccggttaacccgggtaaaccccggtaaacccccccggtaaaccccccgggaaaacccccgtaaccccccggttaaacccccgttaccgttaccccgggtttaacccccccg

SEQ ID NO: 156152 - DNA, 819 bp, Homo sapiens
  misc_feature: GYAE6OF01AUQ2Z.12.87.H10.1.454.CMB.1.raw
  modified_base (219)..(219): a, c, t, g, unknown or other
  misc_feature (219)..(219): n is a, c, g, or t
  modified_base (252)..(252): a, c, t, g, unknown or other
  misc_feature (252)..(252): n is a, c, g, or t
  modified_base (728)..(728): a, c, t, g, unknown or other
  misc_feature (728)..(728): n is a, c, g, or t
tcagatacgacgtacacgaccggtgctcgatttagcagtactgcgttgggtttggggcgtgggcctcaggaagcagcatcggaggtgcctcagccatggcatggactccctctcttcctcggcgtccttgcttactgcacgtggttccgtcggcctcgtatcgacctgactccacgccctaccctgtcgtcgtcccgtcgtaccccgaggaccaggacncgtacacactcctacatcgactcgtggactagngtacgtagggtttaaggggtaactttcgtcgttttcgtacggttatacagtacgaacggacgtaccgaccggccgtaccgttcccgttgttccgttaggtctacgttacgtaaggtaacggacgtaggccggtaccgggtccggtaccccgtaggtacgggttaaccttcccgttaaggaccgtaccggttactttcccggtacccggttacctacccggttaacccgccccgggtaacaaaccggtacccgtaccggtaaaccctccgggttaaccaccggaacctttaccgcccggaacgggaccccggtacccagggttcctaaccggtcggtactacgggtcccgaggtttcccaagttttaccgccggtacgaacggttagggaccggtcgaaccttccggttaccccttaccgggtttacctttcccgggaagtttcccgggtaaggtttccggggccggtaaacccgtntttcccggggtaccgttccgaacccgttcggaaccggttccccaccgtaccccggaaccttaacccccgaccctttgtcccgttaaccccg

SEQ ID NO: 156153 - DNA, 698 bp, Homo sapiens
  misc_feature: GYAE6OF01B33JL.12.87.H10.1.454.CMB.1.raw
  modified_base (200)..(200): a, c, t, g, unknown or other
  misc_feature (200)..(200): n is a, c, g, or t
  modified_base (219)..(219): a, c, t, g, unknown or other
  misc_feature (219)..(219): n is a, c, g, or t
  modified_base (233)..(233): a, c, t, g, unknown or other
  misc_feature (233)..(233): n is a, c, g, or t
tcagatacgacgtacacgaccggtgctcgatttagcagtactgcgttgggtttgggggctgggcctcaggaagcagcatcggaggtgcctcagccatggcatggatccctctcttcctcggcgtccttgcttactgcacaggttccgtggcctcgtatgacctgactcacgcccaccctcgtcgtgtccgtcgtcccccnggacagacagtcacaatcncatgctctggacgntgacgtaggttagggggtaaatttcgtacttttcgtagggtactcgaagccgaaggaacgccgtacggaccctaccgtcccctgttcgttcggtactagttactaagtaaggatacgacggacggccgtccctacggacggtacttccgagacgtcgttacctccggtccggtacctacccgaaccgtcccggaactaaccactaaccgccctaacgtcctacgacctacgtaccgaccgggccccggaccgtacgacgttcgtacgtacggcggtaacgtcttacggtacctttacgtaccggacgtccgggtacgggtcggtaccggtaactcccggtccctttaccgttccccgtttacggttacgtccgttacgggtaccggacggttacgacccgttagttcccggtacgtacccgtcgaacgttcaaccgtacccaccgtaacccacgtcgtctacccg

SEQ ID NO: 156154 - DNA, 357 bp, Homo sapiens
  misc_feature: GYAE6OF01AC5IA.12.87.H10.1.454.CMB.1.raw
  modified_base (154)..(154): a, c, t, g, unknown or other
  misc_feature (154)..(154): n is a, c, g, or t
  modified_base (260)..(260): a, c, t, g, unknown or other
  misc_feature (260)..(260): n is a, c, g, or t
  modified_base (334)..(334): a, c, t, g, unknown or other
  misc_feature (334)..(334): n is a, c, g, or t
  modified_base (336)..(357): a, c, t, g, unknown or other
  misc_feature (336)..(357): n is a, c, g, or t
tcagatacgacgtacacgaccggtgctcgatttagcagtactgcgttggggtttgggggggattcctgagcgattctccggctccaactccggcaacacagccactctgaccatcagccgggacccaggctctcgatgaggctgactattacgngccgaggcgtgggacagcctcctacgttccgttatgtcgttcgggagggtcggaccagtcggtccaccggttcgtacggtacacggacccaaacgacccaaccccngtctcactccgtctccccgcctctctacgtcgtactcgtacggacggtcggcgtcggaccgaggccatagtagnannnnnnnnnnnnnnnnnnnnnn

SEQ ID NO: 156155 - DNA, 717 bp, Homo sapiens
  misc_feature: GYAE6OF01CXPR4.12.87.H10.1.454.CMB.1.raw
  modified_base (278)..(278): a, c, t, g, unknown or other
  misc_feature (278)..(278): n is a, c, g, or t
  modified_base (506)..(506): a, c, t, g, unknown or other
  misc_feature (506)..(506): n is a, c, g, or t
  modified_base (530)..(530): a, c, t, g, unknown or other
  misc_feature (530)..(530): n is a, c, g, or t
tcagatacgacgtacacgaccggtgctcgatttagcagtactgcgttgggtttggggctgggcctcaggaagcagcatcggaggtgcctcagccatggcatggatcctctcttcctcggcgtcttgcttactgctacaggttccgtggcctcgtatgacctgactcacgcccacctgtcgtcgtccgtcgtccccaggacacgactagtacactaatctacacgtgactctaggactatgacgtagttaaggggtaaagtttggtctttcgaggtacncgagacgaggaacgccgaacggcctaacgtcccgtgttcccgtggtacacttacgtaataaggtgtacgacggacgggtccgtacccgtagaacgggactttccgaagtcgtacgtacgtccggtaccgcctaaccggaaccttccggaacaacgacgcgtaacctaccgttacgccgaactacgtaccgacggaccggggtaaccacgtcgtcgtacggacgtacgngggtacctaagtacgtaacgtacncgtaccggacgggtcggtacggaaccgttacggccctaaccccgttacttttaccgtacgttacggtcggttacccgggagggtacccggtagtaaccgtcgggttaacccgacccgttcgttaacccgggaccctaaaccgggacccctaaaccggaaccccaaccccgtcgttcgggtaaccccc

SEQ ID NO: 156156 - DNA, 301 bp, Homo sapiens
  misc_feature: GYAE6OF02F6O5I.12.87.H10.1.454.CMB.1.raw
  modified_base (297)..(301): a, c, t, g, unknown or other
  misc_feature (297)..(301): n is a, c, g, or t
tcagatacgacgtacacgaccggtgctcgatttagcagtactgcgttgggtttgggggattcctgagcgattctccggctccaactccggcaacacagccactctgaccatcagcgggacccaggctctcgatgaggctgactattactgccaggcgtgggacagctccacttcccgttatgtcttcggaggtgggaccatggtcaccgtcctaggtcagcccaagaccaaccccactgtcactctgttcccgccctcctctacgtcgtatctgagcgggctggcaaggcgcatagnnnnn

SEQ ID NO: 156157 - DNA, 490 bp, Homo sapiens
  misc_feature: GYAE6OF02FNY6F.12.87.H10.1.454.CMB.1.raw
  modified_base (325)..(325): a, c, t, g, unknown or other
  misc_feature (325)..(325): n is a, c, g, or t
  modified_base (485)..(486): a, c, t, g, unknown or other
  misc_feature (485)..(486): n is a, c, g, or t
tcagatacgacgtacacgaccggtgctcgatttagcagtactgcgttgggtttggggctgggcctcaggaagcagcatcggaggtgacctcagccatggcatggactccctctcttcctcggcgtccttgcttactgcacaggttccgtggcctcgtatgacctgactcagccaccctctgtgtccgtgtccccaggacagacagtcacaatctcatgctctggagatgcattgggggaaaatttgctttctggtatcagcagaagccaggccagtcccctgtcttggtcatctataaggatagcaggcggcctcagggattccngagcgattcgccggctccaactccggcaacacagccactctgaccatcagcgggacccaggctctcgatgaggctgacttatactgccaggcgtgggacagctcacttccgtatgtcttggagtggacagtggcacgtctagtcacgccaagaccacccnngtcc

SEQ ID NO: 156158 - DNA, 302 bp, Homo sapiens; identical to SEQ ID NO: 156094
  misc_feature: GYAE6OF02JFTPZ.12.87.H10.1.454.CMB.1.raw
  modified_base (297)..(302): a, c, t, g, unknown or other
  misc_feature (297)..(302): n is a, c, g, or t

SEQ ID NO: 156159 - DNA, 507 bp, Homo sapiens
  misc_feature: GYAE6OF02G2NK7.12.87.H10.1.454.CMB.1.raw
  modified_base (412)..(412): a, c, t, g, unknown or other
  misc_feature (412)..(412): n is a, c, g, or t
  modified_base (427)..(427): a, c, t, g, unknown or other
  misc_feature (427)..(427): n is a, c, g, or t
tcagatacgacgtacacgaccggtgctcgatttagcagtactgcgttgggtttggggctgggcctcaggaagcagcatcggaggtgcctcagccatggcatggatccctctcttcctcggcgtccttgcttactgcacaggttccgtggcctcgtatgacctgactcagccaccctctgtgtccgtgtccccaggacagacagtcacaatctcatgctctggagatgcattgggggaaaagtttgctttctggtatcagcagaagccaggccagtcccctgtcttggtcatctataaggatagcaggcgccctcagggattcctgagcgattctccggctccaactccggcaacacagccactctgaccatccagcgggaccccaggcctcgtcgatcgaggctgactatcngccaggcgtgggacngctccacttccgtatgtcttcggagtggactagtggtccaccgtccgtaggtcacgcccaagacccaaccccactgtacc

SEQ ID NO: 156160 - DNA, 301 bp, Homo sapiens
  misc_feature: GYAE6OF02F8F3T.12.87.H10.1.454.CMB.1.raw
  modified_base (297)..(301): a, c, t, g, unknown or other
  misc_feature (297)..(301): n is a, c, g, or t
tcagatacgacgtacacgaccggtgctcgatttagcagtactgcgttgggtttgggggattcctgagcgattctccggctccaactccggcaacacagccactctgaccatcagcgggacccaggctctcgatgaggctgactattactgccaggcgtgggacagctccacttcccgttatgtcttcggaggtgggaccatggtcaccgtcctaggtcagcccaagaccaaccccactgtcactctgttcccaccctcctctacgtcgtatctgagcgggctggcaaggcgcatagnnnnn

SEQ ID NO: 156161 - DNA, 572 bp, Homo sapiens
  misc_feature: GYAE6OF02HBBTV.12.87.H10.1.454.CMB.1.raw
tcagatacgacgtacacgaccggtgctcgatttagcagtactgcgttgggtttggggctgggcctcaggaagcagcatcggaggtgcctcagccatggcatggatccctctcttcctcggcgtccttgcttactgcacaggttccgtggcctcgtatgacctgactcagccaccctctgtgtccgtgtccccaggacagacagtcacaatctcatgctctggagatgcattgggggaaaatttgctttctggtatcagcagaaggcaggccagccccctgtcctactcatcttacaaaataccaggcgccctcgtcgggtccctgagcgattctctgctccgactcgtgggaacacgacgtcactctacgaccatcacgccgggacccaggctatgatgacggtctgtactacttacgtgtcgaggtcgtagggacagcgaggtcgtaggtcggttccgggacgggacggaccagttccgtaggtacccggttagttacgggtcctaacggccccgtaaggtccgtccggccccccgttggtaccctaccgttccgttcccgttaccccccg

SEQ ID NO: 156162 - DNA, 303 bp, Homo sapiens
  misc_feature: GYAE6OF02HVO2P.12.87.H10.1.454.CMB.1.raw
  modified_base (297)..(303): a, c, t, g, unknown or other
  misc_feature (297)..(303): n is a, c, g, or t
tcagatacgacgtacacgaccggtgctcgatttagcagtactgcgttgggtttggggggattcctgagcgattctccggctccaactccggcaacacagccactctgaccatcagcgggacccaggctctcgatgaggctgactattactgccaggcgtgggacagctccacttcccgttatgtcttcggaggtgggaccatggtcaccgtcctaggtcagcccaagaccaaccccactgtcactctgttcccacctcctctacgtcgtatctgagcgggctggcaaggcgcatagnnnnnnn

SEQ ID NO: 156163 - DNA, 549 bp, Homo sapiens
  misc_feature: GYAE6OF02F2HD3.12.87.H10.1.454.CMB.1.raw
  modified_base (442)..(442): a, c, t, g, unknown or other
  misc_feature (442)..(442): n is a, c, g, or t
tcagatacgacgtacacgaccggtgctcgatttagcagtactgcgttgggtttggggctgggcctcaggaagcagcatcggaggtgcctcagccatggcatggatccctctcttcctcggcgtccttgcttactgcacaggttccgtggcctcgtatgacctgactcagccaccctctgtgtccgtgtccccaggacagacagtcacaatctcatgctctggagatgcagttgggggaaaagtttgctttctggtatcagcagaagccaggccagtcccctgtcttggtcatctataaggatagcaggcggccctcgagggtattcctgacgcgattccgtccggctccaacgtccggacaaacacacgcccactctcgaccatcagccgggacccaggctcgtcgatcggaggctgacttattactgccagggcgtggacngcctccacttccgtatcgtcgttcgggaggtcgggtaccagtcggtacctaccggttcccgttaggtccacggaccccaaacggaccccaaccccgtactcgtaccc

SEQ ID NO: 156164 - DNA, 539 bp, Homo sapiens
  misc_feature: GYAE6OF02H871J.12.87.H10.1.454.CMB.1.raw
  modified_base (311)..(311): a, c, t, g, unknown or other
  misc_feature (311)..(311): n is a, c, g, or t
  modified_base (332)..(332): a, c, t, g, unknown or other
  misc_feature (332)..(332): n is a, c, g, or t
  modified_base (351)..(351): a, c, t, g, unknown or other
  misc_feature (351)..(351): n is a, c, g, or t
  modified_base (354)..(354): a, c, t, g, unknown or other
  misc_feature (354)..(354): n is a, c, g, or t
  modified_base (533)..(533): a, c, t, g, unknown or other
  misc_feature (533)..(533): n is a, c, g, or t
tcagatacgacgtacacgaccggtgctcgatttagcagtactgcgttgggtttgggctggccgtcaggaagcagcatcttgaggtgtcctcagccatggcatggatcctctcttcctcgcgtccttgcttactgcacaggttccgtggcctcgtatgacctgactcagccaccctctgtgtccgtgtcccaggacaggacagtcacaagtctcgatgctctggagatgcagttgggggaaatttgtctttctggtatcagcagaagccagccagtcccctgtcttggtcatcagtagatgcaggcgccctnaggtatcctgagcgtatttcncggctccaactccggcaanacncgtccactctgaccactacacgcggacccacggctctaccgagtcgacggctgactacttactcgaccgacgcgtagggacacgtcctacctaccttccgttatcgttcgttcggacggtacgggtaccgtgtcggtcacccggttccgacggtcacggcccaaccgacctaaccccgngtaccg

SEQ ID NO: 156165 - DNA, 566 bp, Homo sapiens
  misc_feature: GYAE6OF02GBSY9.12.87.H10.1.454.CMB.1.raw
  modified_base (436)..(436): a, c, t, g, unknown or other
  misc_feature (436)..(436): n is a, c, g, or t
  modified_base (453)..(453): a, c, t, g, unknown or other
  misc_feature (453)..(453): n is a, c, g, or t
tcagatacgacgtacacgaccggtgctcgatttagcagtactgcgttgggtttggggctgggcctcaggaagcagcatcggaggtgcctcagccatggcatggatccctctcttcctcggcgtccttgcttactgcacaggttccgtggcctcgtatgacctgactcagccaccctctgtgtccgtgtccccaggacagacagtcacaatctcatgctctggagatgcagttggggggaaaagtttgctttctggtatcagcagaagccaggccagtcccctgtcttggtcatctataaggatagcgaggcggccctgagggtacttcgtgacgcgtattcctccggctcccaactccggacaacacacgaccactctacgacccatccgacggccgggacccacggcctcgcgatcggagtctagacttattacncgccgagggcgtggacncgcctccgtacctttcccgttatcgttcgttcgggacggttcgggacctaggtcggtcctacccggtccgtaggtccgaccggcccaaccgaccccaacccctacgtcgtacc

SEQ ID NO: 156166 - DNA, 530 bp, Homo sapiens
  misc_feature: GYAE6OF02HG2RH.12.87.H10.1.454.CMB.1.raw
  modified_base (298)..(298): a, c, t, g, unknown or other
  misc_feature (298)..(298): n is a, c, g, or t
  modified_base (311)..(311): a, c, t, g, unknown or other
  misc_feature (311)..(311): n is a, c, g, or t
  modified_base (321)..(321): a, c, t, g, unknown or other
  misc_feature (321)..(321): n is a, c, g, or t
  modified_base (324)..(324): a, c, t, g, unknown or other
  misc_feature (324)..(324): n is a, c, g, or t
  modified_base (331)..(331): a, c, t, g, unknown or other
  misc_feature (331)..(331): n is a, c, g, or t
tcagatacgacgtacacgaccggtgctcgatttagcagtactgcgttgggtttggggctgggcctcaggaagcagcatcggaggtgcctcagccatggcatggatccctctcttcctcggcgtccttgcttactgcacaggttccgtggcctcgtatgacctgactcagccaccctctgtgtccgtgtccccaggacagacagtcacaatctcatgctctggagatgcattgggggaaaatttgctttctggtatcagcagaagccaggccagtcccctgtctggtcatctataaggntagcaggcgcctnagggattccngancgattcnccggctccaactccggacaacacagccactctgaccatcagcggacccaggctctcgatgagctgactatactgccaggcgtgggacacgcctccactttcccgttatcgtcttcggaggttcggaacctagtcgggtcctacccggtccgtaacggtccgaacggtccccaaaggaccccaaccccctatcggtaccc

SEQ ID NO: 156167 - DNA, 556 bp, Homo sapiens
  misc_feature: GYAE6OF02JGRPV.12.87.H10.1.454.CMB.1.raw
  modified_base (503)..(503): a, c, t, g, unknown or other
  misc_feature (503)..(503): n is a, c, g, or t
tcagatacgacgtacacgaccggtgctcgatttagcagtactgcgttgggtttggggcgtgggcctcaggaagcagcatcggaggtgcctcagccatggcatggatccctctcttcctcggcgtccttgcttactgcacaggttccgtggcctcgtatgacctgactcagccaccctctgtgtccgtgtccccaggacagacagtcacaatctcatgctctggagatgcagttgggggaaaatttgctttctggtatcagcagaagccaggccagtcccctgtcttggtcatctataaggatagcaggcggccctcgagggtattcctgagcgattccgtccggctaccgaactcccggacaacacgacgcccaactcctacgacccatccaacggccgggaccccagggcctcgtacgagtggaacggctagacttacttacgtcgaccagggtcgtgggacagcctccacgtttccgtagtcgtcgttcggaggtggacgngtcggtccacgtccgtaggtcacgtacccaacggacccaacccacgtcgtacc

SEQ ID NO: 156168 - DNA, 304 bp, Homo sapiens
  misc_feature: GYAE6OF02G96XA.12.87.H10.1.454.CMB.1.raw
  modified_base (298)..(304): a, c, t, g, unknown or other
  misc_feature (298)..(304): n is a, c, g, or t
tcagatacgacgtacacgaccggtgctcgatttagcagtactgcgttgggtttgggggattcctgagcgattctccggctccaactccggcaacacagccactctgaccatcagcgggacccaggctctcgatgaggctgactattactgccaggcgtgggacagctccacttcccgttatgtcttcggaggtgggaccatggtcaccgtcctaggtcagcccaagaccaaccccactgtcactctgttccccaccctcctctacgtcgtatctgagcgggctggcaaggcgcatagnnnnnnn

SEQ ID NO: 156169 - DNA, 511 bp, Homo sapiens
  misc_feature: GYAE6OF02H62FU.12.87.H10.1.454.CMB.1.raw
  modified_base (293)..(293): a, c, t, g, unknown or other
  misc_feature (293)..(293): n is a, c, g, or t
  modified_base (407)..(407): a, c, t, g, unknown or other
  misc_feature (407)..(407): n is a, c, g, or t
  modified_base (422)..(422): a, c, t, g, unknown or other
  misc_feature (422)..(422): n is a, c, g, or t
tcagatacgacgtacacgaccggtgctcgatttagcagtactgcgttgggtttggggctgggcctcaggaagcagcatcggaggtgcctcagccatggcatggatccctctcttcctcggcgtccttgcttactgcacaggttccgtggcctcgtatgacctgactcagccaccctctgtgtccgtgtccccaggacagacagtcacaatctcatgctctggagatgcagttgggggaaaatttgctttctggtatcagcagaagcaggccagtcccctgtctggtcatctanaagatagcaggcgccctgagggatcctgagcgattctcggctccgaactccggcaacacacgccactctcgaccatccaggccgggacccaggctctgatgagctgactattcngccgaggcgtggacngcctccacttccgttatcgtcgttcggagtcgggacctagtcggtccaccgtcctaggtccacgcccaagaccccaacccagtcgtacc

SEQ ID NO: 156170 - DNA, 608 bp, Homo sapiens
  misc_feature: GYAE6OF02FRA7Y.12.87.H10.1.454.CMB.1.raw
  modified_base (256)..(256): a, c, t, g, unknown or other
  misc_feature (256)..(256): n is a, c, g, or t
  modified_base (463)..(463): a, c, t, g, unknown or other
  misc_feature (463)..(463): n is a, c, g, or t
tcagatacgacgtacacgaccggtgctcgatttagcagtactgcgttgggtttggggcgtgggcctcaggaagcagcatcggaggtgcctcagccatggcatggatccctctcttcctcggcgtccttgcttactgcacaggttccgtggcctcgtatgacctgactcagccaccctctgtcgtccgtgtcccaggacagacagtcacaatctcatgctctggagagtgcgagttgggggaaaagtttgctttcgngggtatcagcagaagccaggcccagtcccctgtcttggtctatctataaggatagcaggcggccctcgacgggtattccctgagcgattcgtccggcctaccaacgtccggtacaaccaccgtacgacccaacgttctcggaaccctatccgacgcccggggacccagggcctcgtccggatcggaggtctagaccttagttaccgngtcctaggccgtgggactggtccttaccgtacgtttacccgttatacggttcgttacgggacggttcgggaccctaggtcggttaccacccggttccgttaggtccacgtccccgaacgacccccaaccctaccgtcgtaccccg

SEQ ID NO: 156171 - DNA, 581 bp, Homo sapiens
  misc_feature: GYAE6OF02F6XLT.12.87.H10.1.454.CMB.1.raw
  modified_base (329)..(329): a, c, t, g, unknown or other
  misc_feature (329)..(329): n is a, c, g, or t
  modified_base (455)..(455): a, c, t, g, unknown or other
  misc_feature (455)..(455): n is a, c, g, or t
tcagatacgacgtacacgaccggtgctcgatttagcagtactgcgttgggtttggggctgggcctcaggaagcagcatcggaggtgcctcagccatggcatggatccctctcttcctcggcgtccttgcttactgcacaggttccgtggcctcgtatgacctgactcagccaccctctgtgtccgtgtccccaggacagacagtcacaatctcatgctctggagatgcagttagggggaaaatttgctttctggtatcagcagaagccaggccacgtcccctgtcttggcatctataaggataggcaggccgccctgagggtattccgngagcgtattcgtccggcctaccaaccgtccggacaacacacgccactctcgaccatcgacggccgggacccaggcctcgtcgatcggacgtctagactattacgcgaccgagggtcgtgggaaccncgcctaccgtacctttcccgttatcggttcgttcggggcggttcgggaaccctggttccggtacctacccggttcgtacgggtaccaccgtacccgaaacgaccccaaccccgttacgtcgtaccc

SEQ ID NO: 156172 - DNA, 726 bp, Homo sapiens
  misc_feature: GYAE6OF02G5IG4.12.87.H10.1.454.CMB.1.raw
  modified_base (266)..(266): a, c, t, g, unknown or other
  misc_feature (266)..(266): n is a, c, g, or t
  modified_base (302)..(302): a, c, t, g, unknown or other
  misc_feature (302)..(302): n is a, c, g, or t
tcagatacgacgtacacgaccggtgctcgatttagcagtactgcgttgggtttggggcgtgggcctcaggaagcagcatcggaggtgcctcagccatggcatggatccctctcttcctcggcgtccttgcttactgcacaggttccgtggcctcgtatgacctgactcagccaccctctgtgtccgtgtccccaggaccagacagtcacaatctcatgctctggagatgcagttgggggaaaagtttggcttttcgtggtatcagnaagaagccaggccagtcccctgtcttggtcatctanaaggatagcaggcggcccttgacgggtattccgtgacgcgacttcgtccggccttcccgaaacgtcccggacaaacgaccacggaccctaacgtctacggaacccactccgaacggtaccgggaccgacggtcctccttggacctggaacggcttacggtacttaacgtttaccgttacgggacccgtaccggggtacgggtttaccgggaaaccgtgggtaccccgttacccctaacccggttttaccccgggtttaacgtttcggtttacccgtttccgggggttaaccggggttccggggtaacccctaaggttccgggttacccgtaacccggttccccggttaacggggtaccctaaccgggttacccccaaaacggtaccccccggtaaaacccgtacccgttaccgttaacccccgg

SEQ ID NO: 156173 - DNA, 549 bp, Homo sapiens
  misc_feature: GYAE6OF02GLYSV.12.87.H10.1.454.CMB.1.raw
tcagatacgacgtacacgaccggtgctcgatttagcagtactgcgttgggtttggggctgggcctcaggaagcagcatcggaggtgcctcagccatggcatggatccctctcttcctcggcgtccttgcttactgcacaggttccgtggcctcgtatgacctgactcagccaccctctgtgtccgtgtccccaggacagacagtcacaatctcatgctctggagatgcagttgggggaaaagtttgctttctggtatcagcagaagccaggccagtcccctgtcttggtcatctataaggatagcaggcgccctgagggtattccgtgacgcgagttcctccggcctccgactcgtacgggaacacgagtcactctgaccagtcacgccgggacccaggctagtgatgacggcttgtctacgtactgcaggcgtggacagcgagcggtggtggtcgggcggacggacgtagtcgtcggtaccgttacgttagggccgacggcccgaacgggtcctcccggtacccccgttcggtcctacccgttcccgg

SEQ ID NO: 156174 - DNA, 676 bp, Homo sapiens
  misc_feature: GYAE6OF02F9HVH.12.87.H10.1.454.CMB.1.raw
  modified_base (468)..(468): a, c, t, g, unknown or other
  misc_feature (468)..(468): n is a, c, g, or t
tcagatacgacgtacacgaccggtgctcgatttagcagtactgcgttgggtttgggggctgggcctcaggaagcagcatcggaggtgcctcagccatggcatggatccctctcttcctcggcgtccttgcttactgcacaggttccgtggcctcgtatgacctgactcagccaccctctgtgtccgtgtccccaggacagacagtcacaatctcatgctctggagatgacagttaggggggtaaaagtttgtctttcgtggtatcgagcagaacgccgacggccacgtcccctgtccttggtctatctagtaaggatagcgaggccggccctcgagggtacttccgtgacgcgtattccgtccggcctaccacgtccggacaacacacgacccactctacgacctatccgacggcgggaccccgaggcctcgtacggatcggacggtctacgtaacttacgttaaccncggacccggtaagggccggttggggaacctacggtccttacccgtaacccgttttcccggttaattcgggtttaccgttaccggggtagggggttaccgggaaccctacgggttccgggtacccgtaccgggttcccgttaacgggttaccgacccggaaccccgtaaacccggtacccccaaacccccggtagtcccgttaaccccg

SEQ ID NO: 156175 - DNA, 574 bp, Homo sapiens
  misc_feature: GYAE6OF02FNMKX.12.87.H10.1.454.CMB.1.raw
  modified_base (325)..(325): a, c, t, g, unknown or other
  misc_feature (325)..(325): n is a, c, g, or t
  modified_base (431)..(431): a, c, t, g, unknown or other
  misc_feature (431)..(431): n is a, c, g, or t
tcagatacgacgtacacgaccggtgctcgatttagcagtactgcgttgggtttgggggctgggcctcaggaagcagcatcggaggtgcctcagccatggcatggatccctctcttcctcggcgtccttgcttactgcacaggttccgtggcctcgtatgacctgactcagccaccctctgtgtccgtgtccccaggacagacagtcacaatctcatgctctggagatgcagttagggggaaaagtttgctttctggtatcagcagagcagccagtccctgtcttggtcatctagtaagatagcaggcgccctgagggtacttccngagcgtattccgtccggcctccaacgtccggacaacgaccacgcccactctacgaccactcacggccgggacccaggcctcgtcgatcgaggtctagacttatacncgaccgaggcgtggacacgccttacccgaccgtttacccgttattcgttccgttcgggtacggtcgggacctcggttcggtacccgtaccggtccgtacgggttcaccggcccgaaaccgaccccaaccccgtactcgtaccc

SEQ ID NO: 156176 - DNA, 349 bp, Homo sapiens
  misc_feature: GYAE6OF02GRY46.12.87.H10.1.454.CMB.1.raw
  modified_base (307)..(307): a, c, t, g, unknown or other
  misc_feature (307)..(307): n is a, c, g, or t
  modified_base (309)..(349): a, c, t, g, unknown or other
  misc_feature (309)..(349): n is a, c, g, or t
tcagatacgacgtacacgaccggtgctcgatttagcagtactgcgttgggttttggggggtagttcctgagcgattctccggctccgaactccggcaaacacagccactctgacccatcagcgggtacccaggctctcgatgaggctgactattactgccaggcgtgggacagctccacttcccgttatgtcttcggaggtgggaccatggtcaccgtcctagggtcagccccaagaccaaccccactgtcactctcgttcccgccctctctacgtcgtatctgagcgggctggcaaggcgcatagnannnnnnnnnnnnnnnnnnnnnnnnnnnnnnnnnnnnnnnnn

SEQ ID NO: 156177 - DNA, 651 bp, Homo sapiens
  misc_feature: GYAE6OF02GTSQ5.12.87.H10.1.454.CMB.1.raw
tcagatacgacgtacacgaccggtgctcgatttagcagtactgcgttgggtttggggctgggcctcaggaagcagcatcggaggtgcctcagccatggcatggatccctctcttcctcggcgtccttgcttactgcacagaatccatggcctcctatgagttgactcagccaccctccatgtccgtcgtcccccggacagacagccagcatcacctgctctggagatgtattgactaatgagtatgcttcctggtatcagcagaaggcaggcccacgccccctgtccctactcattctttacaaaatccacggccgccctcgacggggtccctggaccgtattcctcgtcggccttccgaagttccgtcggcctaccgtccacgtcccctcccgtcggcccagtccgacggtcgggtccctccgagttccgtggaggtagtggacggtcttagtatttaacgttacgtggtcgctagttccgtagtcgggccttcgaaccctaccccgttggtacccgggttcggggttacccggggtacggtttcggggttcccggggaccggggtaaccgggggtaacccgtaacgggtccggtaccgggttaacccgggttcccgtaacggggtacccaccgggacccccgtaacggg

SEQ ID NO: 156178 - DNA, 613 bp, Homo sapiens
  misc_feature: GYAE6OF02H6C43.12.87.H10.1.454.CMB.1.raw
  modified_base (225)..(225): a, c, t, g, unknown or other
  misc_feature (225)..(225): n is a, c, g, or t
  modified_base (381)..(381): a, c, t, g, unknown or other
  misc_feature (381)..(381): n is a, c, g, or t
  modified_base (521)..(521): a, c, t, g, unknown or other
  misc_feature (521)..(521): n is a, c, g, or t
tcagatacgacgtacacgaccggtgctcgatttagcagtactgcgttgggtttggggctgggcctcaggaagcagcatcggaggtgcctcagccatggcatggatccctctcttcctcggcgtccttgcttactgcacaggttccgtggcctcgtatgacctgactcagccaccctctgtgtccgtgtccccaggacagacagtcacaatctcatgctcgtgganatgcagttagggggaaactttgtctttcgtggtatcagcagaacgcaggccagtcccctgtcttggtcatctaataaggataggcaggccggccctcgagggtcttccgtgacgcgacttctccggctcccaacgtccggacaacacacgcctacnctcgaccactcgacggaccgggaccacggcctcgtacgagtgacggtctacgtacttacttaactcggaccgtagggtcggttagggaaccgtcgcccttaccgtaccgtttacccgttagttccgttacgttacggggngggttacggaccgtacggttcggtcccgtaccggttcccgtacggtccgaacgaccccgtaaacggaccccaaccccgtccttacggtaccc

SEQ ID NO: 156179 - DNA, 620 bp, Homo sapiens
  misc_feature: GYAE6OF02JECEH.12.87.H10.1.454.CMB.1.raw
  modified_base (212)..(212): a, c, t, g, unknown or other
  misc_feature (212)..(212): n is a, c, g, or t
  modified_base (455)..(455): a, c, t, g, unknown or other
  misc_feature (455)..(455): n is a, c, g, or t
  modified_base (561)..(561): a, c, t, g, unknown or other
  misc_feature (561)..(561): n is a, c, g, or t
tcagatacgacgtacacgaccggtgctcgatttagcagtactgcgttgggtttggggctgggcctcaggaagcagcatcggaggtgcctcagccatggcatggatccctctcttcctcggcgtccttgcttactgcacaggttccgtggcctcgtatgacctgactcagccaccctctgtgtccgtgtccccaggacagacagtcacaatcncatgctctggagatgcattagggggaaaatttgctttctggtatcgagtcagaagccgaggcctagtcccctgttcttggtcattctaagtaaggatagcagggccggcccctgagggtactttccgaggagcgtattccgtcccgggcttacccaaaccgttcccgggacaaaccgacaacggtcccaacgttcctacgaaccctagtaccacgggcccgggaaccccaagggtccttaccncggtaactggacggccgttgaaccgtttacttacgcgtacccgagggtccgtagggaccacggtcctccgtaaccttcccggttatcggtcgtcggaggtcggacngttcggactaccgtcgtacgtaccgagtaccccaagaccccgtaacccacgttctcccg

SEQ ID NO: 156180 - DNA, 695 bp, Homo sapiens
  misc_feature: GYAE6OF02HKWHE.12.87.H10.1.454.CMB.1.raw
  modified_base (224)..(224): a, c, t, g, unknown or other
  misc_feature (224)..(224): n is a, c, g, or t
tcagatacgacgtacacgaccggtgctcgatttagcagtactgcgttgggtttggggctgggcctcaggaagcagcatcggaggtgcctcagccatggcatggatccctctcttcctcggcgtccttgcttactgcacaggttccgtggcctcgtatgacctgactcagccaccctctgtgtccgtgtccccaggacagacagtcacaatctcatgctctgganatgcagttgggggaaaatttgctttctggtatcagcagagccagccagtccctgtcttggtcatctataagatagcaggcgcctcagggtacttccgtgagcgtaacttccgtccgggtcctacccaaccgtcccggaccaaaccaccgacgaccctaccgtctcggaacccagtaccgaaggtacccgggaaccccaaggggtccttcgtaccgaacttcggaacggtccgttacggaactttaacgtttaccgtacgtacccgaacgggtcggtacggggacccaacggtccgttaacccgtaccgttttacccgtttaacgttcggtttaccgtttacggggacgggttacgggtacccgtacggtttcgggtacccgtaacccggttcccgttaacgggtaccctaaccgggtacccccgaaaacggtaaccccccgtaaacccccgtaccgttaccgttaaccccg

SEQ ID NO: 156181 - DNA, 620 bp, Homo sapiens
  misc_feature: GYAE6OF02JCSPJ.12.87.H10.1.454.CMB.1.raw
  modified_base (361)..(361): a, c, t, g, unknown or other
  misc_feature (361)..(361): n is a, c, g, or t
tcagatacgacgtacacgaccggtgctcgatttagcagtactgcgttgggtttgggctgggcctcaggaagcagcatcggaggtgcctcagccatggcatggatccctctcttcctcggcgtccttgcttactgcacagaatccatggcctcctatgagttgactcagccaccctccatgtccgtgtcccccggacagacagccagcatcacctgctctggagatcgtattgactaatgagtatgtcttcctggtatcagcagagcaggccacgccctgtcctactcatcttacaaactccgacggccggcctcgtcgggtcctggacgcgtacttctctgctccgactcgtacgggaacnccgtacgtccactcgtacgaccctatcgacggtcccgggaacccgtaggtaccttaagttcggagttaggtacggtacgttacgtaccgttaacttaccggtcggttacgagggtccggtacgggaccgacggtacgcggtaccggttcggttacggttccgggacgggtacggacccgtaggtccgttacggtaccgttaccgttacggtacgaccggtacccggtacggtccgtacccgtcccccgtcggttacccg

SEQ ID NO: 156182 - DNA, 701 bp, Homo sapiens
  misc_feature: GYAE6OF02IE82F.12.87.H10.1.454.CMB.1.raw
  modified_base (227)..(227): a, c, t, g, unknown or other
  misc_feature (227)..(227): n is a, c, g, or t
  modified_base (308)..(308): a, c, t, g, unknown or other
  misc_feature (308)..(308): n is a, c, g, or t
  modified_base (407)..(407): a, c, t, g, unknown or other
  misc_feature (407)..(407): n is a, c, g, or t
tcagatacgacgtacacgaccggtgctcgatttagcagtactgcgttgggtttggggctgggcctcaggaagcagcatcggaggtgcctcagccatggcatggatccctctcttcctcggcgtccttgcttactgcacagaatccatggcctcctatgagttgactcagcccaccctccatgtccgtcgtcccccggacagacacgccagcatcacctgctctgganatgtattgactaatgagtatgtcttctggtactcagcgaaggaacggcgacggtcccaccggccccccttgtcccttaccnctacttccttaacaaaaactccgacggcccggtaccctcggtacggggtcccctggaacgcgtactctcgtcggtctcccgacttcgacgggtaaaccncgtacgtacctacctacgttaccgaactaccttaccggaaccggacccgggaacccgtacgggtacttacgttagaacgtacggtacggtccttacgttaccgttacgttaaccgtcggtacgtacgggtacggtacgggacgaccggtacgtacgggtccggttgggtacgggttaccggggacgggtaccgggacccgttacggtccgttacggtacccggtttacggttaacgggtccgtaacccggtacccgacggtaccccggtcccggtaccccgtccggttaccccg

SEQ ID NO: 156183 - DNA, 729 bp, Homo sapiens
  misc_feature: GYAE6OF02FGYNQ.12.87.H10.1.454.CMB.1.raw
  modified_base (339)..(339): a, c, t, g, unknown or other
  misc_feature (339)..(339): n is a, c, g, or t
tcagatacgacgtacacgaccggtgctcgatttagcagtactgcgttgggtttggggctgggcctcaggaagcagcatcggaggtgcctcagccatggcatggatccctctcttcctcggcgtccttgcttactgcacaggttccgtggcctcgtatgacctgactcagccaccctctgtgtccgtgtccccaggacagacagtcacaatctcatgctctggagatgctagttagggggtaaaagtttgctttcgtggtatcagcagaagccaggcctacgtcccctgtcttggtcatcgtaataagatagcgacggccgccctgacgggtacttccgnggtacgcgtacttccgtcccgggaccttacccgaaaccgtcccgggaccaaaacccgaccgaacggtcccaaaccgttcccgtacgaaccctaatacccgaaccgggcccggggaaccccgtacgggtaccttccggtaccggtaacgtcgggaacggtccttacggtaacctttacgttaccgtcggacccgtacggggtccggtacgggaaccgtaccggtacccgttacccgttacccgttttaccccgtttaagtttccggttccggttacgggtaacgggttccgggaacctaggttccggtacccgtacccggttcccgttaacggtacccgtaccgaaccccgtaaaccgacccctaaaccccgtacgttacccgttaacccg

SEQ ID NO: 156184 - DNA, 637 bp, Homo sapiens
  misc_feature: GYAE6OF02F9XDL.12.87.H10.1.454.CMB.1.raw
  modified_base (224)..(224): a, c, t, g, unknown or other
  misc_feature (224)..(224): n is a, c, g, or t
tcagatacgacgtacacgaccggtgctcgatttagcagtactgcgttgggtttggggctgggcctcaggaagcagcatcggaggtgcctcagccatggcatggatccctctcttcctcggcgtccttgcttactgcacaggttccgtggcctcgtatgacctgactcagccaccctctgtgtccgtgtccccaggacagacagtcacaatctcatgctctgganatgctagttagggggaaaagtttcgctttcgtggtatcagtcagaacgccgaggccacgtcccctgtccgttggtctagtctaagtaggactagcgaggccgccctcgtaggtacttcgtagcgcgtattccgtccgctaccgacgtccggactaacgcgacgcctacctcgtcgacctacgtaccgacggcccgggacccgcgggcctccgtacgacgtcggacgtcgttacgtacttaacgttcctacgccggtagggtcgtacgggactacgtcccgtacccgttaccgtttcccgtttatcggtaccggtttacgggacggttcgggtacctaggttccggtaaccgacccgttccggtaacgtaccgacgtacccgaaaccgtaccccctaaccgtcctaccggtccg

SEQ ID NO: 156185 - DNA, 306 bp, Homo sapiens
  misc_feature: GYAE6OF02I7S7X.12.87.H10.1.454.CMB.1.raw
  modified_base (290)..(290): a, c, t, g, unknown or other
  misc_feature (290)..(290): n is a, c, g, or t
  modified_base (296)..(306): a, c, t, g, unknown or other
  misc_feature (296)..(306): n is a, c, g, or t
tcagatacgacgtacacgaccggtgctcgatttagcagtactgcgttgggtttggggggattcctgagcgattctccggctccaactccggcaacacagccactctgaccatcagcgggacccaggctctcgatgaggctgactattactgccaggcgtgggacagctccacttcccgttatgtcttcggaggtgggaccatggtcaccgtcctaggtcagcccaagaccaaccccatgtcactctgttcccgccctctctacgtcgtatctgagcgggctggcaaggcncatagnnnnnnnnnnn

SEQ ID NO: 156186 - DNA, 653 bp, Homo sapiens
  misc_feature: GYAE6OF02IDKJU.12.87.H10.1.454.CMB.1.raw
  modified_base (424)..(424): a, c, t, g, unknown or other
  misc_feature (424)..(424): n is a, c, g, or t
tcagatacgacgtacacgaccggtgctcgatttagcagtactgcgttgggtttggggctgggcctcaggaagcagcatcggaggtgcctcagccatggcatggatccctctcttcctcggcgtccttgcttactgcacaggttccgtggcctcgtatgacctgactcagccaccctctgtgtccgtgtccccaggacagacagtcacaatctcatgctctggagatgcagttagggggtaaaagtttgtactttcgtggtatcagcagaacgccaggccacgtccctgtctggtcatatataaggatagcgacggccggtccctacgagggtacttccgtagacggcgtacgttccgtccggacctacccgaacgtccgacaacacacgccactctacgaccatccgaacggccgggtaacccngggtaccttcgacgtaacgtggacgtctacgtaacttacgtactcgacgtacgggcgtaccgggaactacgtcccttaccgttacctttacccgtttaagtccggtttaccgttacggggaggttccgggaaccgtacggttcgggttacccctacccggttaccgtacggtacccgaaccgtaaccccgaaacccgtaaccccgaaccccttacgtacggttaacccc

SEQ ID NO: 156187 - DNA, 667 bp, Homo sapiens
  misc_feature: GYAE6OF02F7WMB.12.87.H10.1.454.CMB.1.raw
tcagatacgacgtacacgaccggtgctcgatttagcagtactgcgttgggtttgggggctgggcctcaggaagcagcatcggaggtgcctcagccatggcatggatccctctcttcctcggcgtccttgcttactgcacaggttccgtggcctcgtatgacctgactcacgccaccctctgtgtccgtgtccccaggacagacagtcacaatctcatgctcgtggagatgctagttagggggtaaaatttgtctttcgtggttatctagcaaggaacgccgaggaccacgtcccctgttccgttggtacatctaagtaaggataggcgacggccgacccgtcgagggtacttccgtagacgctacgttccgtccgtcctaccaaccgtccggacaacacgacgccctactccacgaccataccgacggtaccgggaacccagggtcctacgtacgacgtcggaacggtcttaacgtactttacttaccgtacgacccgtagggtaccgggttagggaacctaccggtacccttacccgttaaccctttacccgtttaagttccgttaccggttacgggacggggttacggaacgtcgtacgggttacccgtaccggtcgtaccggtacaccgaccgaaacccgacccaacccctagtcccgtaaccg

SEQ ID NO: 156188 - DNA, 639 bp, Homo sapiens
  misc_feature: GYAE6OF02FG5PB.12.87.H10.1.454.CMB.1.raw
tcagatacgacgtacacgaccggtgctcgatttagcagtactgcgttgggtttggggctgggcctcaggaagcagcatcggaggtgcctcagccatggcatggatccctctcttcctcggcgtccttgcttactgcacaggttccgtggcctcgtatgacctgactcagccaccctctgtgtccgtgtccccaggacagacagtcacaatctcatgctctggagatgcgtagttagggggtaaaagtttgtctttcgtggtatcgagacagaacgccacggccacgtcccctgtcttggtcatactagtaagatagcgacggcggccctacgaggtacttctacggtagcgtacttccgtccgcctaccgaaccgtcccggactaaccaaccgacgaccctactccacgacccacgtcgacggcccggaccccgaacggtctaccgtacgacgtcggacgtccgttagaccttagttacgtcgccgtagggcggttacggacctacgcccttaccgtaaccgtttcccgttatccggtttcgttacgggacgggttccggacgtacggtcgtacccgtacccggttaccgtacggtccgtacgaccccgaacgtacccccaaccctacgtactaacccg

SEQ ID NO: 156189 - DNA, 724 bp, Homo sapiens
  misc_feature: GYAE6OF02FZFV2.12.87.H10.1.454.CMB.1.raw
  modified_base (226)..(226): a, c, t, g, unknown or other
  misc_feature (226)..(226): n is a, c, g, or t
tcagatacgacgtacacgaccggtgctcgatttagcagtactgcgttgggtttggggctgggcctcaggaagcagcatcggaggtgcctcagccatggcatggatccctctcttcctcggcgtccttgcttactgcacaggttccgtggcctcgtatgacctgactcagccaccctctgtcgtccgtcgtccccaggacagacagtcacaatctcatgctctgganatgctaggttacgggggtaaatttcgtctttcgtaggtactcagcagacgcacggccacgtccctgtcttgtcctatactaagtaacgtatacgacgacggccgtccctacggtacggtacttccgtaggacgtcgtacgttccgtccggtactacccgtaaccgtccggaaccaaccaccgaccgtaccctaccgtccgacgaccctagacccgacgggtccgaccctaggtccctacggtacgagttcgggacgttacctagttaaccttacgttaccgccggtaccggtacgggtacggttaccgggaacctccggtaccctttacccggtacccgttttacggttaacgtcccggtttacggtacggggacggggtaccgtaaccgtacgggtttcccggaacccgttccccgggttaacgttaccggtcccgaaaccccgggtaccccttaaaacccggaccccccttaaccggtaccgttccgttaaccccg

SEQ ID NO: 156190 - DNA, 821 bp, Homo sapiens
  misc_feature: GYAE6OF02HL28N.12.87.H10.1.454.CMB.1.raw
tcagatacgacgtacacgaccggtgctcgatttagcagtactgcgttgggtttggggctgggcctcaggaagcagcatcggaggtgcctcagccatggcatggatccctctcttcctcggcgtccttgcttactgcacaggttccgtggcctcgtatgacctgactcagccaccctctgtgtccgtcgtccccaggacagacagtcacaatctcatgctcgtggagtactgacgtagtttagggggggtaaaacgttttggtacttttcgtgggttaatcgaacggtcaaggtaacggcccgagggccccgtacggttcccccgttacggttccgtttcgggttacctaacgttaccgttaaggtaaacggggtacttaaccggtaccggacggggccccgggtaccccttcgggaacggggtaacctttccggtacggaggtacccggtacgttttccggtcccggtaccttacccgaacccgttacccgggaccaaaccgaaccgaaccggtcccgacccttaccgtaccggaaccctacgtacccgaacggggccccggggaaacccgacggggtccctaccgtacggacgttcggacggtcgttacggtaacttacttaccgcgaccgaggccgggttacgggacctacggtccttacccgttacccgtttaccgttacgttacgttaccggttcggggacggtcgggtaacccgtcggttaccggggtacccttacccgggttacccggttaggacccgttaccggaccccggtaaacccgtaacccccgtaaccccttacggttaccgtaccccg

SEQ ID NO: 156191 - DNA, 865 bp, Homo sapiens
  misc_feature: GYAE6OF02JJR7Y.12.87.H10.1.454.CMB.1.raw
  modified_base (224)..(224): a, c, t, g, unknown or other
  misc_feature (224)..(224): n is a, c, g, or t
tcagatacgacgtacacgaccggtgctcgatttagcagtactgcgttgggtttggggctgggcctcaggaagcagcatcggaggtgcctcagccatggcatggatccctctcttcctcggcgtccttgcttactgcacaggttccgtggcctcgtatgacctgactcagccaccctctgtgtccgtcgtcccaggacagacagtcacaatctcatgctctgganatgcaggttaggggtaaatttgtactttcgtaggtactcgagactaaggaacgccgacggtaccctaccggtccccttaggttccgtttacggtactacttaccgttaaggtaaagggtactaacggtaccggtaccggggtcccggtacccgttaccgggaacggggttaccttcccgtagggacggtaccggttaacgttcccggtccggtaccctacccgtaaccgttaccggaacctaaccgaaccgtaccgaccctaccttaccgtaccgaacccgtacgacccgggtaaccgggaccccgggtaacccgtacggttcccgtaccgtaacgggtaacggttaccgggacggttaccgttaccgttaaccgttttaacgtaacccggtcggtaacccggacgggggtacggttaacccggggtaaccaccgggtttaccccgtacccgttaacccgttttacccgggttaagggttcccgtttaccggggttaacggggaccgggttaccggtacccggtagttaaccccggggttaacctacccggggttaacccggttaacggacccggtaaccccggtaacccggaaacccccgttaaacccggtaccccgttaccgtttcccggtaaccccgg

SEQ ID NO: 156192 - DNA, 648 bp, Homo sapiens
  misc_feature: GYAE6OF02HD6BR.12.87.H10.1.454.CMB.1.raw
tcagatacgacgtacacgaccggtgctcgatttagcagtactgcgttgggtttgggggctgggcctcaggaagcagcatcggaggtgcctcagccatggcatggatccctctcttcctcggcgtccttgcttactgcacaggttccgtggcctcgtatgacctgactcagccaccctctgtgtccgtgtccccaggacagacagtcacaatctcatgctctggagatgcgaggttagggggaaagtttgctttcgtggttatcgagcaagaacgccgaggccacgtcccctgttccgttggtcatctaataaggatagcgacggccgccctacgacggtacttccgtggacgtccgtagttcccgtccggcctaccgaaccgtccggacaaccgacgacgccctactccgtacgaccatccgacggtaccgggaaccctagggcctcgtacgtagtcggacggtcgtagtaccttagttaccgcggtaccgacgggtccgtaaggggaccacggtccctaccgttaccgtttacccgttagtccggttacgttcgggacggttcggaactacggttcggtaccctaccgggttcccgtaggtaccaccggacccgtaaaccgaacccccaacccgtcgttacgtaccc

SEQ ID NO: 156193 - DNA, 752 bp, Homo sapiens
  misc_feature: GYAE6OF02F6317.12.87.H10.1.454.CMB.1.raw
tcagatacgacgtacacgaccggtgctcgatttagcagtactgcgttgggtttggggctgggcctcaggaagcagcatcggaggtgcctcagccatggcatggatccctctcttcctcggcgtccttgcttactgcacaggttccgtggcctcgtatgacctgactcagccaccctctgtgtccgtgtccccaggacagacagtcacaatctcatgctctggagatgcgtaggttagggggtaaaagtttgtactttcgtggtatcagacaagacgccgacggaccctacggttcccccgtaggttccttcgggtactagtacttaagtaaggtactacggtacgacgggcccggtaccccgtacggtagggtaccgtttccgtaggacggtaccgttacgttccgtcccggtcctacccgtaacccgtccggaccaaaccgaaccgacgaccctaccgttaccgtacgtaaccctagttaacccgacgggaccccgggaaccccggtacggtaccctaccggtaccggagtaccgggacgtcggttacgtaaccgttacgttaccgtcgaccggtacgggtcggtacggacgtaccgtaccctcccgttaccgtttccgttaattccggttacggttcggggacggttacgggtacctacgggtccggttaccgttaacccggttccggtacggtaccgtacccggacccgtaaacccgtaccccgaaccccgttacgtccgttaaccccg

SEQ ID NO: 156194 - DNA, 617 bp, Homo sapiens
  misc_feature: GYAE6OF02HC1JD.12.87.H10.1.454.CMB.1.raw
  modified_base (307)..(307): a, c, t, g, unknown or other
  misc_feature (307)..(307): n is a, c, g, or t
  modified_base (402)..(402): a, c, t, g, unknown or other
  misc_feature (402)..(402): n is a, c, g, or t
tcagatacgacgtacacgaccggtgctcgatttagcagtactgcgttgggtttggggctgggcctcaggaagcagcatcggaggtgcctcagccatggcatggatccctctcttcctcggcgtccttgcttactgcacaggttccgtggcctcgtatgacctgactcagccaccctctgtgtccgtgtccccaggacagacagtcacaatctcatgctctggagatgcgtaggttagggggtaaagtttgtctttcgtggtatcaggcaagacgccacggccacgtccctgtcttggtcatcgtaanaaggatagcgacggccgtccctagaggtacttccgtgagcgtacgttccgtccgtcctaccaccgtccggaccacaccacgccacgtcacgaccntccgacgggcccggacccaggtaccctgtaccggagtacggaggtaccttaggtaccttattccggcgacccggtagggccggtacgggacctcgtaccgtccctttacgttcccgttagtccgttacggttacgggacgggtaccgcgtaggttccggccgttaccggtccgtacggtccacgacccgaacgtacccccgaacctgtccgtacc

SEQ ID NO: 156195 - DNA, 749 bp, Homo sapiens
  misc_feature: GYAE6OF02FL4R0.12.87.H10.1.454.CMB.1.raw
  modified_base (229)..(229): a, c, t, g, unknown or other
  misc_feature (229)..(229): n is a, c, g, or t
tcagatacgacgtacacgaccggtgctcgatttagcagtactgcgttgggtttggggctgggcctcaggaagcagcatcggaggtgcctcagccatggcatggatccctctcttcctcggcgtccttgcttactgcacaggttccgtggcctcgtatgacctgactcagccaccctctgtgtccgtcgtccccagacagacagtcaacaacgtctcatcgctcgtgganatgcgaggttagggggtaaaagtttcgtctttccgtggtactcgacgacgaagaacgaccgacgccgacgttccccgttgttccgttcggtactacgttaccgtaaggtaaaggtacgtacggtaccgacggtcccggtaccgtacggaacgggtcgttaccgtggacggtacgtacttccggtacccgtccgtacccgtaaccgtccggaccaaccgacgaccgtacctaccgtcgtacgaccgtacgtacgaccgggaccgggacccgtacgggtctaccgtcgtagtaacggcggtaccgttacgtaacgtttaactccggtaccggtcccggtaggggttacggtacggtaccgtaccgtcccgtacccggtttacctttcccggttagttcgggttccgttaccggggtacgggtccgtaacgttccggtccggtacccgttacccggttacccggtacggtacccgaccgtaccccggaaacccgtacccaacccccgtgtacccttaacccgg

SEQ ID NO: 156196 - DNA, 736 bp, Homo sapiens
  misc_feature: GYAE6OF02IEHQP.12.87.H10.1.454.CMB.1.raw
  modified_base (225)..(225): a, c, t, g, unknown or other
  misc_feature (225)..(225): n is a, c, g, or t
  modified_base (229)..(229): a, c, t, g, unknown or other
  misc_feature (229)..(229): n is a, c, g, or t
  modified_base (660)..(660): a, c, t, g, unknown or other
  misc_feature (660)..(660): n is a, c, g, or t
tcagatacgacgtacacgaccggtgctcgatttagcagtactgcgttgggtttggggctggcctcaggaagcagcatcggaggtgcctcagccatggcatggatccctctcttcctcggcgttccttgcttactgcacacggttccgtggcctcgtatcgacctgactcacgcctaccctctgtcgtccgtcgtcccgaggacagacagtcacatctcatgctgngagntgcgtaggttaggggtaaactttgtctttcgtggtactcgtacgactaacggacgccgacggacctccggttcccgttgttcgttacggtacctacgttacttaaggtaacggtactacggcgacgggtccgaccgtacggaacggttactccgtagtacgtccgtacgttccgccggtaccttaccgtaccgtaccggaacctaacgaccgtaccgtacctacctcgtaccgtaacctacgtcggaaccgggacccggaacccggtacggtaccgttacgtacgtcgtacggtacggtccgttacgtacgttacgttaccgcggtacgtcgggtacgggtcggaacctcgtaccctccgtaccgtttccggttgttacggtccgggtttacgggcgggtttacggaacccgttacggccgggttaacccnccgggttacccgtaacggtcccggtaaccggaccccgtaacccgtaaccccgtacccgtccgttacccgttacccg

SEQ ID NO: 156197 - DNA, 862 bp, Homo sapiens
  misc_feature: GYAE6OF02FRAVX.12.87.H10.1.454.CMB.1.raw
  modified_base (227)..(227): a, c, t, g, unknown or other
  misc_feature (227)..(227): n is a, c, g, or t
tcagatacgacgtacacgaccggtgctcgatttagcagtactgcgttgggtttggggctgggcctcaggaagcagcatcggaggtgcctcagccatggcatggatccctctcttcctcggcgtccttgcttactgcacaggttccgtggcctcgtatgacctgactcacgccaccctctgtcgtccgtcgtccccaggacagacagtcacaatctcatgctctgganatcgcgtaggttagggggtaaagttgtctttcgtggtatcgagacgaacgaacgccgacggaccctacgttcccccgttacgttcgtttacggtctaacgttcgttaagttaaggtacgtacgaccgaacggggcccggtacccgttaccggaaggggttacctttaccgtcggaacgttccgttaacgtttccgtaccccgggtacccttaaccccgtaacccgtccccggtaaacaaaccctaaccgaccgtacccctaaccttaccgtaccgaaccctaccgttaccgaacccgggacccggggtaaccccgacgggtacccgttaccgtccggtaacgttcggaccgggttacgttaccggtaaacctttacgtttaccggccggtacccggtaacggggtccggggttacgggaaccgtaccgttacccgttacccgttacccggttttacccggtttaccgtttaccgggtttacccggttaccgggggtaccgggtttaccggggaaccgtttaccgggttaccgggttacccgtacccgggtttaaccgttaccgggtacccgtaaccccggaccccggtaaacccggtaacccccgtaaaccccgttccgtacccggttaaccccc

SEQ ID NO: 156198 - DNA, 805 bp, Homo sapiens
  misc_feature: GYAE6OF02FZHAJ.12.87.H10.1.454.CMB.1.raw
tcagatacgacgtacacgaccggtgctcgatttagcagtactgcgttgggtttggggctgggcctcaggaagcagcatcggaggtgcctcagccatggcatggatccctctcttcctcggcgtccttgcttactgcacaggttccgtggcctcgtatgacctgactcacgccaccctctgtcgtccgtcgtccccaggacagacagtcacaatctcatcgctcgtggagatcgacgtaggttaggggggtaaaagtttggtccttttcgtggttaacttcgaagacgaacggaacgtacccgaacggcccgtaaccgttacccccgttggttccgttttacgggttacctaacgttacgttaaacgttaaaagggtaacgttaacggaccggttaacggggccccgggtaccccgtttacggaacggggttacctttacccggtacggacggtaccgttaactttcccggtcccggtaccctacccggaaccgttacccggaccaaacgtaccaaccgacccctacttacccgtaacgacccgtaacgtaccggacggtaccccggggaaccccgtaggtacccgtccgtacgacggtacggacggtcgttaacgtaccgttacgttaccgcgaccggtacgggtcgggtacgggacgccgtaccctacccgttaccgtttccgttaacgttcggttacggtaccgggtacgggttccggaacgtcggttccggtacccgtaccgtaccggttacgtaccgtaacccggaacctaacccgtaacccacctaccgttacgtacccg

SEQ ID NO: 156199 - DNA, 761 bp, Homo sapiens
  misc_feature: GYAE6OF02II7OM.12.87.H10.1.454.CMB.1.raw
tcagatacgacgtacacgaccggtgctcgatttagcagtactgcgttgggtttggggctgggcctcaggaagcagcatcggaggtgcctcagccatggcatggatcctctcttcctcggcgtccttgcttactgcactaggttccgtggcctcgtatgacctgactcagccaccctctgtcgtccgtgtccccaggacagacagtcacaactctacagtcgctcgtggacgagtacgctaaggttagggggtaaaacgttttgcgttttacgtaggttacgtaccgtagacgaagaaacgtccagggtaccctaaccgtcccgttcggttaccgtttggtaccacgttacgtaaggtaaacggtaacgttacgcgtaacgggtccgtacccgtacggtaacgggtaccttaccgtacggtacggaccgtacgttccgttaccccgggtacttaaccctaaccgtccggaacaaccgtaacgaccgaccgtactaccgtcgacaacgttcgacggaccggtacccgacgtactccgtacgtagtacgaggtcaaccgtacgtacttaccgcgtaccggcggtacggtacggtaccgaccgtacgttaccctaaccgtttacccgttagtcggttacccggtttcgggaacgggttccgggtactacggttccgggtaacccgtacggtttacccggtaacggtccgttaaccccggaacccggttaacccgaaccccgtaaacccgtggttaccccgtaccg

SEQ ID NO: 156200 - DNA, 636 bp, Homo sapiens
  misc_feature: GYAE6OF02GQ9YJ.12.87.H10.1.454.CMB.1.raw
tcagatacgacgtacacgaccggtgctcgatttagcagtactgcgttgggtttggggctgggcctcaggaagcagcatcggaggtgcctcagccatggcatggatccctctcttcctcggcgtccttgcttactgcacaggttccgtggcctcgtatgacctgactcagccaccctctgtgtccgtgtccccaggacagacagtcacaatctcatgctctggagatgcagttagggggaaaatttgctttcgtggtatcagcaagaacgccgaggccacgtcccctgtcttggtcatcgtaataaggatacggcgacggccggccctacgagggtacttccgtggacgacgtacttccgtccggtccttaccgaaccgtccggacaaaccacgaacgcctactcgtacgacctatacgacggccgggaccaggtcctcgacgtagtaggacgtcgttacgtacttaacttaccgtcgccggagggcggtacgggactacgccttcccttaccgtttccgttagtcggttcgttacgggacgggttacggaccgtaggttccggtaccttacccggtacgttacggtaccaaccggtacccgaaaccgtaaccccaaccccgttagtaccggtaccc

SEQ ID NO: 156201 - DNA, 619 bp, Homo sapiens
  misc_feature: GYAE6OF02H1NQB.12.87.H10.1.454.CMB.1.raw
  modified_base (371)..(371): a, c, t, g, unknown or other
  misc_feature (371)..(371): n is a, c, g, or t
  modified_base (373)..(373): a, c, t, g, unknown or other
  misc_feature (373)..(373): n is a, c, g, or t
  modified_base (405)..(405): a, c, t, g, unknown or other
  misc_feature (405)..(405): n is a, c, g, or t
  modified_base (419)..(419): a, c, t, g, unknown or other
  misc_feature (419)..(419): n is a, c, g, or t
  modified_base (433)..(433): a, c, t, g, unknown or other
  misc_feature (433)..(433): n is a, c, g, or t
  modified_base (476)..(476): a, c, t, g, unknown or other
  misc_feature (476)..(476): n is a, c, g, or t
  modified_base (590)..(590): a, c, t, g, unknown or other
  misc_feature (590)..(590): n is a, c, g, or t
tcagatacgacgtacacgaccggtgctcgatttagcagtactgcgttgggtttggggctgggcctcaggaagcagcatcggaggtgcctcagccatggcatggatccctctcttcctcggcgtcttgcttactgcacaggttccgtggcctcgtatgacctgactcagccaccctctgtgtccgtcgtccccaggacacgacacgtacacaatctacatgcctgtaggatacgtgactaggttaaggggggtaaatttcgttcttttcgtggtactcaggcaagacgccgaggtcctaccgtccctgttcgtcgaccgtattactaagaacggagtacgcggacggtccggcctacggagggttactccgngngctacttcgccgactcctaacgccgacacacncacctctgacaccntcgacgccggaccnggtctcgtagcgcgacgcttacgtaccttagtacgtcgaccgnggtacggtcgccaccgttacctcccgtacgtttacctacggtcgttaccgttggggtaccggtagtccgtaacgttcggacccttcgggtaccgtacggtccaacccggtaccncccggtaaacccacccttcggtacgtccc

SEQ ID NO: 156202 - DNA, 793 bp, Homo sapiens
  misc_feature: GYAE6OF02GIBWN.12.87.H10.1.454.CMB.1.raw
  modified_base (612)..(612): a, c, t, g, unknown or other
  misc_feature (612)..(612): n is a, c, g, or t
tcagatacgacgtacacgaccggtgctcgatttagcagtactgcgttgggtttggggcgtgggcctcaggaagcagcatcggaggtgcctcagccatggcatggatcctctcttcctcggcgtccttgcttactgcacaggttccgtggcctcggtatcgtacctgactcacgcctaccctctcgtcgtccgtcgtcccgaggacagacacgtacacaacttcctcaacttgacctcgtggagattgaccgtaggttagggggaaaacttttggtacctttccggttaggttactaccgaggtaccgaaggtaaaccgccgaggacccgttaacggttcccccctttgggttaccttacgggttacccatttaccgttaaaacggtaacgtaacgttacgaaccggtcggtaacccgggtccttaccgggtacgggttaacgttccgacggttacggacgttaacgtcccgttacgggtacccttaccgaacccggttcccgggactaaaccgacgtacccggaacctaccggtacctacgaacccgtaccgtaaccgacggtaccccgggaccgtaacggccttccgaacgtaccgtaggacggtaccgtntaacctttaccgtacgtacggacccgtagggcccgttacggacgtacgtcccgacgtttaccgttccggttacttacggtccgttggacgggtacgtacccgtagttcccggaccgtaccggttacctacggacccgtacggacccttaaaccggacccacccgttacggacttaacccgg

SEQ ID NO: 156203 - DNA, 839 bp, Homo sapiens
  misc_feature: GYAE6OF02FKD2A.12.87.H10.1.454.CMB.1.raw
  modified_base (147)..(147): a, c, t, g, unknown or other
  misc_feature (147)..(147): n is a, c, g, or t
  modified_base (231)..(231): a, c, t, g, unknown or other
  misc_feature (231)..(231): n is a, c, g, or t
tcagatacgacgtacacgaccggtgctcgatttagcagtactgcgttgggtttggggctgggcctcaggaagcagcatcggaggtgcctcagccatggcatggatccctctcttcctcggcgtccttgcttactgcacaggttccgnggcctcgtatgacctgactcagccaccctctgtcgtccgtcgtccccaggacagacagtcacaactctcatgctcgtggacgangactaggttagggggtaaagtttggtcttttcgtggttactcgagtacgaacgaacgccgacggtcccgtaacgttccccccgttgttaccgtttcgggttacctaacgttaccttaaacgttaaaagggtaacttaacgggtcgtaacggggtaccccgggtacccccgttaggaaccgggggttacctttaccccggtagggtaaccggtacccgttaaacggttttcccggtaccccggggttacccttacccccgtaaaacccgttacccccggggtaaccgaaaccccgtaacgacccgtaacccctaccgttaccgttaccgaaccccgtacgtaccgaccgggtacccggggaccccgtaggtacccgtccgtacggtacgtaccgggtaggtacccttacgggtaaacctttacgttaccggtcgacccggtagggttccgggtaaggaccgtaacgtccttacccgtaccggttttcccttaggtacgttccggttaggggaccggttacggaaccgtcgggttccgtaccgttaacccgtcggttaaccggccgaccgaacccggtaccgaaccccggaacccctagtacgtaccccg

SEQ ID NO: 156204 - DNA, 666 bp, Homo sapiens
  misc_feature: GYAE6OF02FOQEJ.12.87.H10.1.454.CMB.1.raw
  modified_base (362)..(362): a, c, t, g, unknown or other
  misc_feature (362)..(362): n is a, c, g, or t
tcagatacgacgtacacgaccggtgctcgatttagcagtactgcgttgggtttgggggctgggcctcaggaagcagcatcggaggtgcctcagccatggcatggatccctctcttcctcggcgtccttgccccttactgcacaggttccgtggcctcgtatgacctgactcagccaccctctgtgtccgtgtccccaggacagacagtcacaatctcatgctctaggagatgctagttaggggggtaaaaacgtttggtcttttcgtaggtatcgaggcaacggaacgccagggcctacggtcccccgtgtccgtttaggtcattctaagtaaaggtatagcgaggccggccctgacgggtnttccgtggagtcgtattcgtccggcctccaacgtccggtaccaacaccagcccactctcgaccagtacgacggccggggacccagggcctcgtccggatggacggtctacgaacttacttacgacggtccgagggtcggttgggggaacctcgtacgttcccgtaaccgtttcccgtttaagtcggttccgttacggggtacggggttcgggaaccctaggtttccgggtacccgtaccgggttcccgttacgggtcccaacggaccccaaacccggaacccccaaccccggagttccgtaacc

SEQ ID NO: 156205 - DNA, 951 bp, Homo sapiens
  misc_feature: GYAE6OF02JKI4S.12.87.H10.1.454.CMB.1.raw
  modified_base (194)..(194): a, c, t, g, unknown or other
  misc_feature (194)..(194): n is a, c, g, or t
  modified_base (233)..(233): a, c, t, g, unknown or other
  misc_feature (233)..(233): n is a, c, g, or t
  modified_base (268)..(268): a, c, t, g, unknown or other
  misc_feature (268)..(268): n is a, c, g, or t
  modified_base (474)..(474): a, c, t, g, unknown or other
  misc_feature (474)..(474): n is a, c, g, or t
tcagatacgacgtacacgaccggtgctcgatttagcagtactgcgttgggtttggggctgggcctcaggaagcagcatcggaggtgcctcagccatggcatggactcccctctccttccgtcggcgtccttgcttacgtgccacgtacggttcccggtggccctcggttatcggacccgtgtacctcacgcccncccgtctgtcggtacccgttcgtcccccaggacagaccngtccaacgaactcctacgatcgtcgtcgtggtagntcgtacgtacgggttaaggggtaaagtttcgttcgtttacggtagtactccgaagtcgtaaggtaaccgccctacggtaccctccggttccccgtttcgggtaccgttttacggcttaacggtttaaccgtaaggtaaacggttaacgaccggtacgggtaacggttcccccggtacccgttaggtacgggttacctttaccgggnggttacggtacccgtagtttccccggtacgttcccttaacccgggtacccgtcccggtaccgaaaccgtacggtaacccctcggtaccttcccggtaaccgtaccgtaaccgtacccggtaaccgggtacccccggggtaacccggtacggttacccggtttacgtaaccggttacgggtaccggttaccgttaacgggttaacctttaaccgttacccggttaccggacgggttaaccggtcggggtttaaacgaccggtttaccggtcccccgttttacccggttacccgttttaacccgggtttaccggttaccggtttacccgggtttaccgggaacggggttttcccgtaccggtaccgtttacccggggtacccttaaccgttaccggggtacccgtttacccgaaccggaccccgttaacccggaacccccgttaccccggtacggtttaccccgtacgtttacccccgg

SEQ ID NO: 156206 - DNA, 827 bp, Homo sapiens
  misc_feature: GYAE6OF02HRDV1.12.87.H10.1.454.CMB.1.raw
tcagatacgacgtacacgaccggtgctcgatttagcagtactgcgttgggtttggggctgggcctcaggaagcagcatcggaggtgcctcagccatggcatggatccctctcttcctcggcgtccttgcttactgcacaggttccgtggcctcgtatgacctgactcacgcccaccctctgtcgtccgtcgtcccaggacagacagtcacaatctcatcgctcgtggagtagtcgacgtacggttagggggtaaaagttttcgtacgttttccgttagggttactaccgtagacgtaacggaacgaccgaacggacccgtacggttccccgttggttccgtttcggtacctaacgttacctaaacgtaaaggtaactaacggccgtaacgggcccggtaccccgtacggtaacgggtacttacccgtagggtacgaccggttacgttcccggtacccggtaccttaaccccgtaaacgttaccccgggaactaaacccgtaacccgtaaccggacccctacccgttaccgtaaccgaaaccctacgttaccgaaccggggaccccgggaacccgtacgggtaccctcgtacgtagtcgggtaacgtccgttaacgtaacttaacgttaccgacgccggtaacgggtcggtaacggacctccgtaccgttacccgttacccgtttcttacgttcggttccggttacgggtaacggtcgggtaacccgtaggttcccggtaaccgtcccggttaccggttaacggacccgtaacccggtaccccgaaaacccgacccccggtaacgttacccggtaccgttaaccccgg

SEQ ID NO: 156207 - DNA, 727 bp, Homo sapiens
  misc_feature: GYAE6OF02JBE9L.12.87.H10.1.454.CMB.1.raw
  modified_base (223)..(223): a, c, t, g, unknown or other
  misc_feature (223)..(223): n is a, c, g, or t
tcagatacgacgtacacgaccggtgctcgatttagcagtactgcgttgggtttggggctgggcctcaggaagcagcatcggaggtgcctcagccatggcatggatccctctcttcctcggcgtccttgcttactgcacaggttccgtggcctcgtatgacctgactcacgccaccctctgtcgtccgtcgtccccgaggacacgacacgtcaacatctcatcnctcgtggagatcgcgtaaggttagggggtaaactttgtcctttcgttaggtactcgacgtacaacggaacgccgacggccctaaccggttcccgttcggttacgttcgggtactacgtacgtaaggtaaaccggtagtacggtacggaccggggtccggtacccgtacgggacgggtttacttcccggtaaggacggtacgtacgttccggtaccggtaccgtacccgtaaccgtaccgaaccaacctaccggaccgtaccctaccgttaccgcgtaaacccgtagtacccggaccgggtaccgggaaacccgtcggtaccctgtacgggtacgtcggacggtcgttaacgtacgttactccgacggtccggacgggtcgtacggaccgtccgtccttaccgttaccgttacgtagttccggttcgacgggtacggacgtccgtagttccgtacctacggttcgtacgacctacggaccaaccgacccttaaccgctacgtccc

SEQ ID NO: 156208 - DNA, 793 bp, Homo sapiens
  misc_feature: GYAE6OF02G23NC.12.87.H10.1.454.CMB.1.raw
tcagatacgacgtacacgaccggtgctcgatttagcagtactgcgttgggtttgggggctgggcctcaggaagcagcatcggaggtgcctcagccatggcatggatccctctcttcctcggcgtccttgcttactgcacaggttccgtggcctcgtatcgacctgactcagcccaccctctgtcgtccgtcgtcccaggacagacagtcacaactctcatcgctcgtaggacgtagtcgacgtaggttaagggggtaaaagtttcggtcttttacgtggttactacgacgacgaacggaacggccgacggcccgtacgtccccgtagttcgttcggtactacttacgtaaagtaaggtactacgggacgacgggtcccggtacccgtacggtacgggtacttccggtaggaccggtccgtacgttcccggtccggtaccctacccgtaacgtcccggaaccaaaccaaccgtaccgaccctacttccgaacgtaccctacgtacccggaaccgggtaccgggaaccccgcggtaccctacgtacggtaacggtcggtacgtacggttaacctaactttacgttaccgcggtacggtacgggtaccggtggtaaccctcgtaccctttacccgttacccgtttaccgtttagttaccggttaccgggttacgggacgggttacccgggtacgttaacgggttccgggtaacccgttaccgggttaccgtacgggttacccaacccgtaacccccggaacgtaaaccccccgtacgttacccggttcctaccccg

SEQ ID NO: 156209 - DNA, 672 bp, Homo sapiens
  misc_feature: GYAE6OF02FVGR7.12.87.H10.1.454.CMB.1.raw
tcagatacgacgtacacgaccggtgctcgatttagcagtactgcgttgggtttggggctgggcctcaggaagcagcatcggaggtgcctcagccatggcatggatccctctcttcctcggcgtccttgcttactgcacaggttccgtggcctcgtatgacctgactcagccaccctctgtgtccgtgtcccccaggacagacagtcacaatctcatgctctggagatgcagttagggggtaaaagtttgctttcgtggtatcgagcagaacgccgacggccacgtccccctgtccgtttgggtctattacgtaataaggtataggcgacgggccggcccgtcgagggtacttccgtgagtccgtattccgtccggtctcccaacgtccggaccaacacacgacccactctcgaccatcgacggccggacccaggtcctcgtcgagtcgacggtctacgtacttactaccgtcgaccggaggtccggtacgggactaccggccttaccccgtaccgttttaccccgttgttaccggttcgttaccggggtacgggttccggaaccgttacggttccgggttaccccgtaacccgggttccgttaaccggtccaacccgggttaccccgaaacccggtaacccccaacccccgttacggttacccgtaaccccg

SEQ ID NO: 156210 - DNA, 788 bp, Homo sapiens
  misc_feature: GYAE6OF02GWQKC.12.87.H10.1.454.CMB.1.raw
  modified_base (136)..(136): a, c, t, g, unknown or other
  misc_feature (136)..(136): n is a, c, g, or t
  modified_base (142)..(142): a, c, t, g, unknown or other
  misc_feature (142)..(142): n is a, c, g, or t
  modified_base (183)..(183): a, c, t, g, unknown or other
  misc_feature (183)..(183): n is a, c, g, or t
  modified_base (525)..(525): a, c, t, g, unknown or other
  misc_feature (525)..(525): n is a, c, g, or t
  modified_base (544)..(544): a, c, t, g, unknown or other
  misc_feature (544)..(544): n is a, c, g, or t
  modified_base (549)..(549): a, c, t, g, unknown or other
  misc_feature (549)..(549): n is a, c, g, or t
  modified_base (611)..(611): a, c, t, g, unknown or other
  misc_feature (611)..(611): n is a, c, g, or t
tcagatacgacgtacacgaccggtgctcgatttagcagtactgcgttgggtttggggctgggcctcaggaagcagcatctgaggtgcctcagccatggcatggactccctctccttcctcggcgtccttgcttacngcacgnggttccgtggcctcgtatgacctgactcacgccctaccctntgtcgtccggtcgtacccccgaggtaaccagaaccgtagtacaacctaacttctcgtaattcggccttacgtaggaatccgttggaaccgtaggtttaaggggggttaaaagtttgttaccgttttacggtggtaacctagtaacggacgtaacggaacgcccgttaacggaccgttaaccgttcccccgttaggtccgtttacggtaacctcttaaccgttaaagtaaggactaaggcccgtaagggccccgttacgtacggtacgggttacccttagacggaacgttccggttaattcccgtacccggttactaccccgaaacgttccggacctaaaacncaacgtaccctcgtacgtnaaccncgtacgaacgggcccgaccggtagtccttacgacgaagttcgacgtcgttaacaccgtttanaccgtcacgggtaggttcggaccgtacggtccttcccgtaccgttcccttaaccggttaacttcgttaccggtacgggtaccggtacggaactacgggttaccgttccggtaacccggttaacccgtggtaaccacccgggtaaaccctaccaacccggttaacccgcttaaccccg

SEQ ID NO: 156211 - DNA, 740 bp, Homo sapiens
  misc_feature: GYAE6OF02H28J9.12.87.H10.1.454.CMB.1.raw
tcagatacgacgtacacgaccggtgctcgatttagcagtactgcgttgggtttggggctgggcctcaggaagcagcatcggaggtgcctcagccagtggcatggactccctctcttcctcggcgtcttgcttactgcacaggttccgtggcctacgtatgacctgactcgacgcccacctctcgtgtccgtcgacccagacagacagtacactaatcctgactgtcctcgtaggagtatacggtagtaacgggttaagggggtaaacttttgtacgttttcgtaggttaactcgtaagacgaacggtaacgaccgaagtacccggtaccgtacccgttcggttacggtacggtaaccgtagtaacctaaacgtaaaggttacgtaacggacccggtacggggtcccggttacccgtacgggtaacggggttacctacggtacggtaacgtaccgtacgtttacgtccggtacctaccgtaacccgtaccggtaaccaacgtaccgacgtacccgtcgtacgtacgactaacgtacaacggtaccggaccgacggtcgtacgtacggtacgtggacgacgttaagtaaccttacgtacgtaccgtcgacgggtcggtacggacctacgtccgtaccttacccgtttacgtaccgttacgtacgtacgaggttcgtacgtcggtacgttccgacggtcgtaacgtcgaaccgaccgtaaccgtaaccacctccgtactaccg

SEQ ID NO: 156212 - DNA, 865 bp, Homo sapiens
  misc_feature: GYAE6OF02FQJ1O.12.87.H10.1.454.CMB.1.raw
tcagatacgacgtacacgaccggtgctcgatttagcagtactgcgttgggtttggggcgtgggccctcaggaagcagcatcggaggtgcctcagccatggcatggatccctctcttcctacggcgtcccttggcttactgcacaggttccgtggcctcgtatgacctgacgtcagccaccctctgtgtccgtcggtccccaggtacacggacaggtcacaagttcctccgtatcgctctagggtacgacgtgccgtagtttaggggggtaaaacgttttcggtacgttttaccgttggttacgttacgtaacggtcgtaaaggaaacgcccgtacggacccgtacggttacccccctagttccgtttacgggtccgtaacgttaccgtaaggtaaggtagttaccggacgaacggggtaccgtccccttacggaacgggtaacgtttcccgtagggaccggtacggacgttttacccgtacccgggtccctaacccgtaaaccccgttcccgggaaacgtaaacccgtaaccgtaacccggtaccccggtaaacgttccgtaacggtaacccctagtacccggaacgggccccgggtaaccccgaacggggtccctaccggttaccgaagttacgggaaccggtctacggtaaccgttacttaacggccgtaccggaaggcccgggttaggaacctcgggtcccttaacccgttacgttttacccggtaagttccggtaccgtttcggggacgggttacggaccggttacgtaacccgggtccgttaacccggtcggttaaccgggtaccctaccgggaaccccgtaaccggtaacccctaacccggtaccgttacccggtaccc

SEQ ID NO: 156213 - DNA, 915 bp, Homo sapiens
  misc_feature: GYAE6OF02IJFXR.12.87.H10.1.454.CMB.1.raw
  modified_base (149)..(149): a, c, t, g, unknown or other
  misc_feature (149)..(149): n is a, c, g, or t
tcagatacgacgtacacgaccggtgctcgatttagcagtactgcgttgggtttggggctgggcctcaggaagcagcatcggaggtgcctcagccatggcatggatccctctcttcctcggcgtccttgccttactgcactaggttccgnggtccctcgttagtcgtacctggtacctcgaactcccgacccttctgtcgtccgtcgtcccgaggacagacagtacacaatctcatcgctcgtaggacgacgtacgtacgtaagggtttaacggggggtaaaacgtttttcggtactttttacggtacggttagtacgtaaggaccgtaacggaaccggcccgaaccggtaacccgtacccgtttaccccgttcgtttccgttacggttactaacccgtttaagtaaacggtttaaagggttaacgtaaacggtcccgggtaaacggggtccccgggtaaccccggtttacgggtaaacggggtttacctttaccgggtaacggaaccggttcgttaaacccgtttccccgggttacccggtaaccgtaaccccgtaacccggtcccggaaacctaaccggaaaccgtacaccccgtaaccgtacgtcccgaaacgtgtaccgggaaccgggtaccccggggccgtaccggtaaccgttcgtacggacgtaggggtaccgtaaccgttaaccggtacgttacctaccggttaaccgaccgggtaacgggtacggtaacgggtaccgaccgttccgtacccttttaacccggttacggtttacccgttacgggttaccggggtttccgggtaacgggttcggtaccggtacgtttcgggacccggttaccgtaaccggtccgtaaccggtaccgtaaccggtaacccaaccccgtaacgttcccggtactaccccgg

SEQ ID NO: 156214 - DNA, 721 bp, Homo sapiens
  misc_feature: GYAE6OF02IFRF2.12.87.H10.1.454.CMB.1.raw
tcagatacgacgtacacgaccggtgctcgatttagcagtactgcgttgggtttggggctgggcctcaggaagcagcatcggaggtgcctcagccatggcatggatccctctcttcctcggcgtccttgcttactgcacaggttccgtggcctcgtatgacctgactcagccaccctctgtgtccgtcgtcccaggacagacagtcacaactctcatgtctcgtggagtagtcgacgtagggttagggggtaaaagtttcgtcttttcgtggtactcgacgtacgaagacgccgtacggccgtaccgttcccctcgttacctactacgtacttactttaacaaaacttaccgacggtcccggtacccgttcggtacggggtcccgtggtacgtcgtacgttctccgtcggtccgttccgaccgttcgtacggaacactacgtacctactcgtacgaccgtacgtacgaccggtcccggaaccgtacggtacgttaacgttagagtcgaacggtcttacggtactacgtacgtcgtacgtcggtcggtacggtcgagtacgacggtcggttcgggttcgggtaccgggtacgggaccggtaccgtaggttacccgtacggtttaccggtaccggtacggtaccggtaccggtacccggaaccggtccgttacccggtcccgggttaccgtaccttacccggttcccgttacccgttacccccg

SEQ ID NO: 156215 - DNA, 861 bp, Homo sapiens
  misc_feature: GYAE6OF02HEEBB.12.87.H10.1.454.CMB.1.raw
tcagatacgacgtacacgaccggtgctcgatttagcagtactgcgttgggtttggggctgggcctcaggaagcagcatcggaggtgcctcagccatggcatggactccctctcttcctcggcgtccttgcttactgcacaggttccgtggcctcgtatcgacctgactcgacgccctaccttcgtcgttcgtccgttccgacccgaggacacgacacgtacaactaactctactacgtgctacgtaggatacgtcgtacgttaaggttaaggggttaaacgtttgttctttacggttaggttactcgacgtacggaagaccggaccgacggtccgtaccgttcccgttgttcgttacggtactacttacgttaagttacggtacgtacgtacggaccggtccgtaccgttacggtacggttactacgtacggacgtccgttacgttcccggaccgtacctaaccgtaccgtaccgaaccgacgtaccgaaccgtacctaaccggttccgtaacgaccggtaaccgtacggtaccgggaaccccgggtactaacccggggttccgttaacggttaccgtacgggtaacgggtaccggttaacgtttaccgggttaaccctttaacggttaacccggttccggaacggtacccggggttacgggtaaccgggacccttacgggttaccccgtttaccgtttaccggtttaccgtttacggtcccggtttacggggtacccggtaaggggttcccgtaaacgggtttcccggttaaccggttaccggcccctttaacgggccggttaacccgtacccggaacccgtaacctaccccggaaacccgttttcgacccggtttaccc

SEQ ID NO: 156216 - DNA, 673 bp, Homo sapiens
  misc_feature: GYAE6OF02FFWGD.12.87.H10.1.454.CMB.1.raw
  modified_base (225)..(225): a, c, t, g, unknown or other
  misc_feature (225)..(225): n is a, c, g, or t
  modified_base (252)..(252): a, c, t, g, unknown or other
  misc_feature (252)..(252): n is a, c, g, or t
  modified_base (331)..(331): a, c, t, g, unknown or other
  misc_feature (331)..(331): n is a, c, g, or t
  modified_base (468)..(468): a, c, t, g, unknown or other
  misc_feature (468)..(468): n is a, c, g, or t
tcagatacgacgtacacgaccggtgctcgatttagcagtactgcgttgggtttggggctgggcctcaggaagcagcatcggaggtgcctcagccatggcatggatccctctcttcctcggcgtccttgcttactgcacaggttccgtggcctcgtatgacctgactcagccaccctctgtgtccgtgtccccaggaccagacagtcacaatctcatgctctgganatgcagttgggggaaaatttgctttcnggtatcgagcagaagccaaggccagtcccctgtcttggtcatctaagtagatagcgaggccgcctgagggtacttccgngacgcattcgccggtctaccgaacgtcccggtacaaacgtaccgacgacccgtacttacgacgaaccctaatcgaacggtcccgggaccccaaggtccctcgtacggatcggacggtacctaggacttacgttaccngacccgtaaggggtccgtacgggaccaggtccccttaccgttaccctttacccggttatacggttccgttacgggacgggtttacggggaccctaaggtttccgggtaccctaacccgggtttccccgttaagggtcccgttaaacccggcccccgtaaaaccggtaccccccgttaacccccgtaaccggttgtttaacccccg

SEQ ID NO: 156217 - DNA, 819 bp, Homo sapiens
  misc_feature: GYAE6OF02FM2EF.12.87.H10.1.454.CMB.1.raw
  modified_base (212)..(212): a, c, t, g, unknown or other
  misc_feature (212)..(212): n is a, c, g, or t
  modified_base (507)..(507): a, c, t, g, unknown or other
  misc_feature (507)..(507): n is a, c, g, or t
tcagatacgacgtacacgaccggtgctcgatttagcagtactgcgttgggtttggggctgggcctcaggaagcagcatcggaggtgcctcagccatggcatggatccctctcttcctcggcgtccttgcttactgcacaggttccgtggcctcgtatcgacctgactcagccaccctctgtgtcccgtcgtccccaggtaccagacagtcanaactctcatgctctggacgatgcgtacggttaggggggtaaaaagttttcggtcgttttacgtagggttacttacgacgacgtaacggaaacgacccgacggggtaccctaccgttccccggtagtttccgttggtacctaacgtacgttaagtaaacggtgttaacggccggacggggtacccggcccctaggaacgggtaactttccgtagacgtcgtacttccgtccgggtaccaccgtaacccgtaccgaaccgtaaacaccgcgtaaccctacgttccgaacgtaacccngttacccggacggtcccggggaaccccgtaacgggtcccgttactaccggtaaggtacggaccggttaacgttacgtaacggtttaactttcccggacggacccgtaggggtaccgggttacggggaaccgttcggtaccccgttaccgttaacccgtttttcccggttaagttcgggtttaccggttacgggggtaacgttacgtaccggtaacggtttccgggtaaccttcccgggttaccgttaacgtaccggtaacccgtacccggtaaacccgaaccccccgtaaccgttacccggtgttaaccccg

SEQ ID NO: 156218 - DNA, 736 bp, Homo sapiens
  misc_feature: GYAE6OF02G5U68.12.87.H10.1.454.CMB.1.raw
  modified_base (139)..(139): a, c, t, g, unknown or other
  misc_feature (139)..(139): n is a, c, g, or t
  modified_base (170)..(170): a, c, t, g, unknown or other
  misc_feature (170)..(170): n is a, c, g, or t
  modified_base (177)..(177): a, c, t, g, unknown or other
  misc_feature (177)..(177): n is a, c, g, or t
  modified_base (261)..(261): a, c, t, g, unknown or other
  misc_feature (261)..(261): n is a, c, g, or t
  modified_base (306)..(306): a, c, t, g, unknown or other
  misc_feature (306)..(306): n is a, c, g, or t
  modified_base (329)..(329): a, c, t, g, unknown or other
  misc_feature (329)..(329): n is a, c, g, or t
  modified_base (555)..(555): a, c, t, g, unknown or other
  misc_feature (555)..(555): n is a, c, g, or t
  modified_base (567)..(567): a, c, t, g, unknown or other
  misc_feature (567)..(567): n is a, c, g, or t
tcagatacgacgtacacgaccggtgctcgatttagcagtactgcgttgggtttggggctgggcctcaggaagcagcatcggaggtgcctcagccatggcatggactccctctcttcctcggccgtccttgcttactgcncaggttccgtggcctcgtatgacctgactcncgacccncccctgtcgtcgtccgtacgtcccccgaaggtacacgaacacggtaccaacctaaacttcactaacgtgtccttcgtaggacgntacgacgtagggttaaggggtaaatttcgtaccgttttgtacgtntcgacgtagaaagaccgtaccgngtacccgtaaccgtccgttcgttaccgtttacgggtacctatttaccgtaaaaggtaaggtaacgtacgaccgggtaaccggtcccgtacccgtacgggtaggttaccgttaccgttagacggtccgtaagttcccgtaccgaccgtaccaaccggttaccgactaacaccgtacgctaccgttacaccgtacgtcctacgacggaccgaccgtacgtaccgtccncgaacgtggtancggtaattaaccgtacgttacgccgtacggacgcggtccggacgtaccgccttaccgttaaccgttcgttacgtggtacccgtgggtaccgtaccggtcgtacggtccgtcgtaccggtccgacgtaccgaccgtacccgaacctaccccgtaactacccgtatcccgg

SEQ ID NO: 156219 - DNA, 773 bp, Homo sapiens
  misc_feature: GYAE6OF02FR9WE.12.87.H10.1.454.CMB.1.raw
  modified_base (238)..(238): a, c, t, g, unknown or other
  misc_feature (238)..(238): n is a, c, g, or t
tcagatacgacgtacacgaccggtgctcgatttagcagtactgcgttgggtttggggctgggcctcaggaagcagcatcggaggtgcctcagccatggcatggatccctctcttcctcggcgtcctgtcttactgcacacggttccgtggcctcgtatcggacctgactcacgccaccctctggtctccggtcgtccccgaggacagacagtacaactatctcatcggctcgtagganagtacgacgtaaggtttaaggggggtaaaagtttcgtcttttcggtagtctacgagacgaaggtaaccgccgaggtcccgacgttccccgtaggtcttacggtactactcgtaaagtaaccggatacgcgaacgggtcccgtcccgtaggtacggtactttaccggagacgtcgtacgtccgtccggacctaacccgtaacggtccccgtaactaaaccacgaccgacctaactcgacgaccctacgtaacgaccggggaacccggaccgacgtaccgtccgtacggacgtcggaccggcttaacgacgttaacgttccgggacctcggaccggttaccggacgggtaaccgccgtttaccgtaccccgttaccgttttaccgtacgtttaccggtacgggtttacggggaccggttacgggtaaccgtaccgggtttccggtaacccggacccggttttaccggtaaacggtacccgaccccgtaacccgtaaccgtaacccccggtaaccccgttacggttacccgtaacccg

SEQ ID NO: 156220 - DNA, 763 bp, Homo sapiens
  misc_feature: GYAE6OF02JPNIQ.12.87.H10.1.454.CMB.1.raw
  modified_base (536)..(536): a, c, t, g, unknown or other
  misc_feature (536)..(536): n is a, c, g, or t
  modified_base (573)..(573): a, c, t, g, unknown or other
  misc_feature (573)..(573): n is a, c, g, or t
tcagatacgacgtacacgaccggtgctcgatttagcagtactgcgttgggtttggggcgtgggccgtcaggaagcagcatcggaggtgcctcagccatggcatggatccctctcttccctcggcgtccttgcttactgcacaggttccgtggcctcgtatcgacctgactcagccaccctctgtcgtccgtacgtcccccaggaccacggactacgtccacaatctacatgacctcgtaggacgtactgaccaggttagggggaaaacttttcggtccgtttacgttagggttactcgtaagtaccgaagtaaccggcccgaacggacccgtaaccggtcccccttacggttaccgtttccgggtacctaacggttacctaaacgttaacgggtagttacgaccggtacgggacccggtacccgtacggaacgggtctttaccgcgtacggtacgtccgttccggtacccgtccgttacccgaaccgtcccggtaaccaaccgtaccgtaccgaccctaaccgtccgtacccgtanaccgtacccgacggccggtaaccccgacgtccgtacncggtagtacggcgtacgtacgtaccttaacgtaccgtacgtaccgacgggttcgaccgggactaccgtccttacccgtaccgtttaccgtattcggtccgtacgggtacggtaccggtacgcgtacccggtcgtacccgtcgtacgtaccgacccggccaacccgcccgtaaccgtaccgtccgtaaccc

SEQ ID NO: 156221 - DNA, 637 bp, Homo sapiens
  misc_feature: GYAE6OF02FPKH5.12.87.H10.1.454.CMB.1.raw
  modified_base (432)..(432): a, c, t, g, unknown or other
  misc_feature (432)..(432): n is a, c, g, or t
  modified_base (443)..(443): a, c, t, g, unknown or other
  misc_feature (443)..(443): n is a, c, g, or t
tcagatacgacgtacacgaccggtgctcgatttagcagtactgcgttgggtttggggctgggcctcaggaagcagcatcggaggtgcctcagccatggcatggatccctctcttcctcggcgtccttgcttactgcacaggttccgtggcctcgtatgacctgactcagccaccctctgtgtccgtgtccccaggacagacagtcacaatctcatcgctctggagatgcagttaggggtaaagtttgtctttcgtggtatcgtagcagaacgccaggcccacgtccccgtgtcgttcggtctactctaagtaaggatagcgacgggccggtcccgtcgtacgggtacttccgtggacgcgtattccgtccggcctacccgaacgtccggacaacaccacgcccactctcgaccagtacgacggccgggaccnggcctcgtcgntagacggcttagacctttagtcgcgccgtagggcggtacggactcgtccctccgttaccgttcccgttagttccggttacggttcgggacggttcgggaaccttacggttaccgggtaccccttaccgggttccgtacggtaccgacccggaacccgtaaccggaacccccttaccccgtacgttccgtacccg

SEQ ID NO: 156222 - DNA, 702 bp, Homo sapiens
  misc_feature: GYAE6OF02GTO2Q.12.87.H10.1.454.CMB.1.raw
  modified_base (691)..(691): a, c, t, g, unknown or other
  misc_feature (691)..(691): n is a, c, g, or t
tcagatacgacgtacacgaccggtgctcgatttagcagtactgcgttgggtttggggctgggcctcaggaagcagcatcggaggtgcctcagccatggcatggatccctctcttcctcggcgtccttgcttactgcacaggttccgtgcctcgtatgacctgactcagccacctctgtgtccgtcgtcccagacagacagtcaacatctcatgctacgtggagtagtgacgtaggttagggggtaaaatttcggtctttctaggtatacgagtacaagaacgcgacgtacctacgtcccctgttcgttagactatactagtaagagtagtaccgacggcgtcccgtagacgggtacttcgagacgtcgtacgttccgtcggacctaccgtaaccgtaccgacctaaaccaccgaacgtccccaacgttccgaacgacctaccgttaccggaccgggtacccgggaccccgtacggtccgttaccgtaggtactgggaacgcgttaacggactttaacgtaccgtacgaccggtacgggtcggtacgaccggtctacccgttacccttaccggttttaccccgttagttccggtacggtttacgggaccgggttaccgaaccgttacgggtcgtacccgtcccgttacggtacgtacccgaccggaacccgaaccgtaaccctaaccccgtntaaccggtccc

SEQ ID NO: 156223 - DNA, 740 bp, Homo sapiens
  misc_feature: GYAE6OF01DOONW.13.9.A09.1.454.CMB.1.raw
  modified_base (264)..(264): a, c, t, g, unknown or other
  misc_feature (264)..(264): n is a, c, g, or t
  modified_base (281)..(281): a, c, t, g, unknown or other
  misc_feature (281)..(281): n is a, c, g, or t
  modified_base (679)..(679): a, c, t, g, unknown or other
  misc_feature (679)..(679): n is a, c, g, or t
tcagtcacgtactacacgaccggtgctcgatttagcgagacgcgcaggggctgggagaggagccccagccgtgagattcccaggagtttccacttggtgatcagcactgaacacagaccaccaaccatggagtttgggcttacttgggttttccttgttgcttaattttaaaggtgtccaatgtgagctgcagctggtggagtcgtgggggtagtttggacagcgaagggccgtccctgagacctctcctagtactaacttcgnggattcgaagttgggtntattatcgtactatagaacgtcggggtcccgaccgtacgggccgttaccggaagggggaaacgggggcgttaggggtagggttagggggtttaaggttttccgaaggttttaagggacgtacgttaaacgtttcttacgaagttaggtaagttaggggaaacaaacgtaagtaaacgtacccggccggtacgttaacgtaacggttaaaaaacgggctaaacggtaacttacccaacccgtaattaccgtaacgaaaggaagtagtacggtacgtaacccgaagaacgacgtaacgttcccgtacctttacgtgaccgtaagtatacggtacgtacggcctaacgggaacgaaccgggtaacgaacctaacgaacgtcctaagttaccttaattacgngttacgaacgttagaagtagttatacgacgtactaccgtaaccgcccgttgtcgtacgggg

SEQ ID NO: 156224 - DNA, 560 bp, Homo sapiens
  misc_feature: GYAE6OF01B7177.13.9.A09.1.454.CMB.1.raw
  modified_base (277)..(277): a, c, t, g, unknown or other
  misc_feature (277)..(277): n is a, c, g, or t
  modified_base (299)..(299): a, c, t, g, unknown or other
  misc_feature (299)..(299): n is a, c, g, or t
  modified_base (348)..(348): a, c, t, g, unknown or other
  misc_feature (348)..(348): n is a, c, g, or t
  modified_base (461)..(461): a, c, t, g, unknown or other
  misc_feature (461)..(461): n is a, c, g, or t
tcagtcacgtactacacgaccggtgctcgatttagcgagacgcgcaggggctgggagaggagccccagccgtgagattcccaggagtttccacttggtgatcagcactgaacacagaccaccaaccatggagtttgggcttacttgggttttccttgttgctattttaaaaggtgtccaatgtgagctgcagctggtggagtcgtgggggaggtttggtacaggccagggcggtccctgagactctcctgtataacttctggattcaacgttgggtnattatgctatgaactgggtccncaggcctccgaggggaggggctgggagtgggtaggtttcagttaggganctaattctcatgagtggggaacaacgagaataccgccgacgtactaaggtaaaggctaagattaccacctatctacaagagtatgacgtccgaagaacgcatccgtcctttcngacagtatggagtagccgtagaacggacggagacacgacgccatcttattacctggtacgtctagagtagttatgcctacgtcctacgctgcgttaggg

SEQ ID NO: 156225 - DNA, 717 bp, Homo sapiens
  misc_feature: GYAE6OF01DDVJJ.13.9.A09.1.454.CMB.1.raw
  modified_base (173)..(173): a, c, t, g, unknown or other
  misc_feature (173)..(173): n is a, c, g, or t
  modified_base (506)..(506): a, c, t, g, unknown or other
  misc_feature (506)..(506): n is a, c, g, or t
tcagtcacgtactacacgaccggtgctcgatttagcgagacgcgcaggggctgggagaggagccccagccgtgagattcccaggagtttccacttggtgatcagcactgaacacagaccaccaaccatggagttgggcttacttgggttttccttgtgcttattttaaaggtntccaatgtgagctgcagctgggtggagtcgtggggggtagtttggacaggccgaggggtccggtcctggacgacctctcctgtatacttcgtggtacttcgtaacgtttggggtagtaatttactggacttagtaggtaaccgtcggggtccccgcgacgggtccgtaccgggaagggggaaggggctaggggtagggttcgggttaggttttccgaagtttaggggactacttaaacttctacgagtacgaaggtcggggaaaccaaacggagtaaacgtacccggcccgtacgtacgtaaagtaaaagggccaaggttacttccaaacctnttaccgtacaaaggagtagtagaacgtccgaaagaacgcctaagtccccgtcttttacgacgactaaggtactagggtaacgtacgtaccgtaaggaaccggaacccgaagggaacccacgtaccgactacttaccttagtaccgtgtacgacgtaggactagttgttacgcgttaaccgtacccgttacgaccgtggtaccgttcggggg

SEQ ID NO: 156226 - DNA, 677 bp, Homo sapiens
  misc_feature: GYAE6OF01DDW8A.13.9.A09.1.454.CMB.1.raw
  modified_base (403)..(403): a, c, t, g, unknown or other
  misc_feature (403)..(403): n is a, c, g, or t
  modified_base (493)..(493): a, c, t, g, unknown or other
  misc_feature (493)..(493): n is a, c, g, or t
  modified_base (645)..(645): a, c, t, g, unknown or other
  misc_feature (645)..(645): n is a, c, g, or t
tcagtcacgtactacacgaccggtgctcgatttagcgagacgcgcaggggctgggagaggagccccagccgtgagattcccaggagtttccacttggtgatcagcactgaacacagaccaccaaccatggagtttgggctttacgtttggttttaccttgttgcttaatttttaaaaggtgtaccaatgtgagctgcagctggtggagtcgtgggggtagtttggacagccgagggcgtcctgagactctctgtactaacttcgtggacttcaacgttgggtagtatttatggacttataggtaaccgtcggggtcccgaccgtacggccttaccgggagggggaacggggcttaggggagggtttggggttaggtttaccagtttaggacgataacgtttcncagtgtagacggacaaacgagaaactacccggcgtcgttacgtaaaggtaaaacgggtctaaggtactttccaaccctatttacccgaanaaaggtaggtatacggtaacgtaccgaaggtaacactactccgttacctttcgacgtactaagcgtagtacggtaacgccgtaagaaaccggtccgagtaacgacaacgtcaagttacttagttcgtagcgtaacgagtaaggtattacgtnacttacgtacccgtagacctgtcgttacgggg

SEQ ID NO: 156227 - DNA, 787 bp, Homo sapiens
  misc_feature: GYAE6OF01AFYX3.13.9.A09.1.454.CMB.1.raw
  modified_base (242)..(242): a, c, t, g, unknown or other
  misc_feature (242)..(242): n is a, c, g, or t
tcagtcacgtactacacgaccggtgctcgatttagcgagacgcgcaggggctgggagaggagccccagccgtgagattcccaggagtttccacttggtgatcagcactgaacacagaccaccaaccatggagtttgggcttacttgggttttccttgttgctattttaaaggtgtccaatgtgagctgcagctgggtggagtcgtgggggagtttggtacagccagggccgtcctgagctcncctgtataacttctggtattcaacgttgggtgtattagtgacttagttggaacgttcggggtcccgaccgacgggtccttaccgagggggaaggggggtccttggggagggtttcggggttaacgggttttcgtaaggttttaggggacgtaccgtaaatttccgttacgagttagggaagttacgggggaaaccaaacggaacgtaaacgtacccgggtacccggtcggttacgttaagggtaaaaacggggccctaaagggttaacctttacccaaaccccgtagtttacctaccgaaaagggtacgaacgttagaccggttaccgaaagaacggaccttacgtcccgtttaccgtttccgtagacgtaacgtacgtaggaaccgttacgaccgttaagggaaccggaccggtaacggacaaccgacggaccttaacttgttaaaccgtcgttagtacggttccgaagttaacggtcgttaacgtttaccggacgttaccggttacccttaaccggtccccgttggtccgtttaaccgggggg

SEQ ID NO: 156228 - DNA, 863 bp, Homo sapiens
  misc_feature: GYAE6OF01D8MWX.13.9.A09.1.454.CMB.1.raw
tcagtcacgtactacacgaccggtgctcgatttagcgagacgcgcaggggctgggagaggagccccagccgtgagattcccaggagtttccacttggtgatcagcactgaacacagaccaccaaccatggagtttgggcttacttgggttttccttgttgcttaattttaaaaggtgtccaatgtgagctgcagcgtggtggagtcggtgggggtaggtttggacaggccgagggtccggtcccgtgacgactctcctagtatacttcgtggtattcgtaagttgggtgtattatgtactagtacgtaacgttcgggtcccgaccgtaggccgtaccggagggggtaacggggtcgtaggggtagggttagggggtttacggtttacgtaaggtttagggacgtacttaatttcctacgtaagttggtaagttacgggggaaaccctaaacggaaaggtaaaccttacccgggtacccggtacggtttaaaccggttaaacgggttaaaaacggccctaaaggttacctttacccgaaacctaacgttaccgtaaccgaaagggtaacgaaggtttacggtaaccgttacccggaaaggtaacggcccttaacgtttcccccgggtttaccttttaccgacggtacgaacggttacgttacgggaaggttaccgtaaccggttaaacgaaccgggaacccgggtaacggaacccacgggtaacctacccttagtttaaccttaacgttttaccggtaaggttaccgtacgttaaagggtaacggttaattaccggttaccggtaaccgttaacggtttaccccccgtaaggttaccccgtttaggccgggtttaaccgggggg

SEQ ID NO: 156229 - DNA, 773 bp, Homo sapiens
  misc_feature: GYAE6OF01DHA41.13.9.A09.1.454.CMB.1.raw
  modified_base (387)..(387): a, c, t, g, unknown or other
  misc_feature (387)..(387): n is a, c, g, or t
tcagtcacgtactacacgaccggtgctcgatttagcgagacgcgcaggggctgggagaggagccccagacgtgagattcccaggagtttccacttggtgatcagcactgaacacagaccaccaaccatggagtttgggcttactttgggttttccttgttgcttaatttttaaaaggtgtccaatgtgagtctgcagctggtggagtcggtgggggaggtcgttagggtaaacgggtccgggggggtcccttcggactcgtcctggtgcagtcctcgtggaactctacttttcgagtgacgcctggatcgaacgtcgggtccgaccgaggcctccggaagggggaaggggtcgtagggagggttgggttaggtttcgagttaagggngtactattctactagtcgaagtacggaacaaacgagaacgtacgccgtcgtacgtaaggtaaacgcaagtacttaccgaacctattacctaagaaacggtagtaagtacgtaacgttacccgaaagaaaccggtactaaccgtttccgttaccccttttcgagaccgtaagtacgttacggtaacggtaccgtacccgtaaagggaaccggtaaccggaacgtaacccgaccggtaacgtaacccgtttataacccgttttaacgtttactacggttaacgaccgtttaagggaaagtttgtaacggtttaccgtaacgttaaccccggttaccggttaacccgtaccggtttccgggtacggtttccgggggtttacccgggggg

SEQ ID NO: 156230 - DNA, 636 bp, Homo sapiens
  misc_feature: GYAE6OF01D0ZUW.13.9.A09.1.454.CMB.1.raw
  modified_base (245)..(245): a, c, t, g, unknown or other
  misc_feature (245)..(245): n is a, c, g, or t
  modified_base (256)..(256): a, c, t, g, unknown or other
  misc_feature (256)..(256): n is a, c, g, or t
  modified_base (263)..(263): a, c, t, g, unknown or other
  misc_feature (263)..(263): n is a, c, g, or t
  modified_base (266)..(266): a, c, t, g, unknown or other
  misc_feature (266)..(266): n is a, c, g, or t
  modified_base (272)..(272): a, c, t, g, unknown or other
  misc_feature (272)..(272): n is a, c, g, or t
  modified_base (370)..(370): a, c, t, g, unknown or other
  misc_feature (370)..(370): n is a, c, g, or t
  modified_base (477)..(477): a, c, t, g, unknown or other
  misc_feature (477)..(477): n is a, c, g, or t
  modified_base (542)..(542): a, c, t, g, unknown or other
  misc_feature (542)..(542): n is a, c, g, or t
tcagtcacgtactacacgaccggtgctcgatttagcgagacgcgcagggggctgggagaggagccccagccgtgagattcccaggagtttccacttggtgatcagcactgaacacagaccaccaaccatggaggtttgggctttacgtttgggttttccttgttgcttaattttaaaaggtgtccagtgtggaggtgcagctggtagagtcgtgggggaggtgtggtacggcgtgggggtccctnagctctctgtnccacctntgntcagtnttgatgagtagtgacatacacgtcggccacctaaccgtccggaggggaacgggctgcgtaggtcggtctacgtaggtaataacgtggtaagtggtacnccgagaccaactaacttgtcgcgaagtctacgtaggtacggaacgggtacctacttaccacctattaccacgaagacgacacgtcgaacccgaataccgtctaaacntctagaacgaatcgaacgtcgtacgtaggacgtcggacgtcgtaccggttctttgttactttggnggtacgtcgggtaaggttcacggtacggttgtacggttcgtaacgttaccgagttaacggtgggtaccgttcgggaacggggcccgaaacgggg

SEQ ID NO: 156231 - DNA, 828 bp, Homo sapiens
  misc_feature: GYAE6OF01BS4KM.13.9.A09.1.454.CMB.1.raw
  modified_base (159)..(159): a, c, t, g, unknown or other
  misc_feature (159)..(159): n is a, c, g, or t
  modified_base (185)..(185): a, c, t, g, unknown or other
  misc_feature (185)..(185): n is a, c, g, or t
  modified_base (341)..(341): a, c, t, g, unknown or other
  misc_feature (341)..(341): n is a, c, g, or t
  modified_base (363)..(363): a, c, t, g, unknown or other
  misc_feature (363)..(363): n is a, c, g, or t
  modified_base (463)..(463): a, c, t, g, unknown or other
  misc_feature (463)..(463): n is a, c, g, or t
tcagtcacgtactacacgaccggtgctcgatttagcgagacgcgcagggggctgggagaggagccccagccgtgagattcccagggagtttccacttggtgatcagcactgaacacagaccaccaacatggagtttggcttattgggttttccttgttncttatttaaaggtgtaccaatgtgancgtgcagtctgggtggacggttcggtaggggggttagtttaggacacggaccggtaggggtccggtcccgtagaacggtccttccgttccttagttaacgttaacctttcgtaggtactttacgtaacgtttggggtattagttactcggacttanacggtaacgtcggggttacccncgtacggtccaccgggaaggggtcgggcgtggggtaggtcgggtttaaggtttctaaggttacggactacgttacttccgatagtcgggagtacgggaanaaccggaatacgtaccggcctacgtaacgtagtaaacggcgtaagacgttaccgactacgttactaagaagtcgtaacgtaggtaacccgttacgaaacggtcgttacctacgggtttaccttcccgtttagtacggacaaacggttggttacggaacggttaccggtaaccgaagggttaaaacccgggaccgtacggtaaacccgtactaaccggtaccttaaccgttttaccgttaaaggtttaccgttaccgggttactacgggtttaacggtacgtttaaagggtttaccccacgggttaacccggtacctttaccccggaaccggtttccgttaaaccggggtcgtttacccggggggg

SEQ ID NO: 156232 - DNA, 426 bp, Homo sapiens
  misc_feature: GYAE6OF02IP070.13.9.A09.1.454.CMB.1.raw
  modified_base (420)..(426): a, c, t, g, unknown or other
  misc_feature (420)..(426): n is a, c, g, or t
tcagtcacgtactacacgaccggtgctcgatttagcgagacgcgcagggggctggagtgggtggcactgatttcatttgatggcaacaataaacactacgcagactccgtgcagggccgattcgccatctcaagagacacgtccaggaccaccctctatctacaaatgaccagcctgagaactgaggacacggctcattattactgtgcgagagtttttggtggctacaggcttgacctctggggccagggaccctggtcacggtctcctcagcctccaccaaggcccatccggtcttcccccctggccaccctcctccaagacgccaccctcgtcgggggccacacgccggccctggggctgcctggtcaaggactacttcctagtacgtgactgagcgggctggcgaaggcgcatagnnnnnnn

SEQ ID NO: 156233 - DNA, 545 bp, Homo sapiens
  misc_feature: GYAE6OF02I0NP3.13.9.A09.1.454.CMB.1.raw
  modified_base (429)..(429): a, c, t, g, unknown or other
  misc_feature (429)..(429): n is a, c, g, or t
tcagtcacgtactacacgaccggtgctcgatttagcgagacgcgcaggggctgggagaggagccccagccgtgagattcccaggagtttccacttggtgatcagcactgaacacagaccaccaaccatggagtttgggcttacttgggttttccttgttgctattttaaaaggtgtccaatgtgagctgcagctggtggagtctggggggaggtttggtacagccagggcggtccctggagactctcctgtataacttctggattcaacttggggtgattatgctatgaactgggtccgcaggctccagggagggctggagtgggtaggttcagttaggagcaattctcatgatggacaacgagaatacgcgcgtctgtaaaagcagattcaccatctcaagagatgagtccaagagcatcgcctttcngcagatgagtagcctagaacgacgagacacgacgccatcttattactgtagtccgtaaggagtacggttattaggttacggtccttacggacccgttgtaccgttaggtccggggg

SEQ ID NO: 156234 - DNA, 585 bp, Homo sapiens
  misc_feature: GYAE6OF02HW95U.13.9.A09.1.454.CMB.1.raw
  modified_base (365)..(365): a, c, t, g, unknown or other
  misc_feature (365)..(365): n is a, c, g, or t
tcagtcacgtactacacgaccggtgctcgatttagcgagacgcgcagggggctgggagaggagccccagccgtgagattcccaggagtttccacttggtgatcagcactgaacacagaccaccaaccatggagtttgggcttacttgggttttccttgttgctattttaaaggtgcccagtgtgaggtgcagctggtggagtctggaggaggcttgatccagccgtggggggtccctgagactctcctgtgcagcctcgtgggttcaccgtcagtcacacctacatgagctgggtccgccaggctccgaggggaaggggctggagtgcgtctcttttattatagtagtggtagtacatactccgnagactcgtgagggccattcacatctccagagaccaattccaaagaaccacgtcttagtttcttacaaatcgaacagcctagagacgccgatcgaacgaccggtccgtagttaacttacgtgtacgacgaagacggagtccggggaccccaacggtaaccgttaacgtacgtacttagtcgggtacgtccgtacgggggacccaacggggaccctaacggg

SEQ ID NO: 156235 - DNA, 654 bp, Homo sapiens
  misc_feature: GYAE6OF02HQBNY.13.9.A09.1.454.CMB.1.raw
tcagtcacgtactacacgaccggtgctcgatttagcgagacgcgcaggggctgggagaggagccccagccgtgagattcccaggagtttccacttggtgatcagcactgaacacagaccaccaaccatggagtttgggcttacttgggttttccttgttgctattttaaaggtgtccaatgtgagctgcagctggtggagtcgtgggggaggtttggtacaggccaggggcggtccctgagactctcctgtataacttctggattcaacttgggtgattatgctatgaacgtgggtccgccgaggctccgaggggaagggctgggagtgggtaggtttcagttaggagcaattctacgatgagtgggacaacgagaataccggcgtacgtgtaaggtaaaggctagaacttccacctatcctacaaagtagagtgacgtaccaaggaacgtccaagttccgtcccttttacgtcgtacagtaacgttggaacggtagcccgttaggaaacgtacccggaaggtaaccaaccgaacggaccctaaagttccttaactttaccgtaggtacgtaaccttaagggtagtaaggttacgttacggaccgttaaccggttacccttaacccggtaccttcggtacccgtttaacggggg

SEQ ID NO: 156236 - DNA, 686 bp, Homo sapiens
  misc_feature: GYAE6OF02H9RHM.13.9.A09.1.454.CMB.1.raw
  modified_base (279)..(279): a, c, t, g, unknown or other
  misc_feature (279)..(279): n is a, c, g, or t
  modified_base (348)..(348): a, c, t, g, unknown or other
  misc_feature (348)..(348): n is a, c, g, or t
tcagtcacgtactacacgaccggtgctcgatttagcgagacgcgcaggggctgggagaggagccccagccgtgagattcccaggagtttccacttggtgatcagcactgaacacagaccaccaaccatggagtttgggcttacttgggttttccttgttgctattttaaaaggtgtccaatgtgagctgcagctggtggagtcgtggggggaggttttggtacaggccagggcggtccctgagactctcctgtataacttctggattcaacttggggtnatttatgctatgaactgggtccgcaggctccgagggaggggctgggagtgggtagtttcagttaggganctaattctacagtggatggggaacaaacgagaaactacggccgtcgttacgtaaggtaaaaggcaaggtacttaccgaaccctattcctacgaaaggtacgaagttaggaacgtacccaaaggaacgactacgttcccgttcccttttacgtcgacgtaagtagtaggaacggttacgacccgttaagggaaacccggaccggaacgggaaccaaccgacgaccctaattaccttactttaccgtggttacgtacgttaagggaagttaacggtttaacgttcggaccgttacggttaccccgttaaccggtacccgttcggtaccgtttaacggggg

SEQ ID NO: 156237 - DNA, 634 bp, Homo sapiens
  misc_feature: GYAE6OF02HUZEQ.13.9.A09.1.454.CMB.1.raw
tcagtcacgtactacacgaccggtgctcgatttagcgagacgcgcaggggctgggagaggagccccagccgtgagattcccaggagtttccacttggtgatcagcactgaacacagaccaccaaccatggagtttggcttacttgggttttccttgttgctattttaaaggtgtccaatgtgagctgcagctggtggagtcgtggggggaggttttggtacaggccgaggggccggtccctgagactctcctgtataacttctggattcactttgatgattatgccatgcacgtgggtccgcaagcctccgagggacggcctgggagtggtctcgaggttattaggttggaataggtggtagcgagtaggctagtggcggtactcgtggtggaacggggtccctaattccaacctacttcctaccgacgacgaacaaccgaccaaagaacctccctagtactctagactaaatacgaacacgtcctagagagacgtaggagaccgacggtccttagtattagttagtacgacgtaaacgtacctaaccctaacccgtttacgttacgtttttacggaggtttacggttaaccgttaccggtagggtacggggtacccgtaacgggtaaccccgg

SEQ ID NO: 156238 - DNA, 595 bp, Homo sapiens
  misc_feature: GYAE6OF02IAVAE.13.9.A09.1.454.CMB.1.raw
  modified_base (300)..(300): a, c, t, g, unknown or other
  misc_feature (300)..(300): n is a, c, g, or t
  modified_base (383)..(383): a, c, t, g, unknown or other
  misc_feature (383)..(383): n is a, c, g, or t
  modified_base (415)..(415): a, c, t, g, unknown or other
  misc_feature (415)..(415): n is a, c, g, or t
tcagtcacgtactacacgaccggtgctcgatttagcgagacgcgcaggggctggggagaggagccccagccgtgagattcccaggagtttccacttggtgatcagcactgaacacagaccaccaaccatggagtttgggcttacttgggttttccttgttgctattttaaaggtgtccaatgtgagctgcagctggtggagtcgtgggggaggtttggtacagccgagggcggtcctgagactctcctgtactaacttctggattcaacgttggggtgattatgctatgaactgggtccncaggctccgagggagggctggagtgggtagtttcagttaggagctaattctcatggagtggaacaacgagaacgtacggccgngtacgtaaggtaaacggctagtactccaaccngtactacgaaagagtagttgacgtaccgaaagaagtcaagttccgcctttgagactagtatggagtactccgtaggaaccggtaccgaggacctacgacgtaccaagttaccgttatacgttggtacgacttaaggagtagttattcgactaccgttccacggtacttgaccgttagggg

SEQ ID NO: 156239 - DNA, 627 bp, Homo sapiens
  misc_feature: GYAE6OF02GXZAA.13.9.A09.1.454.CMB.1.raw
  modified_base (275)..(275): a, c, t, g, unknown or other
  misc_feature (275)..(275): n is a, c, g, or t
  modified_base (298)..(298): a, c, t, g, unknown or other
  misc_feature (298)..(298): n is a, c, g, or t
  modified_base (340)..(341): a, c, t, g, unknown or other
  misc_feature (340)..(341): n is a, c, g, or t
  modified_base (347)..(347): a, c, t, g, unknown or other
  misc_feature (347)..(347): n is a, c, g, or t
  modified_base (372)..(372): a, c, t, g, unknown or other
  misc_feature (372)..(372): n is a, c, g, or t
tcagtcacgtactacacgaccggtgctcgatttagcgagacgcgcaggggctgggagaggagccccagcccgtgagattcccaggagtttccacttggtgatcagcactgaacacagaccaccaaccatggagtttgggcttacttgggttttccttgttgctattttaaaaggtgtccaatgtgagctgcagctggtggagtcgtgggggaggtttggtacagccagggcgtcctgagactctcctgtataacttctggattcaacttggggtntattatgctatgaactgggtccncaggctcgaggggagggctggagtgggtagttcagttaggannaattcnatgatggaacaacagaataccggcncggtactaggtaaaagcaagtacttacacctaatccacgtaagagagtagacgtaccgaagaacgctaacgttccctcgttttccgacgacgtacggtaacttagggaacggttacgccgttaagggaaaccggtacccggaaaggtaccgaacgaccgtacgtaataccgttaactttacgtgttacgtaacgttacggaagtagttagttgaccgttaccgttaccgttaccggaaccttggtacgtacgggg

SEQ ID NO: 156240 - DNA, 623 bp, Homo sapiens
  misc_feature: GYAE6OF02GXGKK.13.9.A09.1.454.CMB.1.raw
  modified_base (297)..(297): a, c, t, g, unknown or other
  misc_feature (297)..(297): n is a, c, g, or t
  modified_base (363)..(363): a, c, t, g, unknown or other
  misc_feature (363)..(363): n is a, c, g, or t
tcagtcacgtactacacgaccggtgctcgatttagcgagacgcgcagggggctggggagaggagccccagccgtgagattcccaggagtttccacttggtgatcagcactgaacacagaccaccaaccatggagtttgggcttacttgggttttccttgttgctattttaaaggtgcccagtgtgaggtgcagctggtggagtctggaggaggcttgatccagcctggggggtccctgagactctcctgtgcagcctctgggttcaccgtcagtcacacctacatgagctgggtccncaggctccgagggaaggggctggagtgcgtcttcttttattatagtagtggtagtacatactccgnagactcggtgacggggccattcaccatcctacccagtacgaacaacttaccaaagaaccacgcttacgtttcttacgaaatcgaaacacgtacctgacgacgaccgagtcggacgaccggtccgtagttacgttcgtggtacgaccggaggacggtagtaccggggacccgtaacgggtaaccgttaaccgtaaccgtacgttacgtacgggtaccggttaccggtcgggggaacccgtacggggacccgtaacccgggg

SEQ ID NO: 156241 - DNA, 831 bp, Homo sapiens
  misc_feature: GYAE6OF02IWZSL.13.9.A09.1.454.CMB.1.raw
  modified_base (723)..(723): a, c, t, g, unknown or other
  misc_feature (723)..(723): n is a, c, g, or t
tcagtcacgtactacacgaccggtgctcgatttagcgagacgcgcaggggctggggagaggagccccagccgtgagattcccaggagtttccacttggtgatcagcactgaacacagaccaccaaccatggagtttggcttacttgggttttccttgttgctattttaaaggtgtccaatgtgagctgcagctggtggagtcgtgggggtagtttggtacaggtccgagggtcggtccctggacgtactcttccgtgttactacgttctaggtattacctaacgttggggtataatttagtgtacttatcggtaacgtcgggtaccgaccgtaggccgtacggaggggtaaggggtcgtgggacggttgggttacggttcgtaagttaggcgtaacttaagttcgtagtagttggaacgttagggaaacctaacgtaaggtaacttaccgggacccgtacggttaacgtaaacggtaaaacgggtctaacggttaaccttacgaacccgtattacccggtaacgtaaacgtaacgtaacgttacggtaacgttaaccggaaaggtaaacccgtcgtaaccggtttccgttacccggttttaacgtacggtaacctagggttaacgttcgggtaaaccgtcggtaacgtaccggtaaaccgggtaccggtaaacgacccgttaacgccggtaaacctttaacggtacctttaacggtttaccgngggtttaaccaacggtttaaggtaaacggttaaccgttcggttaagtacccggttaaccggttaccccggtaaccggtttacccttgggttaacccggttacgggggg

SEQ ID NO: 156242 - DNA, 700 bp, Homo sapiens
  misc_feature: GYAE6OF02I9L20.13.9.A09.1.454.CMB.1.raw
  modified_base (261)..(261): a, c, t, g, unknown or other
  misc_feature (261)..(261): n is a, c, g, or t
  modified_base (305)..(305): a, c, t, g, unknown or other
  misc_feature (305)..(305): n is a, c, g, or t
  modified_base (531)..(531): a, c, t, g, unknown or other
  misc_feature (531)..(531): n is a, c, g, or t
tcagtcacgtactacacgaccggtgctcgatttagcgagacgcgcagggggctggggagaggagccccagccgtgagattcccaggagtttccacttggtgatcagcactgaacacagaccaccaaccatggagtttgggcttacttgggttttccttgttgctattttaaaaggtgtccaatgtgagctgcagctggtggagtcgtgggggaggtttggtacagccaggggcggtcctgagactctcctgtataacttcnggtattcaacgttgggtgtattatgcttatgaactcggggtccncaggctccgaggggaagggctggaggttcgggtaggtttcagtttagggagactaagtttcacgattggtacgtaggggaacctaacgaaggtaaacgtacccggccggtacggttaccgtaagggttaaaaacgggccgtaaggtaacttacctaacccgtaattacgtaacgaaacgaggtactaggacgtacccgaaagacgactacgttccgtcctttacgngacagtataggtactacgacgtaggaaccggaaccgacgaacgacaaccggccttaagtacttaacgtttacgagggtactaccggtaaggtaacggttaagtacgtttacggtaccggtaaccgttaccccgtaacgggtaaccccgttggtaccgttaaccgggggg

SEQ ID NO: 156243 - DNA, 171 bp, Homo sapiens
  misc_feature: GYAE6OF01DL2Z7.37.55.E11.1.454.CMB.1.raw
  modified_base (171)..(171): a, c, t, g, unknown or other
  misc_feature (171)..(171): n is a, c, g, or t
tcagtagtgtagatcacgaccggtgctcgatttagcactcgcacgttgggtttggggaagaggaagactgacggtccccaggagttcaggtgctgggcacagcggccctgggctgcctggtcaaggactacttccatctacactactgagcgggctggcaaggcgcatagn

SEQ ID NO: 156244 - DNA, 164 bp, Homo sapiens
  misc_feature: GYAE6OF01B9I1I.37.55.E11.1.454.CMB.1.raw
  modified_base (164)..(164): a, c, t, g, unknown or other
  misc_feature (164)..(164): n is a, c, g, or t
tcagtagtgtagatcacgaccggtgctcgattagcactcgcacgttggttgggaagaggaagactgacggtcccaggagttcaggtgctggcacagcggcctgggctgcctggtcaaggactacttccatctacactactgagcgggctggcaaggcgcatagn

SEQ ID NO: 156245 - DNA, 172 bp, Homo sapiens
  misc_feature: GYAE6OF01B017Y.37.55.E11.1.454.CMB.1.raw
  modified_base (171)..(172): a, c, t, g, unknown or other
  misc_feature (171)..(172): n is a, c, g, or t
tcagtagtgtagatcacgaccggtgctcgatttagcactcgcacgttgggtttggggaagaggaagactgacggtccccaggagttcaggtgctgggcacagcggccctgggctgcctggtcaaggactacttccatctacactactgagcgggctggcaaggcgcatagnn

SEQ ID NO: 156246 - DNA, 173 bp, Homo sapiens
  misc_feature: GYAE6OF01EW09B.37.55.E11.1.454.CMB.1.raw
  modified_base (173)..(173): a, c, t, g, unknown or other
  misc_feature (173)..(173): n is a, c, g, or t
tcagtagtgtagatcacgaccggtgctcgatttagcactcgcacgttgggtttgggggaagaggaagactgacggtcccccaggagttcaggtgctgggcacagcggccctgggctgcctggtcaaggactacttccatctacactactgagcgggctggcaaggcgcatagn

SEQ ID NO: 156247 - DNA, 170 bp, Homo sapiens
  misc_feature: GYAE6OF01AMNSG.37.55.E11.1.454.CMB.1.raw
tcagtagtgtagatcacgaccggtgctcgatttagcactcgcacgttgggtttggggaagaggaagactgacggtccccaggagttcaggtgctgggcacagcggccctgggctgcctggtcaaggactacttccatctacactactgagcgggctggcaaggcgcatag

SEQ ID NO: 156248 - DNA, 194 bp, Homo sapiens
  misc_feature: GYAE6OF01BDP2F.37.55.E11.1.454.CMB.1.raw
  modified_base (172)..(194): a, c, t, g, unknown or other
  misc_feature (172)..(194): n is a, c, g, or t
tcagtagtgtagatcacgaccggtgctcgatttagcactcgcacgttgggtttgggggaagaggaagactgacggtcccccaggagttcaggtgctgggcacagcggccctgggctgcctggtcaaggctacttccatctacactactgagcgggctggcaaggcgcatagnnnnnnnnnnnnnnnnnnnnnnn

SEQ ID NO: 156249 - DNA, 199 bp, Homo sapiens
  misc_feature: GYAE6OF01CSNTE.37.55.E11.1.454.CMB.1.raw
  modified_base (174)..(199): a, c, t, g, unknown or other
  misc_feature (174)..(199): n is a, c, g, or t
tcagtagtgtagatcacgaccggtgctcgatttagcactcgcacgttgggtttgggggaagaggaagactcgacggtcccccaggagttcaggtgctgggcacagcggccctgggctgcctggtcaaggactacttccatctacactactgagcgggctggcaaggcgcatagnnnnnnnnnnnnnnnnnnnnnnnnnn

SEQ ID NO: 156250 - DNA, 185 bp, Homo sapiens
  misc_feature: GYAE6OF01D8M0T.37.55.E11.1.454.CMB.1.raw
  modified_base (173)..(185): a, c, t, g, unknown or other
  misc_feature (173)..(185): n is a, c, g, or t
tcagtagtgtagatcacgaccggtgctcgatttagcactcgcacgttgggtttgggggaagaggaagactgacggtcccccaggagttcaggtgctgggcacagcggccctgggctgcctggtcaaggactacttccatctacactactgagcgggctggcaaggcgcatagnnnnnnnnnnnnn

SEQ ID NO: 156251 - DNA, 177 bp, Homo sapiens
  misc_feature: GYAE6OF01DGHR5.37.55.E11.1.454.CMB.1.raw
  modified_base (173)..(177): a, c, t, g, unknown or other
  misc_feature (173)..(177): n is a, c, g, or t
tcagtagtgtagatcacgaccggtgctcgatttagcactcgcacgttgggtttgggggaagaggaagactgacggtcccccaggagttcaggtgctgggcacagcggccctgggctgcctggtcaaggactacttccatctacactactgagcgggctggcaaggcgcatagnnnnn

SEQ ID NO: 156252 - DNA, 174 bp, Homo sapiens
  misc_feature: GYAE6OF01D62TI.37.55.E11.1.454.CMB.1.raw
  modified_base (173)..(174): a, c, t, g, unknown or other
  misc_feature (173)..(174): n is a, c, g, or t
tcagtagtgtagatcacgaccggtgctcgatttagcactcgcacgttgggtttgggggaagaggaagactgacggtcccccaggagttcaggtgctgggcacagcggccctgggctgcctggtcaaggactacttccatctacactactgagcgggctggcaaggcgcatagnn

SEQ ID NO: 156253 - DNA, 174 bp, Homo sapiens; identical to SEQ ID NO: 156252
  misc_feature: GYAE6OF01BGIWF.37.55.E11.1.454.CMB.1.raw
  modified_base (173)..(174): a, c, t, g, unknown or other
  misc_feature (173)..(174): n is a, c, g, or t

SEQ ID NO: 156254 - DNA, 199 bp, Homo sapiens
  misc_feature: GYAE6OF01BL4LA.37.55.E11.1.454.CMB.1.raw
  modified_base (172)..(172): a, c, t, g, unknown or other
  misc_feature (172)..(172): n is a, c, g, or t
  modified_base (174)..(199): a, c, t, g, unknown or other
  misc_feature (174)..(199): n is a, c, g, or t
tcagtagtgtagatcacgaccggtgctcgatttagcactcgcacggttgggttgggggaagaggaagactgacggtcccccaggagttcaggtgctgggcacagcggcctgggctgcctggtcaaggactacttctatctacactactgagcgggctggcaaggcgcatagncnnnnnnnnnnnnnnnnnnnnnnnnnn

SEQ ID NO: 156255 - DNA, 174 bp, Homo sapiens; identical to SEQ ID NO: 156252
  misc_feature: GYAE6OF01DPJX5.37.55.E11.1.454.CMB.1.raw
  modified_base (173)..(174): a, c, t, g, unknown or other
  misc_feature (173)..(174): n is a, c, g, or t

SEQ ID NO: 156256 - DNA, 637 bp, Homo sapiens
  misc_feature: GYAE6OF01CKVBY.37.55.E11.1.454.CMB.1.raw
  modified_base (208)..(208): a, c, t, g, unknown or other
  misc_feature (208)..(208): n is a, c, g, or t
  modified_base (211)..(211): a, c, t, g, unknown or other
  misc_feature (211)..(211): n is a, c, g, or t
  modified_base (213)..(213): a, c, t, g, unknown or other
  misc_feature (213)..(213): n is a, c, g, or t
  modified_base (218)..(218): a, c, t, g, unknown or other
  misc_feature (218)..(218): n is a, c, g, or t
  modified_base (224)..(224): a, c, t, g, unknown or other
  misc_feature (224)..(224): n is a, c, g, or t
  modified_base (227)..(227): a, c, t, g, unknown or other
  misc_feature (227)..(227): n is a, c, g, or t
  modified_base (234)..(234): a, c, t, g, unknown or other
  misc_feature (234)..(234): n is a, c, g, or t
  modified_base (236)..(236): a, c, t, g, unknown or other
  misc_feature (236)..(236): n is a, c, g, or t
  modified_base (242)..(242): a, c, t, g, unknown or other
  misc_feature (242)..(242): n is a, c, g, or t
tcagtagtgtagatcacgaccggtgctcgatttagcactcgcacgttgggttggggggaagaggaaggactcgacggtcccccagggagttttcagggtgttctgggtcgacagcggcccgtgggctagcctggtcaaaggtacctaccttccagtcgttacgacttacgtgagtcggggctttggtcaagggctacttaaagtagcngtntnagtgnagctgntgngtgtggngngtgtgnggcgggtcgtgagctctctgtgagctcgtgtctctacttagactagtgtcgcagtcgtcgtcggtcgcgcgcgtcgagggagggcggtggtggtggtcgtcgtagttagttagttggtaggtaggtagtagacacgtagtacgtacgtacgacgtacgtacggtacggtacggtacggtacgtaccgtactacgtacgacgacgtaactaactaccaacgacgacgtacgtacgtagttagttacgtactacgtagtacgtaacgacgtacgtagacgacgacggacgacgacgacgtatatattattagtacgtacgttacgtttcgtttagttacgttacgttactttaccttaccgttacgtacgtaccgtaccggtcggtaccggtaccgg

SEQ ID NO: 156257 - DNA, 556 bp, Homo sapiens
  misc_feature: GYAE6OF01DBN5E.37.55.E11.1.454.CMB.1.raw
tcagtagtgtagatcacgaccggtgctcgatttagcactcgcacgttgggtttgggggaagaggaagactgacggtcccccaggagttcaggtgctgggcacggtgggcatgtgtgagttttgtcacaagatttgggctcaactctcctgtgcagcctctggattcacctttggcagctttgccatgagctgggtccgccaggctccagggaaggggctggaatggggtctcagccattagtagtagtggtggaagcacgtactacgctgactccgtgaagggccgttcgccctctccagagacaactccaacaacacgctgtctctgcaaacttacagcctgagagacgaggacacggccgtatattactgtgacgaaggaaggtctagcagtgcctgtactccactactatatggacgtcgtgggacaaggatcgcgtcaccgtctcctcacgcctccaccgaacggcccacgtccggttcccttcccccgtcggccctacccctccctaccaacgacgccaccgtccgtcggggccacgcggccggtccccgg

SEQ ID NO: 156258 - DNA, 175 bp, Homo sapiens
  misc_feature: GYAE6OF01CK3Z2.37.55.E11.1.454.CMB.1.raw
  modified_base (173)..(175): a, c, t, g, unknown or other
  misc_feature (173)..(175): n is a, c, g, or t
tcagtagtgtagatcacgaccggtgctcgatttagcactcgcacgttgggtttgggggaagaggaagactgacggtcccccaggagttcaggtgctgggcacagcggccctgggctgcctggtcaaggactacttccatctacactactgagcgggctggcaaggcgcatagnnn

SEQ ID NO: 156259 - DNA, 175 bp, Homo sapiens
  misc_feature: GYAE6OF01CJHWI.37.55.E11.1.454.CMB.1.raw
  modified_base (171)..(175): a, c, t, g, unknown or other
  misc_feature (171)..(175): n is a, c, g, or t
tcagtagtgtagatcacgaccggtgctcgatttagcactcgcacgttgggtttggggaagaggaagactgacggtccccaggagttcaggtgctgggcacagcggccctgggctgcctggtcaaggactacttccatctacactactgagcgggctggcaaggcgcatagnnnnn

SEQ ID NO: 156260 - DNA, 173 bp, Homo sapiens; identical to SEQ ID NO: 156246
  misc_feature: GYAE6OF01D7K8O.37.55.E11.1.454.CMB.1.raw
  modified_base (173)..(173): a, c, t, g, unknown or other
  misc_feature (173)..(173): n is a, c, g, or t

SEQ ID NO: 156261 - DNA, 173 bp, Homo sapiens; identical to SEQ ID NO: 156246
  misc_feature: GYAE6OF01A1KX4.37.55.E11.1.454.CMB.1.raw
  modified_base (173)..(173): a, c, t, g, unknown or other
  misc_feature (173)..(173): n is a, c, g, or t

SEQ ID NO: 156262 - DNA, 175 bp, Homo sapiens; identical to SEQ ID NO: 156258
  misc_feature: GYAE6OF01DAV3R.37.55.E11.1.454.CMB.1.raw
  modified_base (173)..(175): a, c, t, g, unknown or other
  misc_feature (173)..(175): n is a, c, g, or t

SEQ ID NO: 156263 - DNA, 559 bp, Homo sapiens
  misc_feature: GYAE6OF01D8M8N.37.55.E11.1.454.CMB.1.raw
tcagtagtgtagatcacgaccggtgctcgatttagcactcgcacgttgggtttgggggaagaggaagactgacggtcccccaggagttcaggtgctgggcacggtgggcatgtgtgagtttttgtcacaagatttgggctcaactctcctgtgcagcctctggattcacctttggcagctttgccatgagctgggtccgccaggctccagggaaggggctggaatgggtctcagccattagtagtagtggtggaagcacgtactacgctgactccgtgaagggccggttcgccctctccagagacaactccaaacaacacgctgtctctgcaacttaacagcctgagagacgaggacacggccgtatattactgtacgcgaaaggaaggtctagcagtgcctggtactcccactactatatggacgtcgtgggacaaaggaatcgcggtcaccgtctcctcacgtcctcccaccgaacggcccacgtccggtccttccccctggccacccctccctaccacgacgcacccgtcgtcggggaccaccgaggcggtcccgg

SEQ ID NO: 156264 - DNA, 534 bp, Homo sapiens
  misc_feature: GYAE6OF01EXB51.37.55.E11.1.454.CMB.1.raw
  modified_base (370)..(370): a, c, t, g, unknown or other
  misc_feature (370)..(370): n is a, c, g, or t
  modified_base (488)..(488): a, c, t, g, unknown or other
  misc_feature (488)..(488): n is a, c, g, or t
  modified_base (496)..(496): a, c, t, g, unknown or other
  misc_feature (496)..(496): n is a, c, g, or t
tcagtagtgtagatcacgaccggtgctcgatttagcactcgcacgttgggtttgggggaagaggaagactgacggtcccccaggagttcaggtgctgggcacggtgggcatgtgtgagttttgtcacaagatttgggctcaactctcctgtgcagcctctggattcacctttggcagctttgccatgagctgggtccgccaggctccagggaaggggctggaatgggtctcagccattagtagtagtggtggaagcacgtactacgctgactccgtgaagggccgttcgccctctccagagacaactccaacaacacgctgtctctgcaacttaacagcctgagagacgaggacacggccgtatattacngtgcgaaaggagggtctagcagtgcctggtactcccactactatatggacgtctgggcaaaggaatcgcggtcaccgtctcctcagcctccaccaaggcccatcgtcttcccctgccncccctccnccaagacgcaccctcgcggggaccacgagccggtcccg

SEQ ID NO: 156265 - DNA, 174 bp, Homo sapiens; identical to SEQ ID NO: 156252
  misc_feature: GYAE6OF01CEW8N.37.55.E11.1.454.CMB.1.raw
  modified_base (173)..(174): a, c, t, g, unknown or other
  misc_feature (173)..(174): n is a, c, g, or t

SEQ ID NO: 156266 - DNA, 177 bp, Homo sapiens; identical to SEQ ID NO: 156251
  misc_feature: GYAE6OF01DQ45U.37.55.E11.1.454.CMB.1.raw
  modified_base (173)..(177): a, c, t, g, unknown or other
  misc_feature (173)..(177): n is a, c, g, or t

SEQ ID NO: 156267 - DNA, 602 bp, Homo sapiens
  misc_feature: GYAE6OF01DPD7C.37.55.E11.1.454.CMB.1.raw
  modified_base (347)..(347): a, c, t, g, unknown or other
  misc_feature (347)..(347): n is a, c, g, or t
  modified_base (379)..(379): a, c, t, g, unknown or other
  misc_feature (379)..(379): n is a, c, g, or t
tcagtagtgtagatacacgaccggtgctcgatttagcactcgcacgttgggtttggggggaaggaggaagactgacggtcccccaggagttcaggtgctgggcacggtgggcatgtgtgagttttgtcacaagatttgggctcaactctcctgtgcagcctctggattcacctttggcagctttgccatgagctgggtccgccaggctccgaggggaaggggctgggaatgggtctcagccattagtagtagtggtggaagcacgtactacgctgactccgtgaacgggccgttcgccctctccagacgacaactccaacaacacgctgtctctgactaacttaacngcctgagagacgaggacacggcgtatattacngtgcgaaaggaggtctagcagtcgctcggtactcccaactactatacgtggacgtcgtagggacgaaaggagtcggcggtaccaccggttcctacctcacgccctaccgaccgaacggccctaacgtccggtcccttcccccgtcggccctacccccgttccctacccaaacggaccgaccctacccgtccggtcggggaccaaccgcggcccgggtccccgg

SEQ ID NO: 156268 - DNA, 198 bp, Homo sapiens
  misc_feature: GYAE6OF01A2B9K.37.55.E11.1.454.CMB.1.raw
  modified_base (173)..(198): a, c, t, g, unknown or other
  misc_feature (173)..(198): n is a, c, g, or t
tcagtagtgtagatcacgaccggtgctcgatttagcactcgcacgttgggtttggggggaagaggaagactgacggtcccccaggagttcaggtgctgggcacagcggccctgggctgcctggtcaaggctacttccatctacactactgagcgggctggcaaggcgcatagnnnnnnnnnnnnnnnnnnnnnnnnnn

SEQ ID NO: 156269 - DNA, 615 bp, Homo sapiens
  misc_feature: GYAE6OF01CVOZ1.37.55.E11.1.454.CMB.1.raw
  modified_base (163)..(163): a, c, t, g, unknown or other
  misc_feature (163)..(163): n is a, c, g, or t
  modified_base (169)..(170): a, c, t, g, unknown or other
  misc_feature (169)..(170): n is a, c, g, or t
  modified_base (173)..(173): a, c, t, g, unknown or other
  misc_feature (173)..(173): n is a, c, g, or t
  modified_base (176)..(177): a, c, t, g, unknown or other
  misc_feature (176)..(177): n is a, c, g, or t
  modified_base (179)..(179): a, c, t, g, unknown or other
  misc_feature (179)..(179): n is a, c, g, or t
  modified_base (181)..(181): a, c, t, g, unknown or other
  misc_feature (181)..(181): n is a, c, g, or t
  modified_base (183)..(183): a, c, t, g, unknown or other
  misc_feature (183)..(183): n is a, c, g, or t
  modified_base (185)..(186): a, c, t, g, unknown or other
  misc_feature (185)..(186): n is a, c, g, or t
  modified_base (188)..(188): a, c, t, g, unknown or other
  misc_feature (188)..(188): n is a, c, g, or t
  modified_base (196)..(197): a, c, t, g, unknown or other
  misc_feature (196)..(197): n is a, c, g, or t
  modified_base (203)..(203): a, c, t, g, unknown or other
  misc_feature (203)..(203): n is a, c, g, or t
  modified_base (206)..(206): a, c, t, g, unknown or other
  misc_feature (206)..(206): n is a, c, g, or t
  modified_base (209)..(209): a, c, t, g, unknown or other
  misc_feature (209)..(209): n is a, c, g, or t
  modified_base (221)..(221): a, c, t, g, unknown or other
  misc_feature (221)..(221): n is a, c, g, or t
  modified_base (224)..(224): a, c, t, g, unknown or other
  misc_feature (224)..(224): n is a, c, g, or t
  modified_base (227)..(227): a, c, t, g, unknown or other
  misc_feature (227)..(227): n is a, c, g, or t
  modified_base (232)..(232): a, c, t, g, unknown or other
  misc_feature (232)..(232): n is a, c, g, or t
  modified_base (241)..(241): a, c, t, g, unknown or other
  misc_feature (241)..(241): n is a, c, g, or t
  modified_base (260)..(260): a, c, t, g, unknown or other
  misc_feature (260)..(260): n is a, c, g, or t
  modified_base (311)..(311): a, c, t, g, unknown or other
  misc_feature (311)..(311): n is a, c, g, or t
tcagtagtgtagatcacgaccggtgctcgatttagcactcgcacgttgggttgggggaagaggagactgacggtccccaggagttcaggtgctgggcacagcggcctgggctgcctggtcaaggctacttccatctacactactgagcgggctggcaagggcncatagnnacnctnntnancngnngnctcgcagnntcactncancgnactagctcactntcnctnacacncggacttgnttacgcatccgagccactngacgcgagctttcgaccgtggccaggcttaccattaccgtacgccggttanaccggtttaggaccggtttagtaaaacccggtacgtacccgggtaaaaagggtacctaaaaaggtaccgggtacccgtacgtaaaaccggtccttttaccgtacgtacgtacgtacgtacgtacgtacgtacgtacgtacgtacgtacgtacgtacgtacgtacgtacgtacgtacgtacgtacgtacgtacgtacgtacgtacgtacgtacgtacgtacgtacgtacgtacgtacgtacgtacgtacgtacgtacgtagtacgtacgtacgtacgtacgtacgtactactacgtcgtcgtacg

SEQ ID NO: 156270 - DNA, 568 bp, Homo sapiens
  misc_feature: GYAE6OF01BYZGG.37.55.E11.1.454.CMB.1.raw
  modified_base (340)..(340): a, c, t, g, unknown or other
  misc_feature (340)..(340): n is a, c, g, or t
  modified_base (370)..(370): a, c, t, g, unknown or other
  misc_feature (370)..(370): n is a, c, g, or t
tcagtagtgtagatcacgaccggtgctcgatttagcactcgcacgttgggtttggggggaagaggaagactgacggtccccccaggagttcaggtgctgggcacggtgggcatgtgtgagttttgtcacaagatttgggctcaactctcctgtgcagcctctggattcacctttggcagctttgccatgagctgggtccgccaggctccagggaaggggctggaatgggtctcagccattagtagtagtggtggaagcacgtactacgctgactccgtgaagggccgttcgccctctccagagacaactccaaacaacacgctgtctctgcaacttaacngcctgagagacgagacacggctatattacngtgacgaaggaaggtctagcagtgcctgtactccactactatagtgacgtcgtgggacgaaggactcgcgtaccgaccgtcctcctcacgtccctaccgacccaacgggcccacgtccggtcccttcccccgtcggtcccgacccctccctacccgaacgacgccacctcggtcggggaccacgcggcccggtcccgg

SEQ ID NO: 156271 - DNA, 705 bp, Homo sapiens
  misc_feature: GYAE6OF01DDFV1.37.55.E11.1.454.CMB.1.raw
tcagtagtgtagatcacgaccggtgctcgatttagcactcgcacgttgggtttggggggaagaggaagactgacggtccccccaggagttcaggtgctgggcacggtgggcatgtgtgagttttgtcacaagatttgggctcaactctcctgtgcagcctctggattcacctttggcagctttgccatgagcgtgggtccgccaggcctccgaggggaagggctggaatgggtctcgagcctattagtagtaggtggtaggaagcacgtactacgctgacgtccgtggaacgggtccgttcgccctctccagacgaccaactaccaacaacacgtctgtcctctagaccaacttaacacgcctagagagacgacgacgacggaccgtatacttacgtggtcgacggaaggtaacggtctaggcgtaggtcgaccgttacggtacctaccctaacttaacgttaacgtacgtacggtacggtcgtacggggaacgaaaacgggtacgtccggtaccggttccgtaacccgttcctacccgttaccgaccgtaccccttaccccgaacccggaaaccgggtccccaaccggttcccggttaccccttcccccgtcggacccccctaccccgttaccctacccgtaacggtacccgaccccgtaccgttccgggtaccggggacccaccggcgggcccggtccccggg

SEQ ID NO: 156272 - DNA, 559 bp, Homo sapiens
  misc_feature: GYAE6OF01B729X.37.55.E11.1.454.CMB.1.raw
  modified_base (337)..(337): a, c, t, g, unknown or other
  misc_feature (337)..(337): n is a, c, g, or t
  modified_base (369)..(369): a, c, t, g, unknown or other
  misc_feature (369)..(369): n is a, c, g, or t
tcagtagtgtagatcacgaccggtgctcgatttagcactcgcacgttgggtttgggggaagaggaagactgacggtcccccaggagttcaggtgctgggcacggtgggcatgtgtgagttttgtcacaagatttgggctcaactctcctgtgcagcctctggattcacctttggcagctttgccatgagctgggtccgccaggctccagggaaggggctggaatgggtctcagccattagtagtagtggtggaagcacgtactacgctgactccgtgaagggccggttcgcctctccagagacaactccaacaacacgctgtctctgcaacttaacngcctgagagacgaggacacggcctatattacngtgacgaaggaggtctagcagtgctgtactccactactatatgacgtcgtgggacgaaaggagtacgcggtaccgaccgtctcctacacgtccctaccaccgaacgggcccaacgtccggtccttcccccgtcggccctaccctccctaccaacgacgccacctcgtcggggaccacgagccggtcccgg

SEQ ID NO: 156273 - DNA, 553 bp, Homo sapiens
  misc_feature: GYAE6OF01CP3H4.37.55.E11.1.454.CMB.1.raw
  modified_base (339)..(339): a, c, t, g, unknown or other
  misc_feature (339)..(339): n is a, c, g, or t
tcagtagtgtagatcacgaccggtgctcgatttagcactcgcacgttgggtttggggggaagaggaagactgacggtccccccaggagttcaggtgctgggcacggtgggcatgtgtgagttttgtcacaagatttgggctcaactctcctgtgcagcctctggattcacctttggcagctttgccatgagctgggtccgccaggctccgaggggaaggggctggaatgggtctcagccattagtagtagtggtggaagcacgtactaagctgactccgtgaagggccgtcgcctctccagagacaactcaacaacacgctgtctctgacaacttaacngcctgagagacgaggacacggcgtatatactgtgacggaaggaaggtcagcgagtcgctcggtactcccactactatatggacgtcgtgggacgaaaggatcgcgtccgaccgtctcctcacgtccctaccaccgacggcccacgtcgtccctccccgtgccctccctccaccgacgaccgccaccgtcgtcggggaccacgcggccgtcccgg

SEQ ID NO: 156274 - DNA, 173 bp, Homo sapiens; identical to SEQ ID NO: 156246
  misc_feature: GYAE6OF01AU2DJ.37.55.E11.1.454.CMB.1.raw
  modified_base (173)..(173): a, c, t, g, unknown or other
  misc_feature (173)..(173): n is a, c, g, or t

SEQ ID NO: 156275 - DNA, 575 bp, Homo sapiens
  misc_feature: GYAE6OF01EIBQB.37.55.E11.1.454.CMB.1.raw
  modified_base (395)..(395): a, c, t, g, unknown or other
  misc_feature (395)..(395): n is a, c, g, or t
tcagtagtgtagatcacgaccggtgctcgatttagcactcgcacgttgggtttgggctgaactggctttttcttgtggctattttaaaaggtgtccagtgtgaggtgcagctgtcggagtctgggggaggcttggtacagcctggggggtccctgacactctcctgtgcagcctctggattcacctttggcagctttgccatgagctgggtccgccaggctccaggggaaggggctggaatgggtctcagccattagtagtagtggtggaagcacgtactacgctgactccgtggaacgggccggttcgccctctccgagacgacaactccaaacaacacgctgtctctgacaaacttaacagcctgagagacgaggacacggccgtatattacngtagacgaaggaaggtctagcagtgctgtactcccatactatatgacgtcgtgggacaaaggatcggcggtcaccgtctcctcacgccctccaacccgacgggccccagtccggttacccttcccccgtcggccctacccctccctacccaaacgaccgacctacccgtcggtacggggg

SEQ ID NO: 156276 - DNA, 552 bp, Homo sapiens
  misc_feature: GYAE6OF01EAGTP.37.55.E11.1.454.CMB.1.raw
  modified_base (373)..(373): a, c, t, g, unknown or other
  misc_feature (373)..(373): n is a, c, g, or t
  modified_base (388)..(388): a, c, t, g, unknown or other
  misc_feature (388)..(388): n is a, c, g, or t
  modified_base (540)..(540): a, c, t, g, unknown or other
  misc_feature (540)..(540): n is a, c, g, or t
tcagtagtgtagatcacgaccggtgctcgatttagcactcgcacgttgggtttgggggaagaggaagactgacggtccccccaggagttcaggtgctgggcacggtgggcatgtgtgagttttgtcacaagatttgggctcaactctcctgtgcagcctctggattcacctttggcagctttgccatgagctgggtccgccaggctccgagggaaggggctggaatgggtctcagccattagtagtagtggtggaagcacgtactacgctgactccgtgaagggccgttcgcctctccagagacaactccaacacacgctgtctctgactaacttaacagcctgagagacgaggacactgccgtatatactgngacgaagaggtcagnagtgcgtggtacctccactactatagtggacgtcgtgggacaaggatcgcggtcaccgtcctcctcacgcctccaccgacggcccactccggtccttccccgtcgccctacccctcccgtaccaacgacgaccgtaccgtcgtacggggccncgcggtcccggg

SEQ ID NO: 156277 - DNA, 175 bp, Homo sapiens; identical to SEQ ID NO: 156258
  misc_feature: GYAE6OF01C18PU.37.55.E11.1.454.CMB.1.raw
  modified_base (173)..(175): a, c, t, g, unknown or other
  misc_feature (173)..(175): n is a, c, g, or t

SEQ ID NO: 156278 - DNA, 567 bp, Homo sapiens
  misc_feature: GYAE6OF01DH1ZQ.37.55.E11.1.454.CMB.1.raw
tcagtagtgtagatcacgaccggtgctcgatttagcactcgcacgttgggtttggggggaagaggaagactgacggtcccccaggagttcaggtgctgggcacggtgggcatgtgtgagttttgtcacaagatttgggctcaactctcctgtgcagcctctggattcacctttggcagctttgccatgagctgggtccgccaggctccgaggggaaggggctggaatgggtctcagccattagtagtagtggtggaagcacgtactacgctgactccgtgaagggccgttcgccctctccagagacaactccaacaacacgctgtctctgacaaacttaacagcctgagagacgaggacacggcgtaatatactgtgacgaaggaggtctagcagtgctgtactcccactactatatggacgtcgtgggacaaaggaagtcggcgtcaccgtctcctcgacgtcctaccgaccgaacggcccacgtcccgtccttcccccgtggccctaccccgtccctaccgaacgacgccaccgtccggtacggggccacgcggcccggtcccgg

SEQ ID NO: 156279 - DNA, 174 bp, Homo sapiens; identical to SEQ ID NO: 156252
  misc_feature: GYAE6OF01A1SP5.37.55.E11.1.454.CMB.1.raw
  modified_base (173)..(174): a, c, t, g, unknown or other
  misc_feature (173)..(174): n is a, c, g, or t

SEQ ID NO: 156280 - DNA, 573 bp, Homo sapiens
  misc_feature: GYAE6OF01DXQOG.37.55.E11.1.454.CMB.1.raw
  modified_base (297)..(297): a, c, t, g, unknown or other
  misc_feature (297)..(297): n is a, c, g, or t
  modified_base (371)..(371): a, c, t, g, unknown or other
  misc_feature (371)..(371): n is a, c, g, or t
tcagtagtgtagatcacgaccggtgctcgatttagcactcgcacgttgggtttggggggaagaggaagactgacggtcccccaggagttcaggtgctgggcacggtgggcatgtgtgagttttgtcacaagatttgggctcaactctcctgtgcagcctctggattcacctttggcagctttgccatgagctgggtccgccaggctccgagggaaggggctggaatgggtctcagccattagtagtagtggtggaagcacgtactacgctgactccgtgaagggccggttcgccctntccagagacaactccaacaacacgctgtctctgcaacttaacagcctgagagacgaggacacggctatattacngtgacgaaggaggtctagcagtgctggtactcccactactatatggacgtcgtgggacgaaaggacgtcgcggtcaccgtctcctcacgtcctaccaccgaacggcccacgtccggtcccttcccccgtcggccctaccccttccctacccgaacgaccgaccacccgtccggtcggggaccaccgcggcccggtccccggg

SEQ ID NO: 156281 - DNA, 175 bp, Homo sapiens
  misc_feature: GYAE6OF01EOILM.37.55.E11.1.454.CMB.1.raw
  modified_base (174)..(175): a, c, t, g, unknown or other
  misc_feature (174)..(175): n is a, c, g, or t
tcagtagtgtagatcacgaccggtgctcgatttagcactcgcacgttgggtttggggggaagaggaagactgacggtcccccaggagttcaggtgctgggcacagcggccctgggctgcctggtcaaggactacttccatctacactactgagcgggctggcaaggcgcatagnn

SEQ ID NO: 156282 - DNA, 649 bp, Homo sapiens
  misc_feature: GYAE6OF01DS04G.37.55.E11.1.454.CMB.1.raw
  modified_base (301)..(301): a, c, t, g, unknown or other
  misc_feature (301)..(301): n is a, c, g, or t
tcagtagtgtagatcacgaccggtgctcgatttagcactcgcacgttagggtttagggggaagaggaagaactcgacggtcccccaggagttcaggtgctgggcacggtgggcatgtgtcgagttttgtcacaagatttgggctcaactctcctgtgcagcctctggattcacctttggcagctttgccatgagctgggtccgccaggctccgagggagggctggaacgtgggtctcagccattagtagtagtggtggaagcacgtactacgctgactccgtgaacgggccgttcgccctntccagagacaactccaacaaccacgctcgtctctgacaacttacagcctagagagacgaggacacggtccgtagtacttacgtgtcgaccggtaaaggtaacgggtctaaggccgtagtcgtccgtacgggtactcccctaacttacctaactaacgtcggacgtcggtcggggacaaaggaacgtcgtacggtccgtaccgtccttccgtcgacgtcccttacccaccgtaacgggccccaagttcccggttaccgttcccccgtggtcccgtaccccgttcccttaccgaacgaccgcccgacccgttccggtacggggacccacggtccggtcccggtaccccgg

SEQ ID NO: 156283 - DNA, 559 bp, Homo sapiens
  misc_feature: GYAE6OF01DJUYL.37.55.E11.1.454.CMB.1.raw
tcagtagtgtagatcacgaccggtgctcgatttagcactcgcacgttgggtttggggggaagaggaagactgacggtcccccaggagttcaggtgctgggcacggtgggcatgtgtgagttttgtcacaagatttgggctcaactctcctgtgcagcctctggattcacctttggcagctttgccatgagctgggtccgccaggctccgagggaaggggctggaatgggtctcagccattagtagtagtggtggaagcacgtactacgctgactccggtgaacgggccggttcgccctctccagacgaccaactccaacaacacgctgtctctgacaacttaacagcctgagagacgaggacacggctatacttactgtgcgagagatcgagacggagtatagcagcagctctgactacgtcgggaccgacggacccgtcggtcaccgtcctcctcctacgcctcccgaccgacggcccacgtccgtccttccccgtcggccaccccgtcctacccgaacgcgccaccgtcgtcggggaccacgcgccggcccgtcggg

SEQ ID NO: 156284 - DNA, 630 bp, Homo sapiens
  misc_feature: GYAE6OF01BMQWM.37.55.E11.1.454.CMB.1.raw
  modified_base (249)..(249): a, c, t, g, unknown or other
  misc_feature (249)..(249): n is a, c, g, or t
  modified_base (328)..(328): a, c, t, g, unknown or other
  misc_feature (328)..(328): n is a, c, g, or t
  modified_base (337)..(337): a, c, t, g, unknown or other
  misc_feature (337)..(337): n is a, c, g, or t
  modified_base (348)..(348): a, c, t, g, unknown or other
  misc_feature (348)..(348): n is a, c, g, or t
  modified_base (363)..(363): a, c, t, g, unknown or other
  misc_feature (363)..(363): n is a, c, g, or t
  modified_base (397)..(397): a, c, t, g, unknown or other
  misc_feature (397)..(397): n is a, c, g, or t
tcagtagtgtagatcacgaccggtgctcgatttagcactcgcacgttgggtttgggctgaactggctttttcttgtggctattttaaaaggtgtccagtgtgaggtgcagctgtcggagtctgggggaggcttggtacaggccgtggggggtccctgacactctcctgtgcagcctctggattcacctttggcagctttgccatgagctgggccgccaggctccgagggaaggggctggaatgggtctnagccagttagtagtagtggaggaagcacgtacacgctgactccgtgaacgggccgttcgcctcgtaccagacgacaacnccaacaacncgctgtctctnctaaactaacagccngagagacgaggacacggaccgtattacttaacgnggtacgaacggaaggagtacagcaggtcgacgtacgacctaccctactacgtatagtacggtacgtacggacgggaacaaaggactcggtaccggtacctaccgtctaccgtacgaccgtacccgaccgaaccggaaccggtacccgtaccgttcccggtaccccttacccccggcggtaccccgtaccccttacccgtaaccgaacgaccgtacctaccggtcgggtacggg

SEQ ID NO: 156285 - DNA, 556 bp, Homo sapiens
  misc_feature: GYAE6OF01EMEMV.37.55.E11.1.454.CMB.1.raw
  modified_base (340)..(340): a, c, t, g, unknown or other
  misc_feature (340)..(340): n is a, c, g, or t
  modified_base (371)..(371): a, c, t, g, unknown or other
  misc_feature (371)..(371): n is a, c, g, or t
tcagtagtgtagatcacgaccggtgctcgatttagcactcgcacgttgggtttgggggaagaggaagactgacggtcccccaggagttcaggtgctgggcacggtgggcatgtgtgagttttgtcacaagatttgggctcaactctcctgtgcagcctctggattcacctttggcagctttgccatgagctgggtccgccaggctccgaggggaagggctggaatgggtctcagccattagtagtagtggtggaagcacgtactacgctgactccgtgaagggccgttcgccctctccagagacaactccaaacaacacgctgtctctgcaaacttaacngcctgagagacgaggacacggctatattacngtgcgaaaggaggtctagcagtgcctgtactccactactatagtgacgtcgtgggacaaaggatcgcggtcaccgtctcctcacgtcctaccgaccgaacggcccacgtccggtccttcccccgtcggccctacccctccctaccgaacgacgccaccgtcgtcggggcaccgcgccggtcccgg

SEQ ID NO: 156286 - DNA, 185 bp, Homo sapiens
  misc_feature: GYAE6OF01BWON0.37.55.E11.1.454.CMB.1.raw
  modified_base (171)..(185): a, c, t, g, unknown or other
  misc_feature (171)..(185): n is a, c, g, or t
tcagtagtgtagatcacgaccggtgctcgatttagcactcgcacgttgggtttgggggaagaggaagactgacggtcccccaggagttcaggtgctgggcacagcggccctggctgcctggtcaaggctacttccatctacactactgagcgggctggcaaggcgcatagnnnnnnnnnnnnnnn

SEQ ID NO: 156287 - DNA, 651 bp, Homo sapiens
  misc_feature: GYAE6OF01BGPZ8.37.55.E11.1.454.CMB.1.raw
  modified_base (256)..(256): a, c, t, g, unknown or other
  misc_feature (256)..(256): n is a, c, g, or t
tcagtagtgtagatcacgaccggtgctcgatttagcactcgcacgttgggtttgggggaagaggaagactgacggtcccccaggagttcaggtgctgggcacggtgggcatgtgtgagttttgtcacaagatttgggctcaactctcctgtgcagcctctggattcacctttggcagctttgccatgagctgggtccgccaggcctccaggggaagggctggaatgggtctcagccattagtagtagtggtggaancaacgtactacgctgactccggtgaagggccggttcgccctctccagacgacaactccaaacaacacgctcgtctctcgacaacttaacagcctgagagacgaggacacggccgtaatacttacgtgtcgacggtaaagggaacgggtctaggacgtagtcgccgttacggtacctaccctacctaactagtacgtcggtacgtacggtacggggacgaaaggtaacgtacggtaccggtaccgtacccgttcctcctaccgacgtcccgtacccgaccgaacgggcccacgttcccggtacccgttccccgtccggtccctacccctcccgtacccgtaaccgacgtcccgacccgtccgtaccggggacccaccggccggcccggtccccggg

SEQ ID NO: 156288 - DNA, 187 bp, Homo sapiens
  misc_feature: GYAE6OF01A6I7W.37.55.E11.1.454.CMB.1.raw
  modified_base (170)..(170): a, c, t, g, unknown or other
  misc_feature (170)..(170): n is a, c, g, or t
  modified_base (175)..(187): a, c, t, g, unknown or other
  misc_feature (175)..(187): n is a, c, g, or t
tcagtagtgtagatcacgaccggtgctcgatttagcactcgcacggttgggtttggggggaagaggaagactgaccggtcccccaggagttcaggtgctgggcacagcggccctgggctgcctggtcaaggctacttccatctacactactgagcgggctggcaaggcgnatagnnnnnnnnnnnnn

SEQ ID NO: 156289 - DNA, 614 bp, Homo sapiens
  misc_feature: GYAE6OF01BK3JI.37.55.E11.1.454.CMB.1.raw
  modified_base (358)..(358): a, c, t, g, unknown or other
  misc_feature (358)..(358): n is a, c, g, or t
tcagtagtgtagatcacgaccggtgctcgatttagcactcgcacgttgggtttgggggaagaggaagactgacggtcccccaggagttcaggtgctgggcacggtgggcatgtgtgagttttgtcacaagatttgggctcaactctcctgtgcagcctctggattcacctttggcagctttgccatgagctgggtccgccaggctccgaggggaagggctaggaatgggtctcagccattagtagtagtggtggaagcacgtactacgctgactccgtgaacggccgttcgcctctccagagacaactccaaacacacgctgtctctgactaaactaacagcctgagacgacgagacncggactatattacgtgtacgacggaaggaaggtctaggcgagtcgccgtcggtacctcctaactactatacgtcggtacgtcgtaggggacaaacggagtcgtcgtaccaccgtcctccgtcgaccgtccctaccgaaccgaaccggccctacgtccgttcccgttccccgtcgtaccccgtaccctccctaccggaaccgtccgacccgtaacccgtcggtaccggggaccaaccgtccgggcccggtacccggg

SEQ ID NO: 156290 - DNA, 578 bp, Homo sapiens
  misc_feature: GYAE6OF01ENTZ4.37.55.E11.1.454.CMB.1.raw
tcagtagtgtagatcacgaccggtgctcgatttagcactcgcacgttgggtttggggggaagaggaagactgacggtccccccaggagttcaggtgctgggcacggtgggcatgtgtgagttttgtcacaagatttgggctcaactctcctgtgcagcctctggattcacctttggcagctttgccatgagctgggtccgccaggctccagggaagggctggaatgggtctcagccattagtagtagtggtggaagcacgtactacgctgactccgtgagggccgttcgccctctccagagaccaactcccaaacaacacgctgtctctgacaacttaacagcctgagagacgaggacacggcgtaatacttactgtgacggaaaggaagggtctaggcagtgccgtgtacctcccactactatagtcggacgtcgtagggacaaaggacgtcgcggtccaccgtctcctacacgtcctaccaccgaacggcccacgtccggtcccttccccgtcgtccctacccgtcccaccgaacgcgaccacccgtcgtacggggaccacgacggccggtcccgg

SEQ ID NO: 156291 - DNA, 669 bp, Homo sapiens
  misc_feature: GYAE6OF01EHJJF.37.55.E11.1.454.CMB.1.raw
  modified_base (274)..(274): a, c, t, g, unknown or other
  misc_feature (274)..(274): n is a, c, g, or t
  modified_base (338)..(338): a, c, t, g, unknown or other
  misc_feature (338)..(338): n is a, c, g, or t
  modified_base (344)..(344): a, c, t, g, unknown or other
  misc_feature (344)..(344): n is a, c, g, or t
tcagtagtgtagatcacgaccggtgctcgatttagcactcgcacgttgggtttgggctgaactggctttttcttgtggctattttaaaaggtgtccagtgtgaggtgcagctgtcggagtctgggggagcttggtacagcctggggggtccctgacactctcctgtgcagcctctggattcacctttggcagctttgccatgagctgggtccgccaggctccgagggaagggctggaatgggtctcgagcctattagtagtacgtggtaggaancacgtactacgctgactcgtgaagggccgttacgcctcgccaggacacactccaaacaacacgntcgtcncttagaaacttacagcctgtacgagacgacggacctacggccgttaatacgtttacgtcgtagtcggtaaaggtacgggtcgtaagcgtaacggttcgaccttacgggtacctccaacgttactaagtacgtcggtacgttcgtaggggtactaaacggtaacgtccgaccggttaccgacccgttactaccgttacgtaccgtaccctaccgaacggtaaccggtcccaacgttcccggttcccgttcccccgttaggtacccctaccccgttccgttacccgaacggtaccgtaccgtacccgttcggtaccggggtaacccg

SEQ ID NO: 156292 - DNA, 564 bp, Homo sapiens
  misc_feature: GYAE6OF01DTW1W.37.55.E11.1.454.CMB.1.raw
  modified_base (271)..(271): a, c, t, g, unknown or other
  misc_feature (271)..(271): n is a, c, g, or t
  modified_base (298)..(298): a, c, t, g, unknown or other
  misc_feature (298)..(298): n is a, c, g, or t
  modified_base (342)..(342): a, c, t, g, unknown or other
  misc_feature (342)..(342): n is a, c, g, or t
  modified_base (374)..(374): a, c, t, g, unknown or other
  misc_feature (374)..(374): n is a, c, g, or t
  modified_base (450)..(450): a, c, t, g, unknown or other
  misc_feature (450)..(450): n is a, c, g, or t
  modified_base (532)..(532): a, c, t, g, unknown or other
  misc_feature (532)..(532): n is a, c, g, or t
tcagtagtgtagatcacgaccggtgctcgatttagcactcgcacgttgggtttggggggaagaggaagactgacggtcccccaggagttcaggtgctgggcacggtgggcatgtgtgagtttttgtcacaagatttgggctcaactctcctgtgcagcctctggattcacctttggcagctttgccatgagctgggtcccgccaggctccgagggaaggggctggaatgggtctcagccattagtagtagtggtggaagcacgtactacgntgactccgtgaagggccgttcgccctnccagagacaactcaacaacacgctgtctctgaccaaacttaacngcctgagagacgaggacacggctatacttacnggtgacggaaaggagggtctaggcagtcgcctcgtacctccctactactaatagtgacgtcgtgggacgaaggtancgcgtccacgtctcctcacgtcctaccaccgacggcccacgtccggttccctcccgtcgcccaccctccctaccaacgaccnccgaccgtcggacgggcacgcggcccggccgg

SEQ ID NO: 156293 - DNA, 243 bp, Homo sapiens
  misc_feature: GYAE6OF01BETXA.37.55.E11.1.454.CMB.1.raw
  modified_base (177)..(179): a, c, t, g, unknown or other
  misc_feature (177)..(179): n is a, c, g, or t
  modified_base (181)..(243): a, c, t, g, unknown or other
  misc_feature (181)..(243): n is a, c, g, or t
tcagtagtgtagatcacgaccggtgctcgatttagcactcgcacgttggggtttggggggaagaggaagactgacggtccccccaggagttcaggtgctcgggcacagcggccctgggctgcctggtcaaggctacttccatctacactactgagcgggctggcaaggcgtcatagnnntnnnnnnnnnnnnnnnnnnnnnnnnnnnnnnnnnnnnnnnnnnnnnnnnnnnnnnnnnnnnnnn

SEQ ID NO: 156294 - DNA, 585 bp, Homo sapiens
  misc_feature: GYAE6OF01B2CY1.37.55.E11.1.454.CMB.1.raw
  modified_base (201)..(201): a, c, t, g, unknown or other
  misc_feature (201)..(201): n is a, c, g, or t
  modified_base (293)..(293): a, c, t, g, unknown or other
  misc_feature (293)..(293): n is a, c, g, or t
  modified_base (299)..(299): a, c, t, g, unknown or other
  misc_feature (299)..(299): n is a, c, g, or t
  modified_base (314)..(314): a, c, t, g, unknown or other
  misc_feature (314)..(314): n is a, c, g, or t
  modified_base (351)..(351): a, c, t, g, unknown or other
  misc_feature (351)..(351): n is a, c, g, or t
  modified_base (364)..(364): a, c, t, g, unknown or other
  misc_feature (364)..(364): n is a, c, g, or t
tcagtagtgtagatcacgaccggtgctcgatttagcactcgcacgttgggtttgggggggaagaggaagactgacggtccccccaggagttcaggtgctgggcacggtgggcatgtgtgagttttgtcacaagatttgggctcaactctcctgtgcagcctctggattcacctttggcagctttgccatgagctgggtccncaggctccagggaagggctggaatgggtctcagccattagtagtagtggtggaagcacgtactacgctgactccgtgaagggccgtcgcctntccagngacactccaacaacncgctgtctctgcaacttacagcctgagagacgagacncggctatattacngtacgagaaggagggtctagcgtagtgccgtggtacctcccgactaactatatcgggtactcgtgggactaaaggactcggcggtacacgtcctaccgtcgacgtcccgtaccaccgacgggccctagtcccggttcccttccccgtaggccctaccccgtacctacccgaacggcctcccgacccgtcggtcggggaccaccgacggcccggtaccccgg

SEQ ID NO: 156295 - DNA, 174 bp, Homo sapiens; identical to SEQ ID NO: 156252
  misc_feature: GYAE6OF01BPG30.37.55.E11.1.454.CMB.1.raw
  modified_base (173)..(174): a, c, t, g, unknown or other
  misc_feature (173)..(174): n is a, c, g, or t

SEQ ID NO: 156296 - DNA, 943 bp, Homo sapiens
  misc_feature: GYAE6OF01CTLO1.37.55.E11.1.454.CMB.1.raw
tcagtagtgtagatcacgaccggtgctcgatttagcactcgcacgttgggtttgggggaagaggaagactgacggtcccccaggagttcaggtgctgggcacggtgggcatgtgtgagttttgtcacaagatttgggctcaactctcctgtgcagcctctggattcacctttggcagctttgccatgagctggtccgccaggctccgagggaagggctggaatgggtctcagccattagtagtagtggtggaagcacgtactacgctgactccgtggaaggccgtcgcctctccagagacaacgtccaaacacacgctgtctctgcaacttacagcctgagagacgaggacacggtacgtaatacttacgtggtacgacggaaaggtaagggtctaggacgtaggtcgtaccgttacgggtaacctacccgtaacgttaaccgttaacgttaacggttacgggtaaccggttacgggtaacgggggtaaccgtaaaaacggggtaaccgttaccgggtacccgggttacccgtaaccccggttacccgttacccgttaccccggtaaccggtaccccccgtttaaccccggaaaccccgggtaaaccgggggtaccccccgtaaaccgggttttccccggggttaaccccccgttttacccccccccggggttccggggttaacccccccggttaaacccccccccggttttaaccccccgggttaaaccccccgggttaaaaacccccgggggtaaaaccccggggttttaaaccccccccccggtttaaaacccccccccccggggtttttaccccgggggggtttaaaaccccccggggggggggggtttaaacccccccgaaaaaccccccgggggttaaaaacccccggggggggttccccccccgggggggttttaaaccccccccccccggggggg

SEQ ID NO: 156297 - DNA, 584 bp, Homo sapiens
  misc_feature: GYAE6OF01APDJ1.37.55.E11.1.454.CMB.1.raw
  modified_base (342)..(342): a, c, t, g, unknown or other
  misc_feature (342)..(342): n is a, c, g, or t
  modified_base (377)..(377): a, c, t, g, unknown or other
  misc_feature (377)..(377): n is a, c, g, or t
tcagtagtgtagatcacgaccggtgctcgatttagcactcgcacgttgggtttggggggaagaggaagactgacggtcccccaggagttcaggtgctgggcacggtgggcatgtgtgagttttgtcacaagatttgggctcaactctcctgtgcagcctctggattcacctttggcagctttgccatgagctgggtccgccaggctccgaggggaaggggctggaatgggtctcagccattagtagtagtggtggaagcacgtactacgctgactccgtgaacgggccgttcgcctctccagacgacaactccaacaacacgctgtctctgacaacttaacncgtcctagagagacgaggacacggcgtatattacngtgcgagagatcgaagacggagtagtagcagcagctctagactacgtcgggaccgaccggacccgtcggtaccaccgtctcctaccacgccctacccaccgaacggcccacgtccgtcccgttccccgtccggccctaccccgtccctacccgaacgaccgaccctacccgtccggtcggggaccacgcggcccggtcccggtcggg

SEQ ID NO: 156298 - DNA, 655 bp, Homo sapiens
  misc_feature: GYAE6OF01CPW87.37.55.E11.1.454.CMB.1.raw
  modified_base (199)..(199): a, c, t, g, unknown or other
  misc_feature (199)..(199): n is a, c, g, or t
  modified_base (257)..(257): a, c, t, g, unknown or other
  misc_feature (257)..(257): n is a, c, g, or t
  modified_base (336)..(336): a, c, t, g, unknown or other
  misc_feature (336)..(336): n is a, c, g, or t
tcagtagtgtagatcacgaccggtgctcgatttagcactcgcacgttgggtttgggggaagaggaagactgacggtcccccaggagttcaggtgctgggcacggtgggcatgtgtgtagttttgtcacaagatttgggctcaactctcctgtgcagcctctggattcacctttggcagctttgccatgagctgggtccnccaggctcgaggggaggctggaatgggtctcagccattaggtagtaggtggtaggaancaacgtactacgctgactccggtggaacgggtccgttccgcctctccagacgaaccaactccaacaacacgtctgtacnctcgaccaaacttaacagcctggaacgagacgagtacacggtctaatacgttacgtggtacgacgggaaaagggtacgggttaccaagccgaaggtcgtaccgttacggtacctacccgtaacttaacgtaataagtggacgtcggtaggggaacgaaaggtacgtcggacgttccgaccgttcacccttcgacgccctaccaaccgaccgggccctacgttcccggtcccttcccccgtacggcccctacccgtccctacccgaacgaccgaccctacccgtccgggtacgggaccctacggcggtcccggtcccggg

SEQ ID NO: 156299 - DNA, 569 bp, Homo sapiens
  misc_feature: GYAE6OF01ETVTB.37.55.E11.1.454.CMB.1.raw
  modified_base (507)..(507): a, c, t, g, unknown or other
  misc_feature (507)..(507): n is a, c, g, or t
  modified_base (534)..(534): a, c, t, g, unknown or other
  misc_feature (534)..(534): n is a, c, g, or t
tcagtagtgtagatcacgaccggtgctcgatttagcactcgcacgttgggtttggggggaagaggaagactgacggtccccccaggagttcaggtgctgggcacggtgggcatgtgtgagttttgtcacaagatttgggctcaactctcctgtgcagcctctggattcacctttggcagctttgccatgagctgggtccgccaggctccgagggaagggctggagtgggtctcaggtattactggtagtggtaataccgcatactacgcagactccgtgacgggccgttcaccgtctccagagacaattccaaagaactacggtctatctaggaaatgaacagcctgagagccgaaggaccaccggccctatattactggtcgcgagagatcgaggacggagtatagcagcagctcgtgactacgtcgggaccgaaccggacccgtggtaccaccgtcctcctcacgccctaccgaccgaacggccctacgtccgtaccctccccgngtcccaccctcctaccgaacgacgccnccgtcgtacgggcacgacgccgccgtcggcgtcgg

SEQ ID NO: 156300 - DNA, 567 bp, Homo sapiens
  misc_feature: GYAE6OF01BR9LQ.37.55.E11.1.454.CMB.1.raw
  modified_base (330)..(330): a, c, t, g, unknown or other
  misc_feature (330)..(330): n is a, c, g, or t
  modified_base (374)..(374): a, c, t, g, unknown or other
  misc_feature (374)..(374): n is a, c, g, or t
  modified_base (458)..(458): a, c, t, g, unknown or other
  misc_feature (458)..(458): n is a, c, g, or t
  modified_base (503)..(503): a, c, t, g, unknown or other
  misc_feature (503)..(503): n is a, c, g, or t
tcagtagtgtagatcacgaccggtgctcgatttagcactcgcacgttggggtttgggggaaagaggaacgactgacggtccccccaggagttcaggtgctgggcacggtgggcatgtgtgagttttgtcacaagtatttgggctcaactctcctgtgcagcctctggattcacctttggcagctttgccatgagctgggtccgccaggctccagggaaggggctggaatgggtctcagccattagtagtagtggtgaagcacgtactacgctgactcgtgaacgggccggttcgccctctccagagacaactccaacacacgctgtctcngcaacttaacacgcctgagagacgaggacacggcgtatattacngtagacgaaggaaggtcaggcagtcgcctaggtacctcccactactatatggacgtcgtgggacaaggatcggcgtccacgtcncctcgacgcctaccaccgaacggcccagtccggtaccttccccgnggtaccctcccttcccaccgaacgcgtcctacccgtcggtcggggaccacgcggccggtcccgg

SEQ ID NO: 156301 - DNA, 815 bp, Homo sapiens
  misc_feature: GYAE6OF01ACDEQ.37.55.E11.1.454.CMB.1.raw
tcagtagtgtagatcacgaccggtgctcgatttagcactcgcacgttgggtttggggggaagaggaagactgacggtccccccaggagttcaggtgctgggcacggtgggcatgtgtgagttttgtcacaagatttgggctcaactctcctgtgcagcctctggattcacctttggcagtctttgccatgagtcgtcgggtcccgccaggccgtccggaaggggaacggggctagggaagttggggtcctcgacgcctaagtttaggtaaggttaggtagggtaggaaacgcgaaccgttacgtacgctcgaccgtccggtaggaacgggtccggttccgcccctctaccgagacgaccaacctaccaaacaacacgcttacgtcctctacgaacctaaaccttaacgcgtccgtaggaacgaacggaccggacggaccgaccggtacgttaattacgttacgtggtacggaacggaaagggtaacggtctacgcgtacgtcgaccgttacggtaccctacccgtaatacgtatacggtacggtacgttacggtacggggaaacaaacgggtacgtccggaccgggtacccctacccggttcctacccttaccggacccgttacccccgtaacccgaaacccgggaacccgggttaccccctacggggtttcccccgttcccccgtttaccccccggtacgtaccccccgttaaccccccgttacccgtaacccgtaaacccgggacccgtacccgtaccccggttccgggggaacgggaccccgaacccgggtcgggtacccccgggtccccgg

SEQ ID NO: 156302 - DNA, 174 bp, Homo sapiens
  misc_feature: GYAE6OF01CIADM.37.55.E11.1.454.CMB.1.raw
  modified_base (174)..(174): a, c, t, g, unknown or other
  misc_feature (174)..(174): n is a, c, g, or t
tcagtagtgtagatcacgaccggtgctcgatttagcactcgcacgttgggtttgggggaagaggaagactgacggtccccccaggagttcaggtgctgggcacagcggccctgggctgcctggtcaaggactacttccatctacactactgagcgggctggcaaggcgcatagn

SEQ ID NO: 156303 - DNA, 172 bp, Homo sapiens
  misc_feature: GYAE6OF01DKR3Y.37.55.E11.1.454.CMB.1.raw
tcagtagtgtagatcacgaccggtgctcgatttagcactcgcacgttgggtttgggggaagaggaagactgacggtcccccaggagttcaggtgctgggcacagcggccctgggctgcctggtcaaggactacttccatctacactactgagcgggctggcaaggcgcatag

SEQ ID NO: 156304 - DNA, 803 bp, Homo sapiens
  misc_feature: GYAE6OF01DDJET.37.55.E11.1.454.CMB.1.raw
tcagtagtgtagatcacgaccggtgctcgatttagcactcgcacgttgggtttggggggaagaggaagactgacggtcccccaggagttcaggtgctgggcacggtgggcatgtgtgtagttttgtcaacaagatttgggctcaactctcctgtgcagcctctggattctacctttggcagtctttgccatgagcgtggtccgccgaggcctcggagggaagggcgtggaagtcgggtctcaggacctagttaggtaggtaggtggtaggaagaccacggtactacgtctcgacttccggaggtaacgggtccgtccgccctcgtcagaacgaaccaacctccaaacaaccgacgtctcgtcctctacgaccgtaaacttaacgacgtaccgtagaacggaaggaccgaacgggtaccgaaccggggtaccttaaatttaacgtacgttacgggtacgaaccggggtaaaagggtaacgggttacgtaacggtacgtacggtccggtaacccgttaacggtacccctttaaacccggtaactttaaccgtaacgttaacgggttaccggtaaccgggtttcgggaaacggggtaaacgtaaaacgggtcgtacccgggtaccggacccgttccgtaccctaccgttaccgaccgtacccgtaacccgaaccgtaaccgggccccttaacggttccccggttaccccgtaccccgtaccgtaccccctacccgtaaccctacggtaacgaccgtacccggtaccgtaccgggtcgggaaccacccggtcggcccggtacccggg

SEQ ID NO: 156305 - DNA, 601 bp, Homo sapiens
  misc_feature: GYAE6OF01EV2CA.37.55.E11.1.454.CMB.1.raw
  modified_base (201)..(201): a, c, t, g, unknown or other
  misc_feature (201)..(201): n is a, c, g, or t
  modified_base (295)..(295): a, c, t, g, unknown or other
  misc_feature (295)..(295): n is a, c, g, or t
  modified_base (300)..(300): a, c, t, g, unknown or other
  misc_feature (300)..(300): n is a, c, g, or t
  modified_base (311)..(311): a, c, t, g, unknown or other
  misc_feature (311)..(311): n is a, c, g, or t
  modified_base (318)..(318): a, c, t, g, unknown or other
  misc_feature (318)..(318): n is a, c, g, or t
  modified_base (341)..(341): a, c, t, g, unknown or other
  misc_feature (341)..(341): n is a, c, g, or t
  modified_base (378)..(378): a, c, t, g, unknown or other
  misc_feature (378)..(378): n is a, c, g, or t
tcagtagtgtagatcacgaccggtgctcgatttagcactcgcacgttgggtttggggggaagaggaagactgacggtccccccaggagttcaggtgctgggcacggtgggcatgtgtgagttttgtcacaagatttgggctcaactctcctgtgcagcctctggattcacctttggcagtctttgccatgagctgggtccnccaggctccgaggggaagggctggatgggtctcagccagttagtagtaggtggtaggaagcacgtactacgctgactcgtggacgggccgttcncctcncagacacaacncaacacncgctgtctctagactaacttacngtcctagagagacgagacgacggtctaatacttacgnggtagacgggaaaggtaggtcacgcgtacgtcgtccgtacggtaccctacccgtaacttaactagtagtacggtacgtcggtagggaacgaaagacgtcgaccggtactaccgtctacctcgaccgtcccaccgaccgacggccctacgtccggtcccttcccgccgtccctaccccgtcaccgacgacgccaccgtcggacgggacacgcggccggtcccgg

SEQ ID NO: 156306 - DNA, 579 bp, Homo sapiens
  misc_feature: GYAE6OF01DSHK5.37.55.E11.1.454.CMB.1.raw
  modified_base (257)..(257): a, c, t, g, unknown or other
  misc_feature (257)..(257): n is a, c, g, or t
  modified_base (398)..(399): a, c, t, g, unknown or other
  misc_feature (398)..(399): n is a, c, g, or t
  modified_base (566)..(566): a, c, t, g, unknown or other
  misc_feature (566)..(566): n is a, c, g, or t
tcagtagtgtagatcacgaccggtgctcgatttagcactcgcacgttgggtttggggggaagaggaagactgacggtcccccaggagttcaggtgctgggcacggtgggcatgtgtgagtttttgtcacaagatttgggctcaactctcctgtgcagcctctggattcacctttggcagctttgccatgagctgggtccgccaggctccgagggaagggctggaatgggtctcagccattagtagtagtggtggaancacgtactacgctgactccgtaggaagggtccggttcgcccctctccagacgaacaactccaaacaacacgctcgtctctgactaacttacagcctgagacgacgagacacggcctatatactgtgacgaaggaggtcagnngtgctggtacctacccactactatagtacggacgtcgtagggacaaaggactcggacggtcctaccgtcctccgtcacgccctaccgaccaacgggcccacgttccgtccctccccgtggccctacccctcctaccgaacgaccgcacccgtcggtcgggacaccgnggcccggtcccgg

SEQ ID NO: 156307 - DNA, 580 bp, Homo sapiens
  misc_feature: GYAE6OF01DM47J.37.55.E11.1.454.CMB.1.raw
  modified_base (353)..(353): a, c, t, g, unknown or other
  misc_feature (353)..(353): n is a, c, g, or t
  modified_base (361)..(361): a, c, t, g, unknown or other
  misc_feature (361)..(361): n is a, c, g, or t
  modified_base (384)..(384): a, c, t, g, unknown or other
  misc_feature (384)..(384): n is a, c, g, or t
tcagtagtgtagatcacgaccggtgctcgatttagcactcgcacgttgggtttggggggaagaggaagactgacggtccccccaggagttcaggtgctgggcacggtggcatgtgtgagttttgtcacaagatttgggctcaactctcctgtgcagcctctggattcacctttggcagctttgccatgagctgggtccgccaggctccgaggggaagggctggaatgggtctcagccattagtagtaggtggtggaagcacgtactacgctgacctccgtaggaacgggtccggttcgccccttctacccgagacgacaaacctcaacaacacgctgtctctgacaacttacngcctgagngacgaggacacggctatattacngtgacgaaggaggtctagcgagtcgcccgtactcctactactatatgacgtgtgggacaagagtcgcgtcacctctcctcacgcctccgaccgaacggtcccacgtccggttcccttccccgtacggccctaccccgtccctacccaacgaccgtccacccgtcgtcggggaccacgccggccggtcccgtcgggg

SEQ ID NO: 156308 - DNA, 607 bp, Homo sapiens
  misc_feature: GYAE6OF01B5SFM.37.55.E11.1.454.CMB.1.raw
  modified_base (595)..(595): a, c, t, g, unknown or other
  misc_feature (595)..(595): n is a, c, g, or t
tcagtagtgtagatcacgaccggtgctcgatttagcactcgcacgttgggtttgggctgaactggctttttcttgtggctattttaaaaggtgtccagtgtgaggtgcagctgtcggagtctgggggaggcttggtacagcctggggggtccctgacactctcctgtgcagcctctggattcacctttggcagctttgccatgagctgggtccgccaggctccgagggaaggggctggaatgggtctcagccattagtagtagtggtggaagcacgtactacgctgactcggtgaacgggccgttcgccctctccagagaccaactccaacaacacgctgtctctgacaaacttaacagcctgagagacgaggacacggctatattacgtgtgtaggaacgggacctcgtacgtaccccttatacgcacggcggtcgtcggtccgttggttacctttggaccgtacggtcggggccgtacgggaccccgttggtccgtaccgttccgtccctcaccgccctaccgacccgacgggccctacgtccggtcccttccccgtcggcccgccccgtcgcccgtcccgacggaccgcccncccgtccggacg

SEQ ID NO: 156309 - DNA, 750 bp, Homo sapiens
  misc_feature: GYAE6OF01CRQXV.37.55.E11.1.454.CMB.1.raw
  modified_base (412)..(412): a, c, t, g, unknown or other
  misc_feature (412)..(412): n is a, c, g, or t
  modified_base (417)..(417): a, c, t, g, unknown or other
  misc_feature (417)..(417): n is a, c, g, or t
tcagtagtgtagatcacgaccggtgctcgatttagcactcgcacgttgggtttggggggaagaggaagactgacggtcccccaggagttcaggtgctgggcacggtgggcatgtgtgagttttgtcacaagatttgggctcaactctcctgtgcagcctctggattcacctttggcagctttgccatgagcgtgggtccgccaggctccgaggggaagggctgggaatgggtctcgaacgccaagtttagtagttaggtgggtaggaagcgaacgtactaacgcctgacctcggtaggaacgggccgttccgcccttcaccagacgaaccaacctacccaaacaaccgtccgcctgtcctctagaacctaacttaacacgtcagaagagacgaaggacacgtactatactcnggtanacggaaaggacggtcagccaggtcgtaccgtacggtaaccctacccgaacttaacgtaactaggttacgggaacccgttacgggtacggggaaaacctaaaagggtaaccgtccgggtaccgggttaccctaacccgggtttccctacccgtaccgaacccgtaccccgtaaccccgtaaacccgggaaacccgggtaccccgttaaccggttcccggttccccccgttacccccgttgggacccccctacccccgtttacccgaacccgtaacggaccgccctaacccgtcggggtacgggacccaaccggaccggtcccgggtcccccggg

SEQ ID NO: 156310 - DNA, 585 bp, Homo sapiens
  misc_feature: GYAE6OF01BC16H.37.55.E11.1.454.CMB.1.raw
tcagtagtgtagatcacgaccggtgctcgatttagcactcgcacgttgggtttgggggaagaggaagactgacggtcccccaggagttcaggtgctgggcacggtgggcatgtgtgagttttgtcacaagatttgggctcaactctcctgtgcagcctctggattcacctttggcagctttgccatgagctgggtccgccaggctccgagggaaggggctggaatgggtctcagccattagtagtagtggtggaagcacgtactacgctgactccgtgaagggccgttcgcctctccagagacaactccaacaacacgctgtctctgcaacttacagcctagagagacgaggacacggcctatattactgtgacggaaaggacggtctagcagtcgcctgtacctcccactactatagtggacgtcgtgggacaaggacgtcgcgtccgaccgtctcctcacgccctaccgaccgacggcccacgtccgtcccgttcccccgtcggtccctaccccgttcccgtacccaacggaccgacccgtacccgttccggtcggggaccaccggccggcccgggtccccgg

SEQ ID NO: 156311 - DNA, 173 bp, Homo sapiens; identical to SEQ ID NO: 156246
  misc_feature: GYAE6OF01BJJQ7.37.55.E11.1.454.CMB.1.raw
  modified_base (173)..(173): a, c, t, g, unknown or other
  misc_feature (173)..(173): n is a, c, g, or t

SEQ ID NO: 156312 - DNA, 628 bp, Homo sapiens
  misc_feature: GYAE6OF01EAPU2.37.55.E11.1.454.CMB.1.raw
  modified_base (311)..(311): a, c, t, g, unknown or other
  misc_feature (311)..(311): n is a, c, g, or t
  modified_base (366)..(366): a, c, t, g, unknown or other
  misc_feature (366)..(366): n is a, c, g, or t
  modified_base (385)..(385): a, c, t, g, unknown or other
  misc_feature (385)..(385): n is a, c, g, or t
tcagtagtgtagatcacgaccggtgctcgatttagcactcgcacgttgggtttggggggaagaggaagactgacggtcccccaggagttcaggtgctgggcacggtgggcatgtgtgagttttgtcacaagatttgggctcaactctcctgtgcagcctctggattcacctttggcagctttgccatgagctgggtccgccaggctccgagggaagggctggagtgggtctcagccattagtagtagtggtaggaagcagtatacgctgactcgtggaaggccgttcgcctctcagacacactccaacacncgctgtctctgactaacttaacagcctgagagacgaggacacggactatattacngtagacggaaggtacggtnagcagtcgtacgtacggtacctaccctaacgtactactagtacgggtacgtcggtacgggaacgtaaaggacgtccggcggtaccgacgtcctcctcgaccgtacctacccgaccgaaccggccctacgtcccggttacccttcccccgtacggtacccctaccccgttccacccgaacggacccgtacccgtaacccgttccgggtaccggggacccgacggtcccgggccggtaccccggg

SEQ ID NO: 156313 - DNA, 570 bp, Homo sapiens
  misc_feature: GYAE6OF01E1MN0.37.55.E11.1.454.CMB.1.raw
  modified_base (343)..(343): a, c, t, g, unknown or other
  misc_feature (343)..(343): n is a, c, g, or t
  modified_base (467)..(467): a, c, t, g, unknown or other
  misc_feature (467)..(467): n is a, c, g, or t
  modified_base (556)..(556): a, c, t, g, unknown or other
  misc_feature (556)..(556): n is a, c, g, or t
tcagtagtgtagatcacgaccggtgctcgatttagcactcgcacgttgggtttggggggaagaggaagactgacggtccccccaggagttcaggtgctgggcacggtgggcatgtgtgagttttgtcacaagatttgggctcaactctcctgtgcagcctctggattcacctttggcagctttgccatgagctgggtccgccaggctccgaggggaaggggctggaatggggtctcagccattagtagtagtggtggaagcacgtactacgctgactccgtgaagggccggttcgccctctccagagacaactccaacaacacgctgtctctgcaacttaacngcctgagagacgaggacacggccgtatattacgtgtgcgaaggagggtctagcagtgccgtggtactcccactactatagtggacgtcgtgggacgaaaggatcgcggtcaccgtcctcctccnctcctcccaccgacggcccacgtccggtcccttcccccgtcggcccaccctccctacccaacgacgccacccgtcgtcggggccaccgnggcccggtccccgg

SEQ ID NO: 156314 - DNA, 197 bp, Homo sapiens
  misc_feature: GYAE6OF01EH4AS.37.55.E11.1.454.CMB.1.raw
  modified_base (177)..(197): a, c, t, g, unknown or other
  misc_feature (177)..(197): n is a, c, g, or t
tcagtagtgtagatcacgaccggtgctcgatttagcactcgcacggttggggtttggggggaagaggaagactgaccggtccccccaggagttcaggtgctgggcacagcggccctgggctgcctggtcaaggctacttccatctacactactgagcgggctggcaaggcgcatagnnnnnnnnnnnnnnnnnnnnn

SEQ ID NO: 156315 - DNA, 655 bp, Homo sapiens
  misc_feature: GYAE6OF01EDWCO.37.55.E11.1.454.CMB.1.raw
  modified_base (202)..(202): a, c, t, g, unknown or other
  misc_feature (202)..(202): n is a, c, g, or t
  modified_base (328)..(328): a, c, t, g, unknown or other
  misc_feature (328)..(328): n is a, c, g, or t
  modified_base (389)..(389): a, c, t, g, unknown or other
  misc_feature (389)..(389): n is a, c, g, or t
tcagtagtgtagatcacgaccggtgctcgatttagcactcgcacgttgggtttggggggaagaggaagactgacggtccccccaggagttcaggtgctgggcacggtgggcatgtgtgagttttgtcacaagatttgggctcaactctcctgtgcagcctctggattcaccttttggcagtctttgccatgagctgggtccnccaggctccgagggagggctggaatgggtctcagcctagttagtagtaggtgggtaggaacgtcacgtactacgctagacctccgtgaacgggtccgttcgcctctcagagaccactccaacaacncgctcgtctctgactaacttacgcgacctgagacggacgaaggacacggactatacttacngtacggacgtaaaggtacggtctagctacggtcgccgttacggtaccctaccctaactaacgtaacgtagtacggacgttcggtaggggaaccgtaaaggtaccgtaccggccggtaccgtacccgttcctacccgtaccgaccgtaccctacccgaaccgaaccgggtccctacggttcccggttccttcccgtacccgtcgacccttaccccgcctaccgaacgcgtcctacccgttcggaccgggacaccgccgggtccccgg

SEQ ID NO: 156316 - DNA, 745 bp, Homo sapiens
  misc_feature: GYAE6OF01DZ3RZ.37.55.E11.1.454.CMB.1.raw
  modified_base (297)..(297): a, c, t, g, unknown or other
  misc_feature (297)..(297): n is a, c, g, or t
  modified_base (351)..(351): a, c, t, g, unknown or other
  misc_feature (351)..(351): n is a, c, g, or t
  modified_base (434)..(434): a, c, t, g, unknown or other
  misc_feature (434)..(434): n is a, c, g, or t
tcagtagtgtagatcacgaccggtgctcgatttagcactcgcacgttggggtttaggggggggaagaggaagactgacggtccccccaggagttcaggtgctgggcacggtgggcagtgtgtgtagttttgtcacaagtatttggctcaactctcctgtgcagcctctggacttcacctttggcacgttcctttcggccagttgagtcgtcgggtcccgcgaggcctaccggaggggaacgggtctaggaagtcgggtctacgagtacctagttaagtagtacggtggtaggtaacnccgtaacgttactacggctacggaaccgttccggaggaaccgggtccgttaccnccccttctaccgaaggtaaccgaacaacctaaccgaaaacaccgacgtccgttgttaccgctacgaacctaaacgtttaaccnggtccctaggaacggagaacggtacggacccgacgtaacgttaattaaccgtttacggtagggtacgacggtaaacggggtaggtacctaggacgtaggtccgtccgttacgtaccgtaccctaataacgtattaggtacgtacgtacggtacggaacgtaaggtcgtacggtacggtcctaccgtcctacgtaccaccgtccgtacccgaaccgtacggccctacgtcccgttaccctccccgacgtaccccgtacctaccgaccgtaacgccgtaccctccgtacggcgaccacgtcccgccgtcccgg

SEQ ID NO: 156317 - DNA, 677 bp, Homo sapiens
  misc_feature: GYAE6OF01CAZN9.37.55.E11.1.454.CMB.1.raw
  modified_base (453)..(453): a, c, t, g, unknown or other
  misc_feature (453)..(453): n is a, c, g, or t
tcagtagtgtagatcacgaccggtgctcgatttagcactcgcacgttgggtttgggggaagaggaagactgacggtcccccaggagttcaggtgctgggcacggtgggcatgtgtgagttttgtcacaagatttgggctcaactctcctgtgcagcctctggtacttccaccgtttggctagtctttgccatgagcgtcgggtccgccacggcctaccggaggggaaggggcgtagggaagttggggtcctcgagacctaagttaggtaggttaggtgggtaggaagcgtaacgttacgtacgctacggactcggtaggacgggtccggttccgccctcgaccgagacgaaccaacctaccaacgaacacgctcgtctcgtcaactaactaacacgccgagacgagacggacgaccgacgtacgtatagtcgtagacgacggaaggtacggtntacgcgtagtcgaccgtacggtacctaccgtaactacgtagtacgtacggtcgtaggacgggaacgaaggtcgtacggacgccgtacgtccgtccgacgtaccgtcccgtaccaaccgtaccggcctacgtcccgtccctccccgacggaccctccccgtacctacccgaacgaccgtcccgtacccggtcggacgggaccctacggccggtcccggtcccggg

SEQ ID NO: 156318 - DNA, 756 bp, Homo sapiens
  misc_feature: GYAE6OF01AFN4Y.37.55.E11.1.454.CMB.1.raw
  modified_base (307)..(307): a, c, t, g, unknown or other
  misc_feature (307)..(307): n is a, c, g, or t
  modified_base (362)..(362): a, c, t, g, unknown or other
  misc_feature (362)..(362): n is a, c, g, or t
tcagtagtgtagatcacgaccggtgctcgatttagcactcgcacgttgggtttggggggaagaggaagactgacggtcccccaggagttcaggtgctgggcacggtgggcatgtgtgagttttgtcacaagatttgggctcaactctcctgtgcagcctctggattcacctttggcagctttgccatgagcgtgggtccgccaggcctccgaggggaagggctaggaagtgggtctcgagcctagttagtagtagtgggtggaagcacgtactacgctgacctcgtagacgggtccggttcgccctntaccagacgactaaccgtccaaacaccgacgctcgtctctcgacctaacttaacncgtacctagacgacggtacgacggaaccgaccgggtacttaattacgtttacgtacgggtagtaaccgggtaaaggggtaacggttcgtaacgggacgtacggttacggtcccgttacgggttaacccctacccctaacgttacgttaagttacggtacggtaccggttacggtacggggtaaactaaacggggtaaccgttcggtaccgttaccgaacccggttcctaccgtcgaccgtccccgtacccgaacccggtaccggacccgttacgttccccggttcccttccccccggtaggtacccccttacccctaccccggtacgaacccggtaccgtcccctacccgtccgggttaccgggaccaccggtcccgggccggttacccccggg

SEQ ID NO: 156319 - DNA, 678 bp, Homo sapiens
  misc_feature: GYAE6OF01AKRM6.37.55.E11.1.454.CMB.1.raw
  modified_base (357)..(357): a, c, t, g, unknown or other
  misc_feature (357)..(357): n is a, c, g, or t
tcagtagtgtagatcacgaccggtgctcgatttagcactcgcacgttgggtttgggctgaactggctttttcttgtggctattttaaaaggtgtccagtgtgaggtgcagctgtcggagtctgggggaggcttggtacagcctggggggtccctgacactctcctgtgcagcctctggattcacctttggcagtctttgccatgagctgggtccgccaggctccgaggggaaggggctggaatgggtctcagcctagttagtagtaggtgggtaggaacgcgacggtactacgcttcggaccgtccggtggaacggggtccggttccgccctctccgagacgacactccaaacaacncgcttgtcctcacggacctaaaccgttaacgacgccctaggagaacgggaaacgacgggaccgaacccggtacgttaagtaacgtttaccgtggtacggaacggaagggtaacggtacgtaggcgagtcgccgttcggtacctcccgtaacttaacgtagtacgtacggacgtacggtagggaacaaagggtacgtcggccgttaccgtaccgtcctcctaccgaccgtccctaccaccgaccggccctacgtcccgttccctccccgtcgtaccccgtacccctcccgtaccgaacgccgtacccgccgtcgggtccggg

SEQ ID NO: 156320 - DNA, 817 bp, Homo sapiens
  misc_feature: GYAE6OF01B8CFT.37.55.E11.1.454.CMB.1.raw
  modified_base (237)..(237): a, c, t, g, unknown or other
  misc_feature (237)..(237): n is a, c, g, or t
  modified_base (310)..(310): a, c, t, g, unknown or other
  misc_feature (310)..(310): n is a, c, g, or t
tcagtagtgtagatcacgaccggtgctcgatttagcactcgcacgttgggtttggggggaagaggaagactgacggtcccccaggagttcaggtgctgggcacggtgggcatgtgtgtagttttgtcacaagtatttgggctcaactctcctgtgcagcctctggattcacctttggcagtctttgccatgagcgtgggtccgccaggctccgaggggaaggggctggaatgggtcncgagccagttaggtagtaggtgggtagaagcgaacgtacacggctgacgtccggtaggaacgggtccggttcnccctctaccgagacgaaccaactaccaaacgaacctacgcgtcgttacctctacgaacctaaactttaaacgacgtaccctagggaacgaacggaaccgggaacgggaacccgtaaccgggtaccgtaagtttaacgttaacgtgggtacggaaacgggaaaggggttaaacggttccgaaggcgtacggtcggtccgtacgggttacctacccgtaacgttaactacgttaacggtacggtaacggtaccggtacggggaacgtaaaacgggtaacgtaccggtaccggtacccgtaacccgttccgtacccctaccgtaaccgtaccccgtaacccgaacccggtaaacccgggaccccgtaaccgttccccgggttacccccttacccccgtacccggtacccccgtaacccccgtccctaacccgaaccggaacccgtacccgtaaccccggtaccgggtaccgggggacccgaaccggacccgggcccgggtacccccgggg

SEQ ID NO: 156321 - DNA, 578 bp, Homo sapiens
  misc_feature: GYAE6OF01E2NUD.37.55.E11.1.454.CMB.1.raw
  modified_base (342)..(342): a, c, t, g, unknown or other
  misc_feature (342)..(342): n is a, c, g, or t
  modified_base (402)..(402): a, c, t, g, unknown or other
  misc_feature (402)..(402): n is a, c, g, or t
  modified_base (517)..(517): a, c, t, g, unknown or other
  misc_feature (517)..(517): n is a, c, g, or t
tcagtagtgtagatcacgaccggtgctcgatttagcactcgcacgttgggtttggggggaagaggaagactgacggtccccccaggagttcaggtgctgggcacggtgggcatgtgtgagttttgtcacaagatttgggctcaactctcctgtgcagcctctggattcacctttggcagctttgccatgagctgggtccgccaggctccgaggggaaggggctggaatgggtctcagccattagtagtagtggtggaagcacgtactacgctgactccgtgaagggccggttcgccctctccagagacaactccaacaacacgctgtctctgcaacttaacngcctgagagacgaggacacggccgtaatacttactgtgacgaaaggaagggtctagcagngcctggtacctcccactactatatggacgtcgtgggacaaaggatcgcgtcaccgtctcctcacgccctccaaccgaacgggcccctagtccggtcccttcccccgtcggacccncccctccctacccgaacgacgccctacccgtcggtacggggccacgcggccgggtccccgg

SEQ ID NO: 156322 - DNA, 667 bp, Homo sapiens
  misc_feature: GYAE6OF01BIET5.37.55.E11.1.454.CMB.1.raw
  modified_base (214)..(214): a, c, t, g, unknown or other
  misc_feature (214)..(214): n is a, c, g, or t
tcagtagtgtagatcacgaccggtgctcgatttagcactcgcacgttgggtttgggctgaactggctttttcttgtggctattttaaaaggtgtccagtgtgaggtgcagctgtcggagtctgggggaggcttggtacagcctggggggtccctgacactctcctgtgcagcctctggattcacctttggcagctttgccatgagctgggtccnccaggctcgagggaaggggctggaatgggtctcagcattagtagtagtggtggaagcacgtactacgctgactcgtggaagggccggttcgcccctctccagacgacaactccaacaacacgctgtctctgcaacttacagcctagagagacgaggaccacggtccgtaatattaccgtggtacggacggaagggaagggtactaggctaggtcgaccgtcgggtaacctccccgtaactacttacgtacgtcgggtaccgttcggtaggggtaacgaaaagggaacttaccgggaccgggttacctaacccggttcctacccgtacgaccgcccttacccgaacccggaccgggacccctaggtcccggttcccttacccccgtcgggaccctacccccccgttacccgtacccgaacggtaccgaccccgtacccgttcggtacccggggg

SEQ ID NO: 156323 - DNA, 599 bp, Homo sapiens
  misc_feature: GYAE6OF01A3WXZ.37.55.E11.1.454.CMB.1.raw
  modified_base (298)..(298): a, c, t, g, unknown or other
  misc_feature (298)..(298): n is a, c, g, or t
  modified_base (391)..(391): a, c, t, g, unknown or other
  misc_feature (391)..(391): n is a, c, g, or t
  modified_base (585)..(585): a, c, t, g, unknown or other
  misc_feature (585)..(585): n is a, c, g, or t
tcagtagtgtagatcacgaccggtgctcgatttagcactcgcacgttgggtttggggggaagaggaagactgacggtccccccaggagttcaggtgctgggcacggtgggcatgtgtgagttttgtcacaagatttgggctcaactctcctgtgcagcctctggattccaccttttggcagctttgccatgagctgggtccgccaggctccgaggggaagggctggaatgggtctcagccattagtagtagtggtggaagcacgtactacgctgactccggtgaacgggtccggttcnccctctccagacgacaacctccaaacaacacgctgtctctgacctaaacttaacagcctagacgagaccggaggaccacggcctatacttagngtagacggaaggaaggtctaggcagtcgccgtacggtacctaccctactactatacgtcggacgttcggtggggacaaaggtacgtcggcggtccaccgtctacctcacgccctaccgacgacggccctagtccggtccctcccgtcgaccctcccgtaccacccgacgaccgacctaccgtacggcgggaccncgcggcggtcccgg

SEQ ID NO: 156324 - DNA, 646 bp, Homo sapiens
  misc_feature: GYAE6OF01E3TFA.37.55.E11.1.454.CMB.1.raw
  modified_base (311)..(311): a, c, t, g, unknown or other
  misc_feature (311)..(311): n is a, c, g, or t
tcagtagtgtagatcacgaccggtgctcgatttagcactcgcacgttgggtttgggctgaactggctttttcttgtggctattttaaaaggtgtccagtgtgaggtgcagctgtcggagtctggggggaggcttggtacagcctggggggtccctgacactctcctgtgcagcctctggattcacctttggcagctttgccatgagctgggtccgccaggctccgaggggaaggggctggaatgggtctcagccattagtagtaggtggtggaagcacgtactacgctgactcgtgaagggtcgtcgcctntccagagacaactccaacaacacgctgtcctctgacaacttaacagacctgaagagacggaggacacgggcctatacttactgtagacggaagggaacgggtctagctaggtcgtcccgtggtacctcccaactactagtacgtcggacgtcgtaggggacaaaagggacgtaccggccggttaccgtacccggttcctcccttacgacgtccctcccgaacccggtaaacgggccccctaacggttccccggttcccgtttccccccggtcgggacccctacccccgttacccctacccgaaacgaccgaccctccccgtcgggtacccggggg

SEQ ID NO: 156325 - DNA, 196 bp, Homo sapiens
  misc_feature: GYAE6OF01DXAT5.37.55.E11.1.454.CMB.1.raw
  modified_base (168)..(168): a, c, t, g, unknown or other
  misc_feature (168)..(168): n is a, c, g, or t
  modified_base (174)..(196): a, c, t, g, unknown or other
  misc_feature (174)..(196): n is a, c, g, or t
tcagtagtgtagatcacgaccggtgctcgatttagcactcgcacgttgggtttgggggggaagaggaagactgacggtccccccaggagttcaggtgctggcacagcgccctgggctgcctggtcaaggactacttccatctacactactgagcgggctggcaaggcncatagnnnnnnnnnnnnnnnnnnnnnnn

SEQ ID NO: 156326 - DNA, 175 bp, Homo sapiens; identical to SEQ ID NO: 156281
  misc_feature: GYAE6OF01E4HPV.37.55.E11.1.454.CMB.1.raw
  modified_base (174)..(175): a, c, t, g, unknown or other
  misc_feature (174)..(175): n is a, c, g, or t

SEQ ID NO: 156327 - DNA, 569 bp, Homo sapiens
  misc_feature: GYAE6OF01C0XLV.37.55.E11.1.454.CMB.1.raw
  modified_base (376)..(376): a, c, t, g, unknown or other
  misc_feature (376)..(376): n is a, c, g, or t
tcagtagtgtagatcacgaccggtgctcgatttagcactcgcacgttgggtttggggggaagaggaagactgacggtcccccaggagttcaggtgctgggcacggtgggcatgtgtgagttttgtcacaagatttgggctcaactctcctgtgcagcctctggattcacctttggcagctttgccatgagctgggtccgccaggctccgagggaagggctggaatgggtctcagccattagtagtagtggtggaagcacgtactacgctgactccggtgaacgggccgttcgccctctccagagacaactccaacaacacgctgtctctgacaaacttaacagcctgagagacgaggacacggcctaatatactgngcgaaaggaggtcagcagtcgctggtactccactactatatggacgtgtgggacaaggatcgcggtcacgtctcctcacgcctccgaccgacgggcccacgtccgtcccttcccccgtcggccctaccccgtccctacccgaacgaccgcccgtacccgtcggtacggggccaaccgcggcccggtccccggg

SEQ ID NO: 156328 - DNA, 863 bp, Homo sapiens
  misc_feature: GYAE6OF01AUDLM.37.55.E11.1.454.CMB.1.raw
  modified_base (196)..(196): a, c, t, g, unknown or other
  misc_feature (196)..(196): n is a, c, g, or t
  modified_base (381)..(381): a, c, t, g, unknown or other
  misc_feature (381)..(381): n is a, c, g, or t
tcagtagtgtagatcacgaccggtgctcgatttagcactcgcacgttggggtttaggggggggaagaggaaggacgtgacggtcccccaggagttcaggtgctcgggcacggtgggcagtgtgtgagttttcgtcacaacgactttgggactcaacgtctcctggtcgcgacgcctctggacttcacctttggacncgtcctttcgcctagtcgacgtcgtcgggtccgccgaggcctccgaggggtacgggcctggaactgggtctcgacgcctagttagtaggtagttggtaggaagtctaccgtacgtacgctacgacctccggtaggaacggtaccggtcccgacctctactagactacgaaccgtaccaaacaacnccgccttaggtccgttcctacggtaacctaaacctttaaccgtacgtcccgtaggaaccgtacgaaccggtacggaacgacccggtaccgtaacgttaacgttaccgtcggtacgtacgggtaaacgggtaacgggtccgtaaggacgtaggtcggtaccggttacggttacccgtacccgtaactttaacgttaacgttaacgttacgggtaccggttacggtacggggtaaccgaaacggtaacgttaccggtcggttacccgaccggttccgtaaccccgtacggaccggtacccggttaccggaccggtaaccggggcccttaacggttcccggttaccccgttacccccggtacggtacccccgtaccccgtacccggtaaccccggtaacgtaccccggtaccccgtaccccggttacccgggtacccgggggtaaccccgttacccggtccccgggccccgggttaacccccggg

SEQ ID NO: 156329 - DNA, 792 bp, Homo sapiens
  misc_feature: GYAE6OF01C67LO.37.55.E11.1.454.CMB.1.raw
tcagtagtgtagatcacgaccggtgctcgatttagcactcgcacggttgggtttgggggaagaggaagactgacggtcccccaggagttcaggtgctgggcacggtgggcatgtgtcgtagttttgtcacaagatttgggctcaactctcctgtgcagcctctggattcacctttggcagctttgccatgagcgtgggtccgccaggcctccgaggggaagggctaggaatgggtctgagcctattagtagtagtgggtaggaagctacgtactacgctgactcgtaggaacgggtccgttcgccttcacaaggacaaccaacctaccaaacaaccaccggtctaggtcctacgtacgacctaaacttaaccgacggaccctaggaacgaacggaaccgaacggaccgaccggtaccgttaatacttaccgtagtacgacggaaaaggtacggtcgtaacgacgtacggtacgtaccgtaccggtaccctacccgtaaactttacgtaattacggttacgggtaccggttacggtagggggtaaccaaaaggttacggttaccggtacggttacccgtaaccgttcccgttaccgtcccgtaacggtaccccgtacccgtaacccggtaaacccgggtccccgtaaccggttccccgggttaccccgttaccccccggtaccggtaccccgtaccccgttaacccgtaaccccggaacggttacccgacccctaacccggtccggggttaccggggaaccctcccggtaacgggccccgggtacccccgggg

SEQ ID NO: 156330 - DNA, 613 bp, Homo sapiens
  misc_feature: GYAE6OF01DKNH7.37.55.E11.1.454.CMB.1.raw
tcagtagtgtagatcacgaccggtgctcgatttagcactcgcacgttgggtttggggggaagaggaagactgacggtccccccaggagttcaggtgctgggcacggtgggcatgtgtgagttttgtcacaagatttgggctcaactctcctgtgcagcctctggattcacctttggcagctttgccatgagctgggtccgccaggctccgagggaaggggctggaatggggtctcgagcctagttagtagtaggtggtaggaagcacgtactacgctgactcgtggaacgggccggttcgccctctccagacgacaactccaacaacacgctcgtctctgacaacttaacagcctagagagacgaggacacggacgtatacttacgtgcgacgaagggtaagggtctaggacgagtcgccgtcgtacctcccacttaactactagtacggacgtacggtcgggacgaaagacgtaccgcggtaccaccgtcctacctccgacgtaccctaccgaaccgaccggccctacgtcccggttcccttccccgcggtacccacccgtccaccgacgacgccaccgttcggcggggaccacggacgccggtaccccggg

SEQ ID NO: 156331 - DNA, 584 bp, Homo sapiens
  misc_feature: GYAE6OF01C1BI0.37.55.E11.1.454.CMB.1.raw
  modified_base (342)..(342): a, c, t, g, unknown or other
  misc_feature (342)..(342): n is a, c, g, or t
  modified_base (356)..(356): a, c, t, g, unknown or other
  misc_feature (356)..(356): n is a, c, g, or t
  modified_base (391)..(391): a, c, t, g, unknown or other
  misc_feature (391)..(391): n is a, c, g, or t
  modified_base (532)..(532): a, c, t, g, unknown or other
  misc_feature (532)..(532): n is a, c, g, or t
  modified_base (538)..(538): a, c, t, g, unknown or other
  misc_feature (538)..(538): n is a, c, g, or t
  modified_base (553)..(553): a, c, t, g, unknown or other
  misc_feature (553)..(553): n is a, c, g, or t
tcagtagtgtagatcacgaccggtgctcgatttagcactcgcacgttgggtttgggggaagaggaagactgacggtcccccaggagttcaggtgctgggcacggtgggcatgtgtgagttttgtcacaagatttgggctcaactctcctgtgcagcctctggattcacctttggcagctttgccatgagctgggtccgccaggctccgaggggaagggctggaagtgggtctcgagccaatttaggtagtagtggtggaaagcacggtactacgctgactccgtggaacgggtccgttcgccctctcccagacgaccaactaccaaacgaacacgctgtctntgacaaacttaacngcctgaacgagacgaaggacacggcctaatatacngtagcggaaaggagggtctagcagtcgctacggtactcccataactatagtggacgtcgtgggtacaaagacgtcgacggtctaccgtctcctacacgtccctacccgacgaaaccggcccaacgtcggtcccttccccgngacccncccgtccacctagcncccacgtccggagggcccagcggcggtcccg

SEQ ID NO: 156332 - DNA, 176 bp, Homo sapiens
  misc_feature: GYAE6OF01BCB1U.37.55.E11.1.454.CMB.1.raw
  modified_base (175)..(176): a, c, t, g, unknown or other
  misc_feature (175)..(176): n is a, c, g, or t
tcagtagtgtagatcacgaccggtgctcgatttagcactcgcacgttgggtttggggggaagaggaagactgacggtccccccaggagttcaggtgctgggcacagcggccctgggctgcctggtcaaggactacttccatctacactactgagcgggctggcaaggcgcatagnn

SEQ ID NO: 156333 - DNA, 550 bp, Homo sapiens
  misc_feature: GYAE6OF01AP5G2.37.55.E11.1.454.CMB.1.raw
  modified_base (334)..(334): a, c, t, g, unknown or other
  misc_feature (334)..(334): n is a, c, g, or t
  modified_base (467)..(467): a, c, t, g, unknown or other
  misc_feature (467)..(467): n is a, c, g, or t
  modified_base (498)..(498): a, c, t, g, unknown or other
  misc_feature (498)..(498): n is a, c, g, or t
  modified_base (504)..(504): a, c, t, g, unknown or other
  misc_feature (504)..(504): n is a, c, g, or t
tcagtagtgtagatcacgaccggtgctcgatttagcactcgcacgttgggtttggggggaagaggaagactgacggtccccccaggagttcaggtgctgggcacggtgggcatgtgtgagttttgtcacaagatttgggctcaactctcctgtgcagcctctggattcacctttggcagctttgccatgagctgggtccgccaggctccgaggggaaggggctggaatgggtctcagccagttagtagtagtggtggaagcacgtactacggctgactccgtggaagggccggtttcgcccctctccagagacaactccaacaacacgctgtcnctgcaacttaacagcctgagagacgaggacacggctaatattactgtgacgaaggaaggtctagcagtcgctcggtactccctactactatagtggacgtcgtgggacaaggatcgcgtcacgtctcctcgcnccctcaccacggccacgtcggtccttccccnggcccncccctccaccacgcgccaccgtcggacgggcacgcgccggtcccgg

SEQ ID NO: 156334 - DNA, 630 bp, Homo sapiens
  misc_feature: GYAE6OF01CWCT1.37.55.E11.1.454.CMB.1.raw
  modified_base (141)..(141): a, c, t, g, unknown or other
  misc_feature (141)..(141): n is a, c, g, or t
  modified_base (275)..(275): a, c, t, g, unknown or other
  misc_feature (275)..(275): n is a, c, g, or t
  modified_base (320)..(320): a, c, t, g, unknown or other
  misc_feature (320)..(320): n is a, c, g, or t
tcagtagtgtagatcacgaccggtgctcgatttagcactcgcacgttgggtttggggggaagaggaagactgacggtcccccaggagttcaggtgctgggcacggtgggcatgtgtgagttttgtcacaagatttgggctnaactctcctgtgcagcctctggattcacctttggcagctttgccatgagctgggtccgccaggctccagggaagggctggaatgggtctcagccattagtagtagtggtggagcacgtactacgctgactccgnggaacgggccgtccgccctctccagacgacaacctccaacaaccncgactgtctcgtgaccaaacttaacagccctagacgagaacgacggtaacgcggtaccttaattaacgttaccgtaggtgacgggaaaaggacgggtactaggcaggtcgtccttacgggtacctaccctaactacgtaactaacgtgggtacgtcggtacggggtacgaaaggtacgtaccggtcgtaccgtacccgtcctaccctcacgtccctaccgacgtacggccctacgttcccgtcctccccgtggccctaccctccctacgaacgaccgtccaccgtcggtacgggcacgcgccggtcccgg

SEQ ID NO: 156335 - DNA, 808 bp, Homo sapiens
  misc_feature: GYAE6OF01CZ7DQ.37.55.E11.1.454.CMB.1.raw
  modified_base (162)..(162): a, c, t, g, unknown or other
  misc_feature (162)..(162): n is a, c, g, or t
  modified_base (205)..(205): a, c, t, g, unknown or other
  misc_feature (205)..(205): n is a, c, g, or t
  modified_base (482)..(482): a, c, t, g, unknown or other
  misc_feature (482)..(482): n is a, c, g, or t
  modified_base (735)..(735): a, c, t, g, unknown or other
  misc_feature (735)..(735): n is a, c, g, or t
tcagtagtgtagatcacgaccggtgctcgatttagcactcgcacgttgggtttggggggaagaggaagactgacggtccccccaggagttcaggtgctgggcacggtgggcatgtgtgtagttttgtcacaagatttgggctcaactctcctgtgcagcctntggattctacctttggcagtctttgccatgagcgtcgggtccnccgaggcctccgagggagggctaggagtgggtctacgagtaccgtaattaggtaggttaggtgggtaggaacgccgaacgttaaccgtacgtacgttacgaccgttccggtaacggtaaccggggtcccggtttccgaccccttccgtaccgaaggacgtaaccaaccctaccaaaccaacctaccgcttcgtacctcgtaccgaactaacttaaccgacgtacctagaacgacggaacgacggaaccgtaccgggtacttaacgttacgttaacgnggggttacgtaacgggaaagggtacggtttacacgggtacgtacgggtccgtaccggttacggttaacccctaccctaagtttaaccgtaagttcggttaacggacggttacggtacgggtaaacgaacgggtacctccgggtaccgtcccgtaccgttccctacgtaccgtacccgccgtaacccaccgggtaaccgtcccgttaaccggtcccgtttacccctccccggtacccggtaccccctttacccnccccgttaaaccgaccggtaccgtccccgaacgggtccggttacggaccaacccgggtcggccccgttcgggg

SEQ ID NO: 156336 - DNA, 666 bp, Homo sapiens
  misc_feature: GYAE6OF01DJ8YZ.37.55.E11.1.454.CMB.1.raw
  modified_base (258)..(258): a, c, t, g, unknown or other
  misc_feature (258)..(258): n is a, c, g, or t
tcagtagtgtagatcacgaccggtgctcgatttagcactcgcacgttgggtttggggggaagaggaagactgacggtcccccaggagttcaggtgctgggcacggtgggcatgtgtgagttttgtcacaagatttgggctcaactctcctgtgcagcctctggattcacctttggcagtctttgccatgagctgggtccgccaggctccgaggggagggctggaatgggtctcagcctattagtagtagtggtggaancacgtactacgctgactccgtggaacgggccgttcgccctctccgagacgacaacctaccaacaacacgctgtctctgactaaactacagcctagaacgagaacggacggacaccgggtccgtaatacgttactggtcggacgaaaggggtacgggtctaggccgtaggtcgcccgtacgggttacctacccctaacttactaagttagtcgggaccggttcggtacggggaacgaaagggaacgtccggacggtaccgacccgttccgtccctacctaccgaccctaccgaaccgaacgggaccctacgttccggttccccgttacccccgtcgtcccctaccccttccacccgaacgacccgaccgacccgtacggcggggaccaccggcggtcccggtccccggg

SEQ ID NO: 156337 - DNA, 728 bp, Homo sapiens
  misc_feature: GYAE6OF01DWPYW.37.55.E11.1.454.CMB.1.raw
  modified_base (362)..(362): a, c, t, g, unknown or other
  misc_feature (362)..(362): n is a, c, g, or t
tcagtagtgtagatcacgaccggtgctcgatttagcactcgcacgttgggtttgggctgaactggctttttcttgtggctattttaaaaggtgtccagtgtgaggtgcagctgtcggagtctgggggagcttggtacagcctggggggtccctgacactctcctgtgcagcctctggattcacctttggcagctttgccatgagcgtgggtccgccaggctccgagggagggctggatgggtctcagccattagtagtagtggtaggaagcgtaacgtactacgctcgactccggtaggaacgggtccgttcgcctctccgagacgaaccactccaacacacgctgtctctgacaacttacngcctagagagacggacggacgacgggtccttaagttacttacgtggtacggaacgggaaaggggtaacggttcgtaaggcgtaacggttcggtacccgttaggtaacccttacccgtaacttaaccgttaagttacggtcgggtaccggtttacggtagggggaacaaacgggtaacgtcccgggtacggtacccgtaacccgttccgtcccgtacgtaccgtacccttaccccgaaccggtaacccgggtccctaaccggtttccccggtttacccccgttccccccggtcggaccccctcccccgttacccctaacccggaaaccggcccggtaccctaaccccggttcggggtaacccggggg

SEQ ID NO: 156338 - DNA, 623 bp, Homo sapiens
  misc_feature: GYAE6OF01E39H1.37.55.E11.1.454.CMB.1.raw
  modified_base (282)..(282): a, c, t, g, unknown or other
  misc_feature (282)..(282): n is a, c, g, or t
  modified_base (303)..(303): a, c, t, g, unknown or other
  misc_feature (303)..(303): n is a, c, g, or t
tcagtagtgtagatcacgaccggtgctcgatttagcactcgcacgttgggtttggggggaagaggaagactgacggtccccccaggagttcaggtgctgggcacggtgggcatgtgtgagtttttgtcacaagatttgggctcaactctcctgtgcagcctctggattcacctttggcagctttgccatgagctgggtccgccaggctccgaggggaagggctggaatgggtctcagccattagtagtagtggtggaagcacgtactacgctgacctccggngaacgggtccgttcgccctcnccagacgacaactccaaacacacgctgtctctgacctaacttaacagcctaggagagacgaggacacggctatcttagtgtagacggaaggagggtctaggacagtcgccgtaggtacctcccaacttaactatagtcggacgtcggtacgggacaaacggatccggtcggcctacccgtctaccctcgacgtccctacccgaaccgaacgggcccacgttccggtcccgttccccgtcggcccctaccccgtaccctacccgaaacgaccgaccctacccgtcgggtcggggacccaccgtaccgggcccggtcccggg

SEQ ID NO: 156339 - DNA, 597 bp, Homo sapiens
  misc_feature: GYAE6OF01EL0Q6.37.55.E11.1.454.CMB.1.raw
  modified_base (161)..(161): a, c, t, g, unknown or other
  misc_feature (161)..(161): n is a, c, g, or t
  modified_base (246)..(246): a, c, t, g, unknown or other
  misc_feature (246)..(246): n is a, c, g, or t
  modified_base (340)..(340): a, c, t, g, unknown or other
  misc_feature (340)..(340): n is a, c, g, or t
  modified_base (349)..(349): a, c, t, g, unknown or other
  misc_feature (349)..(349): n is a, c, g, or t
  modified_base (565)..(565): a, c, t, g, unknown or other
  misc_feature (565)..(565): n is a, c, g, or t
  modified_base (576)..(576): a, c, t, g, unknown or other
  misc_feature (576)..(576): n is a, c, g, or t
tcagtagtgtagatcacgaccggtgctcgatttagcactcgcacgttgggtttgggggggaagaggaagactgacggtccccccaggagttcaggtgctgggcacggtgggcatgtgtgagttttgtcacaagattgggctcaactctcctgtgcagcctntgattcaccttttggcagtctttgccatgagctgggtccgccaggctccgaggggaaggggctggaatggggtctcagcctaagntttaaggtaggtaggtggtggaaagcacgtactacgctgactccggtgacgggccgtcgccctctccagagacaactccaacaacacgctgtcnctgacaacnttaacagcctgaaggagacgacggtacaacggtcctagtagttacgagtaggccgaaaggaagggtctagccagtgccctcgtactcccatacgtaatatgggacgtacgtaggggcaacggtaactccgcggttccacccgtctccctccacgaccgtcccaccaacgggtccctacctccggtcctcccccctcgcccacccgtccctccaacncgccggacccncctcggggccgaccgtacggg

SEQ ID NO: 156340 - DNA, 661 bp, Homo sapiens
  misc_feature: GYAE6OF01B7GTQ.37.55.E11.1.454.CMB.1.raw
  modified_base (362)..(362): a, c, t, g, unknown or other
  misc_feature (362)..(362): n is a, c, g, or t
tcagtagtgtagatcacgaccggtgctcgatttagcactcgcacgttgggtttgggctgaactggctttttcttgtggctattttaaaaggtgtccagtgtgaggtgcagctgtcggagtctgggggaggcttggtacagcctggggggtccctgacactctcctgtgcagcctctggattcacctttggcagctttgccatgagctggtccgccaggctccgaggggaagggctggaatgggtctcagccattagtagtaggtggtggaagcacgtactacgctgactccggtgaacgggcggttccgccctctccagacgacaactcaaacaacacgctgtctctcgactaaacttaacngcctagaacgacgacgaacggtacacggccgtaattatacgtgtacggacggaaggtaaggtctacgctagtcgtacctacggtacctacccctaagttacctaagtacgttacggaccgtcggtaggggaaccaaaagggtactaccggaccggtacctacccgttcctaccctccgaacgtccccctacgaaacccgaaacggggcccctaaggttccccgttcccgttaccccccgcggtcccctaaccccttccccgtaaccgaacgaccgccctaacccggtcgggtaccgggg

SEQ ID NO: 156341 - DNA, 939 bp, Homo sapiens
  misc_feature: GYAE6OF01DBIKN.37.55.E11.1.454.CMB.1.raw
  modified_base (214)..(214): a, c, t, g, unknown or other
  misc_feature (214)..(214): n is a, c, g, or t
tcagtagtgtagatcacgaccggtgctcgatttagcactcgcacgttgggtttgggggaagaggaagactgacggtcccccaggagttcaggtgctgggcacgggtggcatgtgtgtagttttcgtcacaagtatttgggcctacaactcgtcctgtgcagtcctcgtggattcaccgtttggcctagtctttgcctagtcgagtcgtgggccnctaggcctacggaggggacgggtctagggaactcgggtctacgacgacctaagttacggtaggttagtgggttacggaacgtccgtaacggttaacttccggacttaccgggaccttaccggtagggtaaaccggggtcccgtttaccggcccctttacggtaccaaggttaccgaaccgtaaaccggtaccccaaaccgtaaaccgacggtcccgtttacggttaccctacgttaccggtaaccttaaaacccggtttaaaccgcgggtacccccgtttaaggaaacggggttaaacccgtaacccggggaaagggttaaaccccgaccgggggtttacccgttttaaacttaaccggtttaccggtttacgggtaccggaaaccggttaaaggggggtaacgggtttaccctaaaggtccgtaacgggtaccgttccgttaccggggttaacccttaccgtaaacgttaaccgttaacgtacgtttacgggaccggttacggtacggggtaaccgtaaaggtcgtacggtacggttacctaccggttccttaaccgcgttaacccggtaccccttaccggaaccgttaccggtacccgtacggttcccggttacccttcccccgggtacgttaccccggacccgtaccgtaacccgtaacggtacccgtacccgtaccggttccggttaccgggaaccgccgtccgggtccccgggtacccgg

SEQ ID NO: 156342 - DNA, 770 bp, Homo sapiens
  misc_feature: GYAE6OF01BE4AW.37.55.E11.1.454.CMB.1.raw
tcagtagtgtagatcacgaccggtgctcgatttagcactcgcacgttgggtttgggggaagaggaagactgaccggtcccccaggagttcaggtgctgggcacggtgggcatgtgtgtagttttgtcacaagatttgggctcaactctcctgtgcagcctctggtattcacctttggcagtctttgccatgagcgtcgggtccgccgaggcctccgaggggaagggctaggaagtgggtctcgagcctagttagtagtagtgggtaggaagcacggttactacgctgaccgtccggtaggaacgggtccggtccgccctctccagacgaaccaacctccaaaccacacgtcttcgtcctcgtacgtaacctaaaccgtttaacacgtcctaggaacgaacggacgaacgggacccgaccggtacgttaagttaacgttacggtagtacggaacggtaaacggggtaacggttcgtaacggacgtaggttaccggtaccggttacgtaccccgtaacctaaccgttaacgttagtacgtacggtacggtggtacgggaacgtaaacgacgtccggtaccggtacccgtccgtcccgtaccgtccgaccgtaccccgtacccgaccgtacccggtaccccgtaccgtttaccccggttccccttcccccggtaccgtacccccgtaccccgttaccccgtaaccgaaccgacccgtacccgtaccggtcccgggaccgggacctacccgggacccggtcccggtaccccggg

SEQ ID NO: 156343 - DNA, 585 bp, Homo sapiens
  misc_feature: GYAE6OF01BFLS6.37.55.E11.1.454.CMB.1.raw
  modified_base (310)..(310): a, c, t, g, unknown or other
  misc_feature (310)..(310): n is a, c, g, or t
  modified_base (499)..(499): a, c, t, g, unknown or other
  misc_feature (499)..(499): n is a, c, g, or t
  modified_base (543)..(543): a, c, t, g, unknown or other
  misc_feature (543)..(543): n is a, c, g, or t
  modified_base (571)..(571): a, c, t, g, unknown or other
  misc_feature (571)..(571): n is a, c, g, or t
tcagtagtgtagatcacgaccggtgctcgatttagcactcgcacgttgggtttgggctgaactggctttttcttgtggctattttaaaaggtgtccagtgtgaggtgcagctgtcggagtctgggggaggcttggtacagcctggggggtccctgacactctcctgtgcagcctctggattcacctttggcagctttgccatgagctgggtccgccaggctccagggaagggctggaatgggtctcagccattagtagtagtggtggaagcacgtactacgctgactcgtgaacgggccgttcgccctcnccagacgacaactccaacaacacgctgtctctgcaacttaacagtcctgagacgacgacggacacggccgtatacgttactgtagacggtaaggaagggtctaggcaggtcgacctggtacctcccgaattactatagtcggacgtcgtacggggacaaagggatccggcggtcaacccgttctccctnacggtccaccgaccgaagggccctagttccggtcccttccccgnggccctacccctcgtaccaagactcccncgttcgtccggggg

SEQ ID NO: 156344 - DNA, 616 bp, Homo sapiens
  misc_feature: GYAE6OF01DUOA7.37.55.E11.1.454.CMB.1.raw
  modified_base (293)..(293): a, c, t, g, unknown or other
  misc_feature (293)..(293): n is a, c, g, or t
  modified_base (302)..(302): a, c, t, g, unknown or other
  misc_feature (302)..(302): n is a, c, g, or t
  modified_base (439)..(439): a, c, t, g, unknown or other
  misc_feature (439)..(439): n is a, c, g, or t
tcagtagtgtagatcacgaccggtgctcgatttagcactcgcacgttgggtttggggggaagaggaagactgacggtccccccaggagttcaggtgctgggcacggtgggcatgtgtgagttttgtcacaagatttgggctcaactctcctgtgcagcctctggattcacctttggcagctttgccatgagctgggtccgcgaggctccgaggggaggggctggaagtgggtctcgagcctattagtagtaggtggtaggagcacgtactacgctgactcgtgagggccgtcncctctcagnacacacaacaacacgctagtctctgactaacttaacgacgcctagagacgaacggaggacacggactatagtactgtgacgaaggtacggtgtacgctaggtcgccgttacggtacctcccgtaactactattacgngtacggtcggtagggacaaaggtacgtcggtcgtaccgtaccgtctacccgccgtaccctacccgaaccgaccggtccctcgtacccgttccccttccccgtcgacccctacccgtacctacccgaagtccgacccgtcgtccgggtacgggacacgacggcccgtccggtccgggg

SEQ ID NO: 156345 - DNA, 807 bp, Homo sapiens
  misc_feature: GYAE6OF01AD9BT.37.55.E11.1.454.CMB.1.raw
  modified_base (360)..(360): a, c, t, g, unknown or other
  misc_feature (360)..(360): n is a, c, g, or t
  modified_base (366)..(366): a, c, t, g, unknown or other
  misc_feature (366)..(366): n is a, c, g, or t
  modified_base (437)..(437): a, c, t, g, unknown or other
  misc_feature (437)..(437): n is a, c, g, or t
tcagtagtgtagatcacgaccggtgctcgatttagcactcgcacgttgggtttggggggaagaggaagactgacggtcccccaggagttcaggtgctgggcacggtggcatgtgtgtagttttgtcacaagatttgggctacaacttctcctgtgccagcccttcgtaggacttcctaccgtttggactagtctttgcctagtgcgtcgttcgggcccaccgaggcctaccggaggggaacggggtcctagggaacgttcggggtacctacggaacgtcccttaagttagggtagttcgggtgggtacggaatccgaacgtacgtacgctaggtacctcggtaggacgggtccgttaccncccgtntccgagacgtaacgacctccaaactaccgcgtctggtcctcggtacacctaaccgttaacgcgtaccgtanaggtacgaaccggacgacgtacccgtacggttattaaccgtagtggtaaccgacgggtaaaggtcggtactacgggctaacggttcgaccgttaccggtacctaccctaacttacgttacgtaggttaccggcggttaacggggtgggaaaccgtaagggttaccgcccggtttacggtaccccgttacgtccgttacctccggacccgttccgaacccgttaccggaaccggtcccttaccggtccctaccccgttacccggtcccgaacccggtacccctacccggtaaccgacggtaacccgttacccgtaccgggtttaccccggggacggaccctcccggttaaggggcccccgttaacccgggg

SEQ ID NO: 156346 - DNA, 622 bp, Homo sapiens
  misc_feature: GYAE6OF01BJ24V.37.55.E11.1.454.CMB.1.raw
  modified_base (305)..(305): a, c, t, g, unknown or other
  misc_feature (305)..(305): n is a, c, g, or t
  modified_base (310)..(310): a, c, t, g, unknown or other
  misc_feature (310)..(310): n is a, c, g, or t
tcagtagtgtagatcacgaccggtgctcgatttagcactcgcacgttgggtttggggggaagaggaagactgacggtccccccaggagttcaggtgctgggcacggtgggcatgtgtgagtttttgtcacaagatttgggctcaactctcctgtgcagcctctggattcacctttaatacctattggatgagttgggtccgccaggttccgaggggaaggggctggaggtgggtcggccaaacataaagcaagagtggaagtgaagaaatactatgtggactctgtgaagggccattcaccatcncaganacaacgccagaactcattgatctgacaaatcgaacagactgagacgcgaggacacggtctgtgtattacgtgtgcgaggagagggaggcgagtttaggtagtaagtggtacgtcggtcttacgttactacttactactatagtcggtagtcggtagggacgaaacgggaccgtaacggtccgtacccgttcctaccctcgaccgtaccctcccaacccggtaccgggaccctaccggtcccggtttcccgtcccccgtcggcccctacccctacccctaccgaacgaccgccctacccgtcggtacccgggg

SEQ ID NO: 156347 - DNA, 769 bp, Homo sapiens
  misc_feature: GYAE6OF01CKO2L.37.55.E11.1.454.CMB.1.raw
tcagtagtgtagatcacgaccggtgctcgatttagcactcgcacgttgggtttggggggaagaggaagactgacggtccccccaggagttcaggtgctgggcacggtgggcatgtgtgagttttgtcacaagatttgggctcaactctcctgtgcagcctctggattcacctttggcagtctttgccatgagtctgggtccgccaggctccgaggggaaggggctggaagtcgggtctcagccattagtagtaggtggtaggaagcgtacgtactacgctcgactccggtggaacgggtccggttccgcccctctccaagacgaaccaacctaccaaacaaccacgcttcggttcctctcgaaccttaaacttaaccgacgtaccgtaggaacggtaacgaacggaacggaccgaaccgggtaccgtttaattacgtttacgtggtacggaacggtaaaggggtaacgggtctacgcgtacggtcgtaccgttacggtacccttaccctaacgttaacgttaattacgtacggtacggttcgggtagggggtaaacctaaagggtacgttaccggaccggtacctacccgtcctccgtaccgaccgtcccgtacccgaaccgtaccggacccctacggttcccgttccccgttacccccgtccggtacccctacccccgttacccgtaacccgtaaccggacccgtacccgtaccccggttccggggtaccggggaccctaacccgggccgggtccccgggtccccggg

SEQ ID NO: 156348 - DNA, 182 bp, Homo sapiens
  misc_feature: GYAE6OF01BT8F4.37.55.E11.1.454.CMB.1.raw
  modified_base (175)..(182): a, c, t, g, unknown or other
  misc_feature (175)..(182): n is a, c, g, or t
tcagtagtgtagatcacgaccggtgctcgatttagcactcgcacgttgggtttggggggaagaggaagactgacggtccccccaggagttcaggtgctgggcacagcggccctgggctgcctggtcaaggactacttccatctacactactgagcgggctggcaaggcgcatagnnnnnnnn

SEQ ID NO: 156349 - DNA, 203 bp, Homo sapiens
  misc_feature: GYAE6OF01DG8CT.37.55.E11.1.454.CMB.1.raw
  modified_base (173)..(173): a, c, t, g, unknown or other
  misc_feature (173)..(173): n is a, c, g, or t
  modified_base (181)..(203): a, c, t, g, unknown or other
  misc_feature (181)..(203): n is a, c, g, or t
tcagtagtgtagatcacgaccggtgctcgatttagcactcgcacgttgggttgggggaagaggaagactgaccggtcccccaggagttcaggtgctgggcacagccggccctgggctgcctggtcaaggactacttccatctaacactactgaggcgggctggacgaagggcncagtagcnnnnnnnnnnnnnnnnnnnnnnn

SEQ ID NO: 156350 - DNA, 837 bp, Homo sapiens
  misc_feature: GYAE6OF01C7568.37.55.E11.1.454.CMB.1.raw
tcagtagtgtagatcacgaccggtgctcgatttagcactcgcacgttgggtttggggggaagaggaagactgacggtccccccaggagttcaggtgctgggcacggtgggcatgtgtgagttttgtcacaagatttggggctcaactctcctgtgcagcctctggattcacctttggcagtctttgccatgagctgggtccgccaggctccgagggagggctggaatgggtctcgagcctagttaggtagtaggtgggtaggaagtccaacgttacacgctggtactccggtaggaacgggtccgttccgccctcgtaccgaaggacgaaccaacctacccgaaacaaaccgtaccgcgttacgttcctaccgtacgaacccgtaaacgttaaacccgacggtcccgtaaggaacggtaacgggaaccggtaaaacgggtaacccggaacccgggttaacccgttaaagtttaaccgtttaacgtcgggtaacggacggggtaaaacggggtacgggttactacggtacgtacggttcggtacccgttacggtacccctacccgtaacttaacgtaacgttaacggtacgggtacggttacgggtacgggaacgtaaagggtaccgtaccggtcggtacccgtacccgttcccgtaccaccgtaccgtaccccgttaacccgaaccgaacccgggtacccctaccggttaccccggttccccgttcccccggtaccggtaccccctaccccgtaccccgtaacccggaacgtacccggtacccgtaccccggttccgggtaccggggtaacccaccgggccggtcccgggtcccggg

SEQ ID NO: 156351 - DNA, 186 bp, Homo sapiens
  misc_feature: GYAE6OF01CGN8O.37.55.E11.1.454.CMB.1.raw
  modified_base (174)..(186): a, c, t, g, unknown or other
  misc_feature (174)..(186): n is a, c, g, or t
tcagtagtgtagatcacgaccggtgctcgatttagcactcgcacgttgggtttgggggaagaggaagactgacggtccccccaggagttcaggtgctgggcacagcggccctgggctgcctggtcaaggactacttccatctacactactgagcgggctggcaaggcgcatagnnnnnnnnnnnnn

SEQ ID NO: 156352 - DNA, 182 bp, Homo sapiens
  misc_feature: GYAE6OF01A99L1.37.55.E11.1.454.CMB.1.raw
  modified_base (173)..(182): a, c, t, g, unknown or other
  misc_feature (173)..(182): n is a, c, g, or t
tcagtagtgtagatcacgaccggtgctcgatttagcactcgcacgttgggtttgggggaagaggaagactgacggtcccccaggagttcaggtgctgggcacagcggccctgggctgcctggtcaaggactacttccatctacactactgagcgggctggcaaggcgcatagnnnnnnnnnn

SEQ ID NO: 156353 - DNA, 852 bp, Homo sapiens
  misc_feature: GYAE6OF01C195U.37.55.E11.1.454.CMB.1.raw
  modified_base (335)..(335): a, c, t, g, unknown or other
  misc_feature (335)..(335): n is a, c, g, or t
tcagtagtgtagatcacgaccggtgctcgatttagcactcgcacgttgggtttggggggaagaggaagactgacggtccccccaggagttcaggtgctgggcacggtgggcatgtgtgagttttgtcacaagatttgggctcaactctcctgtgcagcctctggattctacctttggcagtctttgccatgagtcgtgggccgccagggctccgaaggggaagggctggaattggggtctcgagccaagtttaggtaagtaggtgggtaggaaacgcaacggtactacggctcgtactccggtaggaacggggtcccggtttccgccccttaccnccgaagaacgaccaaacctccaaacaaccacggctcgtcctctcgactaaacttaacacgccgtagacgaacggaacgacgggaacctaaccgggtaccgttaattaacgttaaccgtgggaagggtaaccgggaaaaggggtaacggggttacaacggggaccgtaagggtccggtcccggtacgggttaacccctacccctaaaacttaaccgttaacgttaggttaacgggtaaccgggttcgggttaacggggaaaccgtaaaaacggggtaacctcccggggtaccggtaacccgtaacccgttacccggttcccttaccccgaacgggtccccccttaaccccggaaacccgaacccggggtcccccgtaacgtcccccggggtttaccccttcccccccgggtacggacccccgtacccccctttccaaaccccggtaaacggcccgaacccttaacccggttccgggggaccgggaacccaaccggacggggaccccggtcccccgggg

SEQ ID NO: 156354 - DNA, 962 bp, Homo sapiens
  misc_feature: GYAE6OF01EBF6O.37.55.E11.1.454.CMB.1.raw
tcagtagtgtagatcacgaccggtgctcgatttagcactcgcacgttgggtttgggctgaactggtctttttcttgtggcttaattttaaaaggtgtcagtgtgaggtgcagctgtcggagtcgtggggggaggcttggtacaggccgtggggggtccctgacactctcctgtgcagcctctgtattctaccgtttggcagtctttgcatgagcgtcgggtcccgccaggccgtaccggaggggaagggtcgtagggtaacgttcgggtcctacgacgtaccgttaagtttaaggtaaggttagggttagggtaggaaacggccgtaaccgttaaccgtaccgtccgtacgtaacccgttccggttagggaaccggggtccccggtttcccgcccccttaccgttacccgaaggaaccggaacctaaaccctaacccgaaaccgaaaccgaccgttccgtacggttcccttacgtacggtaaaccttaaaaccgttaacgacgtaccggtaagaacggaaggacggaaccggtaaccgacgggtaccgttaaactttaacgttaccgtagggttacgggaacgggaaacggggttaacgggtaccgtaacggacgtacgggttccgtacccgttaccgggttaaccctaacccccgtaacgtttaactacgttaacggttaccgggtaccgggttacgggtaacggggaaacggaaacggggtaacgttcccggggtacccggttacccggtaacccccgtttcccggtaccccttcccggtacccgtaccccccgttaacccggaaccccgggttaaacccggtccccggttaaccccgggtttccccggttttccccccgttacccccccggtacccggtaaccccccgtttccccccgtaccccggttaaccgaaacccggaccctaccccgggttacccggtccgggtaccccggggg

SEQ ID NO: 156355 - DNA, 835 bp, Homo sapiens
  misc_feature: GYAE6OF01CCE23.37.55.E11.1.454.CMB.1.raw
  modified_base (182)..(182): a, c, t, g, unknown or other
  misc_feature (182)..(182): n is a, c, g, or t
tcagtagtgtagatcacgaccggtgctcgatttagcactcgcacgttgggtttggggggaagaggaagactgacggtccccccaggagttcaggtgctgggcacggtgggcatgtgtgagttttgtcacaagatttgggctcaactctcctgtgcagcctctaggattcaccttttggcgtnttgttcactagtgcgtcgggtcggccgacggacggtccgaccgggaagggggacgggtgtagggtagggttgggcgagtaagttatactagagtagtagtaggtaaggtaggttgtaggaggttaagtagtacgacgacgtccgtacggtaaggaaccggcttacgtaccactactctacgaagacgaactaacaacgaaacaaccactactactactgaacgtaaacaacgaacaacgtcgacgtaagaacgtaacgtaggaacctacgggactagtaggttaactacgaccgtagttacgaccggaaaccggttaaaacgggggtttagggtaacgtagtagacggtaacggtacggtacggggtaagggtagggttagttaggtttttaggttaagtttaacggttacggggtaaccggaaaccgggtaaagtaaccgttacgggtaccggttaccgtaacccggttttcctaccgttaacgtaccccgtaccccgtaacccggtaaaccgggtacccggttaacccgttaccggggttccccccgttttaaccccccggttacccccggaaccggtttaccccccccgtaaccttaaccccccgaaagggaaccccggttaaccgtccccccgggtttaaaccgggggg

SEQ ID NO: 156356 - DNA, 636 bp, Homo sapiens
  misc_feature: GYAE6OF01CEPHM.37.55.E11.1.454.CMB.1.raw
  modified_base (275)..(275): a, c, t, g, unknown or other
  misc_feature (275)..(275): n is a, c, g, or t
  modified_base (339)..(339): a, c, t, g, unknown or other
  misc_feature (339)..(339): n is a, c, g, or t
  modified_base (366)..(366): a, c, t, g, unknown or other
  misc_feature (366)..(366): n is a, c, g, or t
tcagtagtgtagatcacgaccggtgctcgatttagcactcgcacgttgggtttggggggaagaggaagactgaccggtccccccaggagttcaggtgctgggcacggtgggcatgtgtgagttttgtcacaagatttgggctcaactctcctgtgcagcctctggattcacctttggcagctttgccatgagcgtgggtcccgccaggctccgaggggaaggggctagggaatggggtctcgaagcctaagttagtagtaggtggtaagtagcanagtattacgcaagactccgtaggaacgggtccgttacaccatctaccaagacgacaatccgaanagcaacgctgttattgacatatgaacngcctgagacgccaggactcgacatatattagttgagtacgtaactttcgtttagactttagttaacttactccctagtacgaccgtaacgtcgggaccgaacggtaccctggtacctacgtcctaccgtcacgtccctaccgaaccgtaacgggccctaagttcccggtcccttcccccgtcggacccctacccctacccgtaccgaaagtaccgccgtacccgttcggacggggtaccaaaccggacggcccgggtcccgtgggtcccg

SEQ ID NO: 156357 - DNA, 682 bp, Homo sapiens
  misc_feature: GYAE6OF01CQLSF.37.55.E11.1.454.CMB.1.raw
  modified_base (394)..(394): a, c, t, g, unknown or other
  misc_feature (394)..(394): n is a, c, g, or t
  modified_base (435)..(435): a, c, t, g, unknown or other
  misc_feature (435)..(435): n is a, c, g, or t
tcagtagtgtagatcacgaccggtgctcgatttagcactcgcacggttggggtttggggggaagaggaagactgaccggtcccccaggagttcaggtgctgggcacggtgggcatgtgtgtagtttgtcacaagtatttgggctcaactctcctgtgcagcctcgtggattcaccgtttggctagtctttcgcctagtgagccgtgggtccgccgaggcctaccggagggggaacggggtctagggaagtgggtcctacgagctaagttagtagtaggtggtagaacgactacgtactacgtctcgtacgtccggtaggaacgggtccgtaccgcctctacgagaacgaccaactaccgaaacacgacgtctgtcctctacgaactaactaacncgctaggagaacgacgacgacgacgtacgtatacgttacgnggtacgaacggtaaaaggcggtactacggcgtacggttcgtaccggttacggtacctaccctaattaacgtaagtacggtacggacggttaggacgggaaacgaaaggtactcggtacgtaccaccggtctacctacgccgtacccacgaccgtaacggcctacggtccctccgttaccccgcgaccccgtacctccacgaacgtacccgtacacccgtacggcggaaccacggtccgccggtccgg

SEQ ID NO: 156358 - DNA, 693 bp, Homo sapiens
  misc_feature: GYAE6OF01BKITC.37.55.E11.1.454.CMB.1.raw
  modified_base (454)..(454): a, c, t, g, unknown or other
  misc_feature (454)..(454): n is a, c, g, or t
  modified_base (554)..(554): a, c, t, g, unknown or other
  misc_feature (554)..(554): n is a, c, g, or t
tcagtagtgtagatcacgaccggtgctcgatttagcactcgcacgttgggtttggggggaagaggaagactgacggtccccccaggagttcaggtgctgggcacggtgggcatgtgtgagttttgtcacaagatttgggctcaactctcctgtgcagcctctggattcacctttggcagtctttcgacctatgacgtcgtcgggtcccgccgaggccgtacccggagggggaacggggtctagggaacgttcgggttacctcgacgccgtagttaaggtagtaggtagggtaggaagacgtaccgtactacgctacgaccgtccggtaggaacgggtccggttccgcctcgtacagtacaaccaacctaccaaacaaccgaccgtctcgtcctcgtacgacctaacttaacgcgtacgtagacgacgacggagacgacggtactaatagttacngtacgaaggtaaggacggttcgagacgtcgtacgtccgtacgtacctactactatagtacgacggtacgtcggtaggaacgaacggacgtcgtcgtaccncgtacctactacgaccgtcccgtaccaacgaccgggtacctacggttccccgtcccgttcccgaccgtaccctccctaccgaccgaacggccgtacccgacggtccggtacgggaccctacggcccggccggtcccggg

SEQ ID NO: 156359 - DNA, 663 bp, Homo sapiens
  misc_feature: GYAE6OF01ENCU0.37.55.E11.1.454.CMB.1.raw
  modified_base (209)..(209): a, c, t, g, unknown or other
  misc_feature (209)..(209): n is a, c, g, or t
  modified_base (551)..(551): a, c, t, g, unknown or other
  misc_feature (551)..(551): n is a, c, g, or t
  modified_base (558)..(558): a, c, t, g, unknown or other
  misc_feature (558)..(558): n is a, c, g, or t
tcagtagtgtagatcacgaccggtgctcgatttagcactcgcacgttgggtttggggggaagaggaagactgacggtcccccaggagttcaggtgctgggcacggtgggcatgtgtgtagttttgtcacaagtagtttgggctcaactctcctgtgcagcctctggacttctaccgtttggctagtcttgccatgagtcgtcgggtccnccgaggtcgtccggaaggggaacgggcgtaggaagttcgggtacctcgacggtacctaagttagtagttaggtaggtaggaagtccgaacgtacgtacgctcgaccgtcggtaggacgggtccggtcctcctacgtccgagtacgaaccaacctaccaaacacgacgtctcgtctacgtcactaaactacgcacgtagacggtacgacggacgacgtaccggtcttaaagttccgtacgttggacggaacggtaagggaacggttctagcgtagtcgtaccgtacgtaccctacaacttacaagtcgtacgggagtcggaacgagtaacgcgtcgccgaccncgtaccncctgacccgtcacccgaacgtaccgctacccggtcgtcccgttcccacgtccctacccgtacgacgaaccgctacccgcgtcggacggaccgcgcggtcccgcgg

SEQ ID NO: 156360 - DNA, 760 bp, Homo sapiens
  misc_feature: GYAE6OF01DPLD6.37.55.E11.1.454.CMB.1.raw
tcagtagtgtagatcacgaccggtgctcgatttagcactcgcacgttgggtttgggggaagaggaagactgacggtcccccaggagttcaggtgctgggcacggtgggcatgtgtgagttttgtcacaagatttgggctcaactctcctgtgcagcctctggattcacctttggcagtctttagccatgagcgtggtccgcaggctccgagggaacgggctggaatcggggtctcgacgcctaagttagtagtaggtggtaggagcgacgtactacgctagactccggtaggaacgggtccgttcgcccctgtaccagagaccaactcaacacgacgctagtctctacgactaacgttaacacgtcctagaagtacggacgaaggaccgacggtccgttaattaacgttacgtaggtacgacggaaaagggtacggttacgtacggtacaacggttcgaccgtttacggtaaccgttaccccgaacttaacgtaacgttaacggtcgggtaaccgtcgggtaaccggggtaactaaaacggggtcctaaccggtaccggtaccgtaccgtaccttaccggaccgtaccgtacccctacccgtaaccgtaaacccgggtcccctaacggtttaccccggttccccgttacccccggtcggaaccccgttaccccgtaccgtaacccgaacgttaacccgacccgttaaacccggttcgggtaacggggacccctaaaccgccggggtccccgtacccgggg

SEQ ID NO: 156361 - DNA, 915 bp, Homo sapiens
  misc_feature: GYAE6OF01A27OZ.37.55.E11.1.454.CMB.1.raw
  modified_base (217)..(217): a, c, t, g, unknown or other
  misc_feature (217)..(217): n is a, c, g, or t
tcagtagtgtagatcacgaccggtgctcgattttagcactcgcacgttgggtttgggctgaactggctttttcttgtggctattttaaaaggtgtccagtgtgaggtgcagctgtcggagtctgggggagcttggtacagcctggggggtccctgacactctctgtgcagcctctggattcacctttggcagtctttgccagtgacgctcgggtccnccaggctacgagggaagggctaggtaagtcgggtctcgagtcctaagtttaggtagttacgtgggtaggaacgccgtaacgtacgtacgcttagacctccggttaggaacggggtcccgtttcgcccctgtcccgaggacgaccaactacccaaacaaccgacgtctacggttcctacgttacgaccgttaaacttaaccgaggtcccttaggaacggtacggaaaccggagggtaacccgtaacggggttacccgttaaagtttaaacgtttacgttcggttaaccggacggtaacggaacggtacgttaccggaaacgggtaaccggggtaaacggttaacgtacgggtaaccgtaacggaccggttaacgtacccgtaacccgtttacggttacccgttaaccgggttacccgggggaaccccggtaaacccggggttaaccccggttaccgggttaaccccgttaaccccggtttaccccgttacccgttaacccgtacccgttaaccccgttacccccggtaaacccggtaaacccgggtacccccgttaacccggtttaccccgggtttacccccgtttccccccggttacccggttaacccccctaacccccggttaccccttaaaccccggtaaaccgtaacccggtaccccgtaaccccggttacccgggtacccgggggtaaaccccg

SEQ ID NO: 156362 - DNA, 680 bp, Homo sapiens
  misc_feature: GYAE6OF01ARAHV.37.55.E11.1.454.CMB.1.raw
  modified_base (185)..(185): a, c, t, g, unknown or other
  misc_feature (185)..(185): n is a, c, g, or t
  modified_base (317)..(317): a, c, t, g, unknown or other
  misc_feature (317)..(317): n is a, c, g, or t
  modified_base (337)..(337): a, c, t, g, unknown or other
  misc_feature (337)..(337): n is a, c, g, or t
  modified_base (608)..(608): a, c, t, g, unknown or other
  misc_feature (608)..(608): n is a, c, g, or t
tcagtagtgtagatcacgaccggtgctcgatttagcactcgcacgttgggtttggggggaagaggaagactgacggtccccccaggagttcaggtgctgggcacgggtgggcatgtgtgtagtttttgtcacaagatttgggctcaactctcctgtgcagcctcgtggattcctaccgtttggcngtctttcgccatggagtcgtggggtcccgccgagggccgtccggaagggggaaggggccgtagggaagtggggtcctcgagtccagtttaggtagtaggtgggtaggaagcgtaccgtactacgctgtaccnccggtaggacggtccggtcnccctccgtccagacgaaccaactacccaaacacaccgtctcgtctctacacctaactacgcgcctagagtacgaacggacgacgaccggtcctaatcttacgtcggtaggaacggaaaggacggtcgtagcgtagtcgtccgtacgtacctctaactaacttagtagtacggtccgtagggtacgggaataaacgagtaccggccgtacctaccgtcctccgtcgaccgtccctaccgaacccgtacgccctcgtcccgtccttcccccgngccccgtaccctcccggaactcggaccctcgtacccgcgggtccgggaccaccgtccgggcccggtacccgg

SEQ ID NO: 156363 - DNA, 184 bp, Homo sapiens
  misc_feature: GYAE6OF01BCIR3.37.55.E11.1.454.CMB.1.raw
  modified_base (174)..(184): a, c, t, g, unknown or other
  misc_feature (174)..(184): n is a, c, g, or t
tcagtagtgtagatcacgaccggtgctcgatttagcactcgcacgttgggtttggggggaagaggaagactgacggtcccccaggagttcaggtgctgggcacagcggccctgggctgcctggtcaaggactacttccatctacactactgagcgggctggcaaggcgcatagnnnnnnnnnnn

SEQ ID NO: 156364 - DNA, 906 bp, Homo sapiens
  misc_feature: GYAE6OF01DC9AQ.37.55.E11.1.454.CMB.1.raw
  modified_base (470)..(470): a, c, t, g, unknown or other
  misc_feature (470)..(470): n is a, c, g, or t
tcagtagtgtagatcacgaccggtgctcgatttagcactcgcacggttgggtttgggctgaactggtctttttcttgtggacttaattttaaaaggtgtccagtgtgaggtgcagctggtcggagtcgtgggggagcgttggacaggccgtgggggtccctgactactctcctgtcgcgacgcctcgtgtacttctaccgttgctagtcttcgcagtgacgtcgtcgggtccgcgtacgccgtacggaggggacggtcgtaggtacggtcggtcacgagtaccgtaagttaggttaggtaggtacggtaaggaacgtcgtaaccgttacgtacgtaccggtcgtaccggtacggtaacggggtacccggggtccggttacccgtcccgtacgaccgaagaaccgaaccctaacctaaccgaaactaccgaccgttcgtcgtacctcgtaacgtaacctaaaccgttaacncggaacggtagtaaacggaaccggaacggtaaccgaccggtaccggtacttaagttaacgtaccggttagggacggaaacggggtacgggtaacggtccgttaacggtacggtacgggttaccccgtaccggttaacccgtaacccgtacccgttaaactttggtttaaaccgacgggttccgggtaacgtaacccggggtggtaaaaccgtaggtacccggtcggaccccggtttaacccttcccgtacgtacccaacccggttaccacccccggaacccggtaaccggacccccgggtttaacccttacccccgggtttcccccggttacccccggttacccccgtacccgggacccccttaaccccgtttacccgaaacccggggtactacccccgggacccggtttaaccggggcccggggtaaaccccggg

SEQ ID NO: 156365 - DNA, 753 bp, Homo sapiens
  misc_feature: GYAE6OF01A7MIF.37.55.E11.1.454.CMB.1.raw
  modified_base (72)..(72): a, c, t, g, unknown or other
  misc_feature (72)..(72): n is a, c, g, or t
  modified_base (226)..(226): a, c, t, g, unknown or other
  misc_feature (226)..(226): n is a, c, g, or t
  modified_base (308)..(308): a, c, t, g, unknown or other
  misc_feature (308)..(308): n is a, c, g, or t
  modified_base (733)..(733): a, c, t, g, unknown or other
  misc_feature (733)..(733): n is a, c, g, or t
tcagtagtgtagatcacgaccggtgctcgatttagcactcgcacgttgggtttgggctgaactggctttttnttgtggctattttaaaaggtgtccagtgtgaggtgcagctgtcggagtctggggggaggcttggtacagccgtggggggtccctgacactctcctgtgcagcctctggattccacctttggcagtcttttcgcctatggagtcgtggggtcccnccagggctccgaagggggaggggtccgtagggtaagtggggtcctacgacgacctaagtttaggtagtaggtggtaggaacncgtaacgtactaacggcttcgaccgtccggtaggaacgggtcccggttccgccctaccgtccgaacggacgtaacaacctaccaaacaactccgcttcgtacctcgacgaacctaaacgtacacgacgaggaagaggacggaggaccgaccggtactattacgtacgtgaggaacgaagggtagtacgtagacgtagtccgtcggttaccgtaacctacccgtaacttacgtacgtacgtacggtacggttacgggtagggaaccgaaaagggttccggtaccgggttacccggtacccggtaacccgttccccgtttaccgacccgacccgtacccgtaccccgaaccggaacccggtaaccttccggttaccccgtcccgttccccgtcccgaacccgtcccctaaccgtaccgacgtacccnccgtacccggtgggtcccgg

SEQ ID NO: 156366 - DNA, 809 bp, Homo sapiens
  misc_feature: GYAE6OF01BHBIH.37.55.E11.1.454.CMB.1.raw
tcagtagtgtagatcacgaccggtgctcgatttagcactcgcacgttgggtttgggctgaactggctttttcttgtggctattttaaaaggtgtccagtgtgaggtgcagctgtcggagtcgtgggggaggcttgggtacaggccgtggggggtccctgacactctcctgtgcagcctcgtggtacttctaccgtttggctagtctttgcctagtgagtcgtcgggtcccgccgacggcctaccggaaggggaacggggctgggaagttcgggtcctacgacgctagtttaaggtagtaggtggtaggaagcgtaacgtactacgcgtacggacttcggtacggaacgggtccgttccgaccctcgacgaagacaaccacctaaccaacaacaccgtcgtcgtctacacgtacctaaccttaacgcgtaccgtaggaacgaacggaccggaacggtaaccgaccgggttaacgttaacgttactttacgtggtacgggaacgggtaaagggtacgggtacgtacggtaccgaggttcgtaccggttaccggtaaccctacccgtaacgttaacgttacgttaacggtacggtaccggttacgggtacgggaacgtaaacggtacgtaccgggtccggtacccgtacccgttacccgtacctaccggtacccgtcccgtaacccggaacccggtacccggtaccccgttaccgttccccggttaccccgttccccccgtccgggtacccctacccccgtaccccgtaaccgaacccgacccgtaccgtaccccggtcgggtaccccgggg

SEQ ID NO: 156367 - DNA, 778 bp, Homo sapiens
  misc_feature: GYAE6OF01D50VO.37.55.E11.1.454.CMB.1.raw
  modified_base (326)..(326): a, c, t, g, unknown or other
  misc_feature (326)..(326): n is a, c, g, or t
tcagtagtgtagatcacgaccggtgctcgatttagcactcgcacgttgggtttggggggaagaggaagactgacggtccccccaggagttcaggtgctgggcacggtgggcatgtgtgagttttgtcacaagatttgggctcaactctcctgtgcagcctcgtggattcacctttggcagtctttgcctatgagcgtcgggtcccgccgaggcctccgaaggggaacggggctagggaatgggtctacacggcctaagttaggtagtagtgggtaggaagcaacgtactacgctcgactccggtggaacgggtccgttacgcctcnccagacgacaacctccaaacaacgacgtctgtctctagactaacctagacgcctagagacgacgacgacgacggtcgtaattacttacgtggtacgacgggtaaaggtaacgggtacaggaccgtaggtcgtacccgttaggttacccctaacccgtaacgttaacgttaacgttaggtacccggggtaccgtttacgggtacggggaaacctaaaacgggacgtttcccgggacgggtttaccctaacccggttcccgtacccgtaccgtaccgtaccccttaacccgaacccggtaaccgggccccttaacggtttccccgggttaaccccctttcccccggaacggtcccccgttacccccttacccgttaaccgaaacggtaccgtaccccgtaacccggttcggggtaacccgggcccaaacccggtcgggtcccccggtcccgggg

SEQ ID NO: 156368 - DNA, 768 bp, Homo sapiens
  misc_feature: GYAE6OF01C77NB.37.55.E11.1.454.CMB.1.raw
  modified_base (344)..(344): a, c, t, g, unknown or other
  misc_feature (344)..(344): n is a, c, g, or t
  modified_base (350)..(350): a, c, t, g, unknown or other
  misc_feature (350)..(350): n is a, c, g, or t
  modified_base (366)..(366): a, c, t, g, unknown or other
  misc_feature (366)..(366): n is a, c, g, or t
tcagtagtgtagatcacgaccggtgctcgatttagcactcgcacgttgggtttggggggaagaggaagactgacggtccccccaggagttcaggtgctgggcacggtgggcatgtgtgagtttttgtcacaagatttgggctcaactctcctgtgcagcctctggattccacctttggcagtctttgccagtgagcgtcgggtccgccaggcctccgaaggggaagggctaggaagttcgggtctacgagcctattagtagtaggtggtagaagcacgtactacgctgacctcgtaggacgggtccgttccgccctctccgagacgaccaacctaccaacaacncgcgtntctctcactaactacncgctagacgagacggacgacgaccggtacgtaattcgtacgtggtacggtaacggaaagggttaacggtcgtaggacgtaggttccgaccggttaccggttaccctacccctaactttaccgtaagttaacggtcgggtaccgtttcgggtacgggaaaccgaaagggttaaccgtccgggtacccgggttaccctacccggttacccttaccgtcccgaaccggttcccctaccggaaccccgtaaaccgggtcccgttaaccggttaccccggttcccccgttccccccggttcggacccccttaacccccgttacccgtaaccccgacggaacccgtcccgtacccggttacccgggacgggggtacccaaacccgggccgggtcccgggtaccccggg

SEQ ID NO: 156369 - DNA, 784 bp, Homo sapiens
  misc_feature: GYAE6OF01BCTWW.37.55.E11.1.454.CMB.1.raw
  modified_base (513)..(513): a, c, t, g, unknown or other
  misc_feature (513)..(513): n is a, c, g, or t
tcagtagtgtagatcacgaccggtgctcgatttagcactcgcacgttgggtttgggggaagaggaagactgacggtccccccaggagttcaggtgctgggcacggtgggcatgtgtgagttttgtcacaagatttgggctcaactctcctgtgcagcctctggattcacctttggctagtctttgcctatgagtctcgggtccgaccgaggcctccgaaggggaagggtctggtaagtggggtctacgagacctaagttacggtaggtaggtggtaggaaacgtccgtaacgtacctaacggctacggaccttccggtaggaacggggtccgttccgcccgtcctaccgaggtacgaaccgtaacctacccgaaaaccaccgacgtcttacgtcctacgtacgtactaaacttaacgacgtacctaggaacgtacggaaaccggacggaaccgtaccggtaacctagttaacgttaccgtaggtacggtacggaaagggtaacggtctacggngtacgtcgaccgtcgtacctaccgtactaacgtacgtacgttacggtaccgtacgggtacggtaacgtaaacggaacgtcggtacggtaccctaccgtccgtaccctaccgtccgtaccccgtacccgaaccggtaacccggtccctaccgtacccggttcccgtacccccggtacggtacccccgtacccgttacccgtaacccgtaacgacccgtacccgtaccggttaccggaccggggtacccaccggtccggcccggttacccggg

SEQ ID NO: 156370 - DNA, 759 bp, Homo sapiens
  misc_feature: GYAE6OF01A5CTE.37.55.E11.1.454.CMB.1.raw
  modified_base (365)..(365): a, c, t, g, unknown or other
  misc_feature (365)..(365): n is a, c, g, or t
tcagtagtgtagatcacgaccggtgctcgatttagcactcgcacgttgggtttgggggaagaggaagactgacggtcccccaggagttcaggtgctgggcacggtgggcatgtgtgagttttgtcacaagatttgggctcaactctcctgtgcagcctctggattcacctttggcagtctttgccatgagctgggtccgccaggctccgaggggaaggggctaggaagtgggtctcagccattagtagtagtggtggaagcacgtactacgctgacctccgtggaacgggtcccggttcgcccctctccgagacgaccaactccaaacaaccaccggctcgtacctctacgacctaaacttaacncgtccgtagaggacgacggtacgggaccaccgggtaccgttaattacgttacgtggtcgacggaaacgggtaacgggtctaaggcgtaagtcggtacccgttcgggtacccctaccccgtaacgttaacgtaagttacggtacgggtaccggttacggttacgggggaactaaaacggggtacttcccgggtaccggtaacccgtacccgttccctacccgtaccgtaccggtacccctacccggaaccccgtaaccgggacccctacgttaccccggttcccttacccccgttcggaccccttaccccgttacccgtaccccgaaggacccgtacccctaccggttccgggttacggggaccccaccggtaccgggtccccgggtaccccggg

SEQ ID NO: 156371 - DNA, 684 bp, Homo sapiens
  misc_feature: GYAE6OF01BW5L1.37.55.E11.1.454.CMB.1.raw
  modified_base (328)..(328): a, c, t, g, unknown or other
  misc_feature (328)..(328): n is a, c, g, or t
tcagtagtgtagatcacgaccggtgctcgatttagcactcgcacgttgggtttgggctgaactggctttttcttgtggctattttaaaaggtgtccagtgtgaggtgcagctgtcggagtctgggggaggcttggtacaggccgtggggggtccctgacactctcctgtgcagcctctggattcacctttggctagtctttgcctagtgagcgtgggtccgccaggcctccgaggcagtgggctgcgaggtggtctacgaagtactagtgctcctggtaatagagacagactacgcagacgtccgtggaacgggtccgttaccacctntacctaccagacgaacaacttaccaaagacacgcctctatctagactaaagtgaaacacgcgtagaagacgaccggaacgaccgaaccggtacttaattaactttacgtggtaggtacggtaaagggtcggtaggggaagggtacgggggtaactacgggtacggggacccgtaacgggtacccgtcggtaccgacccggttccgtacccgtaccgaccggtaccctacccgaaccggaaccgggtcccctacgttccccggtccccttccccggtcggacccctaccccgtcccgtaaccacggaccgcccgtaccggtccggacggggccaaccgccggcccggtccggtcggg

SEQ ID NO: 156372 - DNA, 633 bp, Homo sapiens
  misc_feature: GYAE6OF01AH5ZV.37.55.E11.1.454.CMB.1.raw
  modified_base (292)..(292): a, c, t, g, unknown or other
  misc_feature (292)..(292): n is a, c, g, or t
tcagtagtgtagatcacgaccggtgctcgatttagcactcgcacgttgggtttgggctgaactggcttttcttgtggctattttaaaaggtgtccagtgtgaggtgcagctgtcggagtctgggggaggcttggtacagcctggggggtccctgacactctcctgtgcagcctctggattcacctttggcagctttgccatgagctgggtccgccaggctccgagggaggggctggaatgggtctcagcctattagtagtagtggtaggaagcacgtactacgctgactcgnggaacgggccggttcgccctctccagacgacaactccaaacaacacgctgtcctctgaccaacttaacacgtacctagacgagacgagaccgtacggccgtaataacttacgtcggtaggacggaacgggtaaggtcgtaagcgtagtcgccgtacggtacctccctaacttaccgtaatacgtcggacgttcgaggggaacgaaacggtcgtacgtaccggtacctaccgtctccctacgaccgtcctacccgaaccgacggcccacggttccgtacccgttcccccgcggtaccccacccgtcctaccaacgaccgtacctacccgtcggtaccggggg

SEQ ID NO: 156373 - DNA, 819 bp, Homo sapiens
  misc_feature: GYAE6OF01DWHSE.37.55.E11.1.454.CMB.1.raw
  modified_base (136)..(136): a, c, t, g, unknown or other
  misc_feature (136)..(136): n is a, c, g, or t
  modified_base (235)..(235): a, c, t, g, unknown or other
  misc_feature (235)..(235): n is a, c, g, or t
  modified_base (307)..(307): a, c, t, g, unknown or other
  misc_feature (307)..(307): n is a, c, g, or t
  modified_base (376)..(376): a, c, t, g, unknown or other
  misc_feature (376)..(376): n is a, c, g, or t
tcagtagtgtagatcacgaccggtgctcgatttagcactcgcacggttggggtttggggggaagaggaagactgaccggtcccccaggagttcaggtgcgtgggcgacgggtgggcagtgtgtgtagttttgtcanaagtagttgggctacaacttctccgtgtacgcgagtcctcgtgtacttcctaaccgtttggctagttcgttcgctagtagcgtcgtccggtccgaccgnggtaccgtacgggaacggggacgggtacggtaggtaaggtcggtctacgacgtactaagtaggtagtagggnggtaggacggtaccacgttaccgtaacgtcgtacgaccgttaccgggtagggtaaccggtccggtcccnccgttactaccgaagtaccgaacgttaccaccgaaactacgtaccgtcgtcttacacgactaaacttacgtacgacgtacgtagaaacggtacgagtaacgggactacggtataacttaaggtacgtacggaacggtaaacggtaaggttaaggaccgttagacgtaccggtaccgtacccggttaaggtaaccccttacgtaaaccgttaacgtaacgttaccgggtaacgttacggggtaaccgggtaaacgggtaacgtaaagggcccgtttaaccggtccgtaacccgtcccgtaacttcccggactaccgtaccgaccgaacccggttcgtaacgtccccgtaccgtcccgtcccgtacgtaccccgtacccgtagtaccgacggacccgttcgaacccggtcgggtacgacccgccgtccggggtaccgtcccgggg

SEQ ID NO: 156374 - DNA, 595 bp, Homo sapiens
  misc_feature: GYAE6OF01BOJ0M.37.55.E11.1.454.CMB.1.raw
  modified_base (323)..(323): a, c, t, g, unknown or other
  misc_feature (323)..(323): n is a, c, g, or t
  modified_base (386)..(386): a, c, t, g, unknown or other
  misc_feature (386)..(386): n is a, c, g, or t
tcagtagtgtagatcacgaccggtgctcgatttagcactcgcacgttgggtttggggggaagaggaagactgacggtccccccaggagttcaggtgctgggcacggtgggcatgtgtgagttttgtcacaagatttgggctcaactctcctgtgcagcctctggattcacctttggcagctttgccatgagcgtgggtccgccaggctccgaggggaagggctggaatgggtctcagccagttagtagtagtggtggaagcacgtactacgctgactcgtggaagggccgttcgccctctccagacgacaacctccaacaacncgctgtctctgactaaacttacacgcctgaagacgacgaggacgacggccgtaatacttacgngtacgacggaaaggaacgggtctaggcgagtcgccgtggtacctaccctactactatagtggtacgtcgtgggacaaggactacggcggtcctacgtcctcctcacgccctaccaccgacggccacgtccggtacccttccccgtcgccctacccgtccctaccgacgaccgcacccgtcggacgggaccaccgcggcccggtacccgg

SEQ ID NO: 156375 - DNA, 862 bp, Homo sapiens
  misc_feature: GYAE6OF01AED88.37.55.E11.1.454.CMB.1.raw
  modified_base (214)..(214): a, c, t, g, unknown or other
  misc_feature (214)..(214): n is a, c, g, or t
tcagtagtgtagatcacgaccggtgctcgatttagcactcgcacgttgggtttgggctgaactggctttttcttgtggctattttaaaaggtgtccagtgtgaggtgcagctgtcggagtctgggggagcttggtacagccgtggggggtccctgacactctcctgtgcagcctctggattcacctttggcagtctttagcatgagcgtggccncgagctcgagggagggctaggaagtcgggtctcgagtcctagttacgtagtaggtggtaggaacgcaacgtactacgctacgacgtcggtaggaacgggtccggttccgacccctacgtaccgaagacgaacctaacctacccaaaacaaccgacgtcctagttacctagtaccgaacttaaacttaaccgacggtaccgtagaacggacgaaaccggacggacgaccgggtaccttataacgttacgtaggtacggaacggtaaagggtacgggtactaaggtacgacgttcggacccgttacggtacctacccgtaacttaacgtagttacgtacgggtaccggtacggtacggggaaaccgaaagggtaccgttacccgggtaccgtaccgtaccccggttaccgttccccgtaaccgtacccggttaaccccgtaccccggtaaaccccgggtaaacccgggtacccccgttaacccggtttaccccggggtttaccccccccgttttaccccccgggtacccggttaacccccccggttaaaccccccgtttaccccggttaaaaccccccgtaaacccgggtttaaacccccgggaccccgtttaaacccccgggttcccggggggttaaacccccgggggg

SEQ ID NO: 156376 - DNA, 844 bp, Homo sapiens
  misc_feature: GYAE6OF01DB7Z2.37.55.E11.1.454.CMB.1.raw
  modified_base (200)..(200): a, c, t, g, unknown or other
  misc_feature (200)..(200): n is a, c, g, or t
  modified_base (275)..(275): a, c, t, g, unknown or other
  misc_feature (275)..(275): n is a, c, g, or t
tcagtagtgtagatcacgaccggtgctcgatttagcactcgcacgttgggtttggggggaagaggaagactgacggtcccccaggagttcaggtgctgggcacggtgggcatgtgtgagttttgtcacaagatttgggctcaactctcctgtacagcctctggattcacctttggcagtctttgccatgagctgggtccncgaggctaccgagggagggctggaagtgggtctcgagcctagttagtagtaggtggtaggaagcacgtactacgntagaccgtccggtaggaacgggtcccggttcgccctcgtaccagaacgacaaccgtaccaaacgtaaccacgctggtcctctagacctaaacttacgcgaccgtaggaacgaggaaccgacggaaccgaccggggtaccttaagtaacgtttacgtaggtacggaacggtaaacggggtaaacggttcgtaaacggcgttaaaggtcggtacccttaacgggttaccccttaccccgtaactttaaacccgttaagttaacggttacggggtaaccgtttaccggggtaacggggaaaccgtaaaacggggtacgtttacccgggtacccgggttaccgtaaccccggtttacgttaccccgtaccgtaccgtacccccgttaaccgaaaccccgggtaaccggggtccccttaacggttccccggtttaccctccccccggtacgggtaccccctacccccggttcccgtaacccggtaaacggtcccgaccccggtacccggttacggggttacccggggaaccgtaacccggcccgggttacccccgggtcccggttacccggggg

SEQ ID NO: 156377 - DNA, 205 bp, Homo sapiens
  misc_feature: GYAE6OF01DHJC3.37.55.E11.1.454.CMB.1.raw
  modified_base (165)..(165): a, c, t, g, unknown or other
  misc_feature (165)..(165): n is a, c, g, or t
  modified_base (170)..(205): a, c, t, g, unknown or other
  misc_feature (170)..(205): n is a, c, g, or t
tcagtagtgtagatcacgaccggtgctcgatttagcactcgcacgttgggtttggggggaagaggaagactgacggtcccccaggagttcaggtgctgggcacagcgccctgggctgcctgtcaaggactacttcatctacactactgagcggctggacaggcgnatagnnnnnnnnnnnnnnnnnnnnnnnnnnnnnnnnnnnn

SEQ ID NO: 156378 - DNA, 789 bp, Homo sapiens
  misc_feature: GYAE6OF01A6W16.37.55.E11.1.454.CMB.1.raw
  modified_base (212)..(212): a, c, t, g, unknown or other
  misc_feature (212)..(212): n is a, c, g, or t
  modified_base (248)..(248): a, c, t, g, unknown or other
  misc_feature (248)..(248): n is a, c, g, or t
  modified_base (352)..(352): a, c, t, g, unknown or other
  misc_feature (352)..(352): n is a, c, g, or t
  modified_base (389)..(389): a, c, t, g, unknown or other
  misc_feature (389)..(389): n is a, c, g, or t
  modified_base (732)..(732): a, c, t, g, unknown or other
  misc_feature (732)..(732): n is a, c, g, or t
tcagtagtgtagatcacgaccggtgctcgatttagcactcgcacgttgggtttggggggaagaggaagactgacggtccccccaggagttcaggtgctgggcacggtgggcatgtgtgagtttttgtcacaagatttgggctcaactctcctgtgcacgcctcgtggattccaccttttgggctagtctttgccatggagcgtggggtcccnccgaggctaccgaggggaagggctggaagtgggtcncagcctaattaggtagtggtgggtagaagctacgtactcgctcgacctcggtaggacgggtccgttccgccctctacgagaacgaacaacctaccaaaccaacnccggtactcgttcctcgtacgacctaaccgttaaacncggacctaggagaacggacgtaacggacccgaacgggtaccgtattacgttacgttagggtacggaacgggtaaacggggtaggtacgtaacggacgtacggtccgtaccggttcgggttaacccctacccgttaacgttaacgttaaggttacgtacgggtaccggtacggttacgggaacgtaaagggtaccgtcggaccggttaccgtaccgttcctaccgtaccgtacccgtacccgtaaccgaacccggtaccggacccgttaaccggttccccggtttaccccgttacccccggtacccgtaccccgtaccccgttacccgacaaacgggtaccccncggttaccccggtcggggtaccggacccgtaccgggcccgggtccccgggtcccggg

SEQ ID NO: 156379 - DNA, 761 bp, Homo sapiens
  misc_feature: GYAE6OF01BVXBY.37.55.E11.1.454.CMB.1.raw
tcagtagtgtagatcacgaccggtgctcgatttagcactcgcacgttgggtttgggggaagaggaagactgacggtccccccaggagttcaggtgctgggcacggtgggcatgtgtgagttttgtcacaagatttgggctcaactctcctgtgcagcctctggattcacctttggcagtctttgccatgagcgtgggtccgccgaggctaccgaggggaagggctaggaattgggtacctcgacgacctagtttaagtaaggtaggtggtaggaacgcgtaacgttactacggctagacctcggtggaacgggtccggtttcgccccttcgtaccgaaggacgaacctaaccgtaccctaaaccaaccgccgacgttcgtactaccttacgaacctaaaccttaacacgtaccgtaggaacgacggaacggacggacgacggtacctattaacgttacgtggtacgacggtaaaggtacggtctaacggcgtagtcgtaccgtacggtacctacccgtaacgttaactagtacgtacggtaccggtacggtaggggaacgaaacggtaacgtccggtaccggtaccgtaccgtcctacccgtaccgaccgtacccgtacccgaacccgaaccggtaccctaccgttcccggttccccgttacccccgtccggaccccgtccccgttaccctacccgtaaccggacccgtcccgtacccgggttccggacggggaccctaccggcccgggcccggtcccggg

SEQ ID NO: 156380 - DNA, 745 bp, Homo sapiens
  misc_feature: GYAE6OF01CQYAM.37.55.E11.1.454.CMB.1.raw
  modified_base (261)..(261): a, c, t, g, unknown or other
  misc_feature (261)..(261): n is a, c, g, or t
tcagtagtgtagatcacgaccggtgctcgatttagcactcgcacgttgggtttggggggaagaggaagactgacggtcccccaggagttcaggtgctgggcacggtgggcatgtgtgagttttgtcacaagatttgggctcaactctcctgtgcagcctctggattcacctttggcagctttgccatgagctgggtccgcaggctccgagggagggctggagtgggtctcgaggttattacgtggtagtaggtaataccgnatactacgcagctcgtaggacggcgttcacgtctaccagacgacaagttccaaagatacggtctatcgtaaggaatgaaactacgcctagaacgacgaccggtaaggaccgaccgggtccttacgttaactttaccgtgtaggaaccgagtaacggattaaccgaaggaaccggtaagtaacgtaaggaccgaggaccgtaagcctttacgtacgtacccgttaacggtcgggggacccgtaaccggtaaccccggtgggtaccctaacccgtcgtacccgtagacccgtccctacccgaacccgtaacggggcccctaaccggtttcccgttcccccgttacccccgtcggtacccccgtacccccgttacccaacccgtaaaacgggaccccgttaaccgtaccccggtttaccggggaccgggggtaccaacccgggtacccggtcccggggtcccccggtcggggtcccttaccccgggg

SEQ ID NO: 156381 - DNA, 707 bp, Homo sapiens
  misc_feature: GYAE6OF01DSW9P.37.55.E11.1.454.CMB.1.raw
  modified_base (307)..(307): a, c, t, g, unknown or other
  misc_feature (307)..(307): n is a, c, g, or t
  modified_base (479)..(479): a, c, t, g, unknown or other
  misc_feature (479)..(479): n is a, c, g, or t
tcagtagtgtagatcacgaccggtgctcgatttagcactcgcacgttgggtttggggggaagaggaagactgaccggtccccccaggagttcaggtgctgggcacggtgggcatgtgtgtagtttttgtcacaagtatttgggctcaacttctcctgtgcagcctctggtacttctaccgtttggcaggtctttcgcctattgaacggtcgtcgggtccgccagggtcctaccggaagggggaaacggggctagggaacgttcggggtactccgaagcctaagtttacgtaggtaggtggtaggaancaacgtacacgctagactccggtggaccgggtccgtccgcctctacgagtacgactaccgacaacctaacgctcttcgtctctacgtactaaactacgacgtcctaggacgacggacgacggtaccgacgtaccgttaatacgtacgtagtacggaggaaacggacgggttntacgagcggtctacgttcgacctaccgaatagtaactacgtcggtacgtcgggtacgggaagtaaacggtcgtacggtccgtcctacgttccaccgtacgaccctaccctacccgaaccgtacggcctaacgttcccctaccgttccccaccgtacccgacccctcccgaactaccgaacccgtccacccgttacgggacgggtacctcgccccgggcgttaccgggg

SEQ ID NO: 156382 - DNA, 844 bp, Homo sapiens
  misc_feature: GYAE6OF01D00YH.37.55.E11.1.454.CMB.1.raw
tcagtagtgtagatcacgaccggtgctcgatttagcactcgcacgttgggtttgggggaagaggaagactgaccggtcccccaggagttcaggtgctgggcacggtgggcatgtgtgagtttttgtcacaagatttgggctcaactctcctgtgcagcctcgtgattctaccgtttggcagtctttcgcctagtgagtcgttcgggtcccgccgacggccgtaccggaaggggtaacggggcgttagggaacgttcggggttacctacgaacggcccttaaggtttaaggttaggttagggtgggttaagggaaacgtccgaaaccggttacgttaacggcttcggaaccgtttccgggtaacgggtaaacgggggtcccgggtttcccgtacccccgtccgttaccgaacggtaaccgtaaacctaaacctacccgaaaacgaacctaccggtccttacggttcctacgttacgtaaccgtaaaacttaacacggtccgaggaaacgaacggacgacgggaaccgcggtaccgttaattaacgtacgtggtacgtacgggaaaggtacggtactaacggtcgtacgtcgtaccgttacggtacctacccgtaacttacgtacgtagtacggacgttacggtcgggaaacgtaaggtacgtcggtacggtaccctacgtcttacctacgtaccgtacccgtaaccgacccgaacggtcccgtacgttaccccggttcccgttcccgtaccggtaccccgtacccccgttacgtacccgaaacggacccgtacccggtacccggttcgggtaacggacccgaacggccggtccggtaccccgggg

SEQ ID NO: 156383 - DNA, 879 bp, Homo sapiens
  misc_feature: GYAE6OF01EB5AA.37.55.E11.1.454.CMB.1.raw
tcagtagtgtagatcacgaccggtgctcgatttagcactcgcacgttgggtttgggctgaactggtctttttcttgtggcttaattttaaaaggtgtccagtgtgaggtgcagctgtcggagtcgtgggggagtcttggtacaggccgtggggggtccctgactactctcctgtgcacgcctctggtacttctaccgtttggctagtctttgcctagtgagtcgtcgggtccgccgacggtcgtaccggaggggaacgggtcgtggtaggtcggttctacgtaggttactttacgtaggtacggttagggtaaccttaccggactaacgttaaccgtaacggtccaacggtaccgttccggtacggcccggggttacccgttccgacccgtaccgtaccgaaggtaactaaccgtaaacgttaaccgaaaacgttaacgtaccggttattacgtacgtaaggaaactacgaaaccgaccggtcgtaaggaacggtacggacccggaacggtaaccgtacccggtacccttattaacgttacgtaggtcgaacggtacgaacggtacgtaaggtaaccgggtaacggtagtaacgtagacgtaacgtaccgtacgtaccgttacggtaacgtaaccggtacccggacgggtaaccccggtaaccggtaaccccggttacggtaccgttaaccccggtccgtacccgtaccgtaccccggttaccccgtaacccgtaacccgggtacccggtccccgtaaccggttccccggtcccctttccccggtacccgtacccgtaacccccctaccggtaaccgaacccgtacgtaaccccgttcccgggtacgggttacccgggaccgtacccggtaccccgggg

SEQ ID NO: 156384 - DNA, 993 bp, Homo sapiens
  misc_feature: GYAE6OF01C810D.37.55.E11.1.454.CMB.1.raw
tcagtagtgtagatcacgaccggtgctcgatttagcactcgcacgttgggtttggggggaagaggaagactgacggtcccccaggagttcaggtgctgggcacggtgggcatgtgtgagttttgtcacaagattgggctcaactctcctgtgcagcctctggaacttctaccgtttggactagtcctttgccattgacgtcgtgggtccgccgaaggcctccgaaggggagggcgtaggtaagtggggtggaccaaacgaagttaccggaggggtacgggttagggtacgggttaaaacccggtaaaaaaacgttcgtaagggttacgggtaaaccgttccggttaaggggttccggggaaccgggggggtacccgttaaactttaccccgaacccggtaaactttaccccgtaacgaaaaccgggtaaacggtaaaacccgaaaaccccgggttaaaaaaccccaaaaaaccggttaccttaaacggttacggtaactttaaacccggaggttaaaaccgaaaacgggttacgggaacccggtaaccgtttaaggaaggttaacccgaaccgggtaaaccggggtaaaaccggcccgggttacgttacgggtttaaacgtttaagttttaccggtttaagggaacggtaccggtaaaggtaccgtttaaaaggttaccggtaaacgttaaacgttaaacgggtttacgaaagggtttcgaaacggttcggtttaaagtacggtaaacgtttcgtaacggttaagttaacggtaaccggttaacgggtaacggggtaacccggtaaacgggtaccgtaaggttccggtaaccgtaccgttacgtttaccgtctaaccggttcccaacccggtaaccggaaaccgggtcccaacccgggtttacccgttacccccggttcccgtaccgggtaccctcccggtaccgaccgttacggaccgttaaccgacccgtaacggtcccgaggtaacccgg

SEQ ID NO: 156385 - DNA, 739 bp, Homo sapiens
  misc_feature: GYAE6OF01BZPZF.37.55.E11.1.454.CMB.1.raw
tcagtagtgtagatcacgaccggtgctcgatttagcactcgcacgttgggtttggggggaagaggaagactgacggtccccccaggagttcaggtgctgggcacggtgggcatgtgtgagtttttgtcacaagatttgggctcaactctcctgtgcagcctctggattctacctttaatacctattggatgagttcgggtcctccaggttccgaggggaaggggctggagtgggtggaccaaacaagtaaagcaagagtaggaagtgaagaaatacgtatgtaggtactcgtggtaggaacgggtccgtaagttccgaacctatccgtccaaggacgaaccaaccggacccaaggtaacctctaagtttaggttactccgttagaacctaaagtacggaaaaccagtaacgtagaaggacgaccgggaacggaccgacggtcttaggttggttaacttacgtgggtacgacggaaggaggacggggaggtagtaaggtttaagtagtaaagtcgggtcgtcggttcctttaccgtaaccttacgttaactactacgtagtcggtacggttcgggtacggggacggtaaacgggaccgtaccggtacccgtaccgtcctacccgtcgtaccgacccgtcccgaacccgtaccggacccgtaccgtcccggttacccgttcccccggtccgcccctaccccgtcccgtacccgacgaccgccgtcccgtcgggtacccggg

SEQ ID NO: 156386 - DNA, 1147 bp, Homo sapiens
  misc_feature: GYAE6OF01D32NH.37.55.E11.1.454.CMB.1.raw
tcagtagtgtagatcacgaccggtgctcgatttagcactcgcacgtttgggtttgggctgaactggctttttcttgtggctattttaaaaggtgtccagtgtgaggtgcagctgtcggagtcgtgggggaggcttggtacagccgtgggggtccctgacactctctgtgcagcctctgattcacgtttggcagtctttgcctatggacgtcgttcggggcccgccgaacgggtccgtacccgggaaagggggttaaacgggggccgtaggggtaaacggtttaccggggtccttaccggaacggacccgttaaagttttaacgggttaaggttaacggggttggggttaacgggtaaaccggtacccgttaaaccgggttaaccgttaacccggtccgttaaggtaaacccggtttccccggggttaagggtaaaaccccgggggttcccccggggttttacccgggtcccccctttacccgttaacccggaacggtaaaccggtaaaccctaaaccccgttaacccaaaacccggaaacccttaaacccgggtcctttaccggttaaccctttctaaccgtaaccggttaaaaaccctttacgaaccggtacccgttaaggaaaccgggaagggtaaacccggaacggggtaacccgtaaacccgggggtacccttaaacggtttaaaaccgttttagtacggggtttaaccggaaacgggggttaaacggggtaaaaccgggggttaacctttaccggggacggttaacggttacccggtacccgtttaacccgggtttaacctaacccccgttaaacgtttaaaccgttaacgtttaacggtaccggggttaccgttacgggggttaacgggaaaccgtaaaacgggggttacctcccggggttaaccggggttaccccgttaaccccgggttaccctttaccccgtaaccggtaaccgtaccccccccggttaaaccccggtaaccccgggttaacccggtaaaccccgtttacccgggtttcccggtttaacccccccgtttaaccccccgggtcccggaaaccccccgtttacccccttacccccggaaccggtaaaacccgtccgtacccccggtaacccggtaggggttaccccggggg

SEQ ID NO: 156387 - DNA, 1083 bp, Homo sapiens
  misc_feature: GYAE6OF01E1747.37.55.E11.1.454.CMB.1.raw
  modified_base (109)..(109): a, c, t, g, unknown or other
  misc_feature (109)..(109): n is a, c, g, or t
tcagtagtgtagatcacgaccggtgctcgatttagcactcgcacgttgggtttgggctgaactggctttttcttgtggcttaattttaaaaggtgtccagtgtgaggtncagctgtcggagtcgtggggggaggcttggtacaggccgtggggggtccctgagactctcctgtgcagtcctctggtactttctaacgttttggtagtcttaagttgggattgggtaccgttcggggtcccgaccgtacggttccgtaccggaaggggggaacgggggtccgtggggagggttcggggtcggacctaaacgagtaaccggaggggggtagggttcgggttaagggtaaaccgtaaaaactggttaggttacggaccttcggtagggtcgggcccggggtaccgtacttacccacctacttaccgtaccgaaggaaccggaaaccgtaaacccgtaaacccaaaaaaccgttcctaacgttacggttaacttcggtaacgtaaaccgtaaaacggtccggggtaacccgtcgggtaacgtaaccggtaccggtacccgggaacgggtaaccgtaaccgggttccggtttaggtttaacgttttaaaggtttacggtttacgggtacgggtaaaccgggtaagggttaacggttttaaaacgtttaaaccggttaaaacccgtttaaaacgggtttaaacgggtttttacccgggtaagggtttaaccggttaaccgggtttaacgggttaaggtttacgggttaacggtttcggttaaccgttttaacggttaaccgggtttaaccggtttaaccccgggggtaacggggggtaaacccggtaacggggttaaacccgttaccgggttaccgggttaacccgttacccgtttaccgtttacccggttaccgaaccccgttacccgtaacccccggtaaacccggtaacccggttaaccccggttcccggttttaccccggttaccccccggtttcccccgggtacccggtcccccgggtaccccgttccgggttaacccccgtacccggggaacccggtaacccggttccccccggaaacccggg

SEQ ID NO: 156388 - DNA, 719 bp, Homo sapiens
  misc_feature: GYAE6OF01CT02V.37.55.E11.1.454.CMB.1.raw
  modified_base (394)..(394): a, c, t, g, unknown or other
  misc_feature (394)..(394): n is a, c, g, or t
tcagtagtgtagatcacgaccggtgctcgatttagcactcgcacgttgggtttgggggaagaggaagactgaccggtcccccaggagttcaggtgcgtgggcacggtggcagtgtgtgtagttttgtcaacgaagtagtttggcctacaaccttcgtcctgtcgcagccttcgtggtattccgaccgtttggcagtcttcgccagtgcgtcgtcggccaccgaggccgtaccggaggggaacgggtctaggtaagtgggtacctcgaagtcgtaaagttaaggtaggtaaggtcggtaaggaaaactcgtaaaccggttacgtaaccgcgtacgtacgtccggtagaaccgggtccgtccgtacctcgaccgaagacgaacactaccaacaacncgcgtatctcacgactaacttaacgcgtacctaaggacgaacgaacggtaacgccgttacggtactaacgttaccgtagtgtaaccggaaggttaaaagggacgttcgaagtacgcgttaccgcgtaaccggttacctaccgtaatacgtagtacgtacggtacgtacgggtacgaacgtaagttaccgacgtcggtaacctaccgtctacgtccaacgtcccgtacgaacgtccgaccgtacgctcccgccctgacccctccgtacccacgaacgtccgaacccgtcgtaccgggacggtaccacgccgggtcccgtacccggg

SEQ ID NO: 156389 - DNA, 811 bp, Homo sapiens
  misc_feature: GYAE6OF01B76DN.37.55.E11.1.454.CMB.1.raw
tcagtagtgtagatcacgaccggtgctcgatttagcactcgcacgttgggtttgggctgaactggcttttcttgtggctattttaaaaggtgtccagtgtgaggtgcagctgtcggagtcgtgggggaggcttgggtacaggccgtggggggtccctgacactctcctgtgcagcctctggacttcacctttggctagtctttcgccagtgagtcgtcgggtccgacgacggcctaccggaaggggaaggggctagggaacgttcgggtctcgacgtaccgtaagttaggtaaggtaggttggtaggaacgtcgtaacgtactacggtctacgtaaccgtcggtaggaacggggtccggttccgccccgttctaccgaggaacgaacctaaccaccaaactaaccgacgtcgttcgtctacacgtaactaaaccttaacgacgtaccgtagaacggacgtaaccggaaggtaaccgacggtaccttaagtacgttacgacgggtacggacgggtaaacgggtacggtactaacgcgtaacggtcggtaccgttaacggtaccctaacctaaccgttaacgtaacgtacgtacggtccggtaacggttacggggaaactaaaacggggtcgtaccggggtaccgtacccgtacccggttacccttaccgtaccgtaaccggtacccctacccggtaaacccggaaccgggttccccaaccggtttccccggtccccgttaccccggtccggacccctaccccgtaccctaacccggaacgacctcccggttaaccgtccggggtaaccgggg

SEQ ID NO: 156390 - DNA, 825 bp, Homo sapiens
  misc_feature: GYAE6OF01AP1EI.37.55.E11.1.454.CMB.1.raw
  modified_base (134)..(134): a, c, t, g, unknown or other
  misc_feature (134)..(134): n is a, c, g, or t
tcagtagtgtagatcacgaccggtgctcgatttagcactcgcacgttgggtttggggggaagaggaagactgacggtcccccaggagttcaggtgctgggcacggtgggcatgtgtgtagttttgtcacaagtnttgggctcaactctcctgtgcagcctgtggtattcacgttcgttggactcgttcgttacgctagtgacgtccggtcggtccgccgacggtccgaaccgggaagggggacggtcggtaggtacggtcggtcctacgcgtacgtagttaggtacggttaggtgggaacgacgtacgtaccgtacgtcgtacgtacgtcgtaccggagggtaccggtccggtacctcccgttacgacctacggaaccgaacctaaccgaccgtaaaccaccgtacggttccctacggttccttccggaacttaaacccgtaacctaaccggtaccgacggtaagggtaacggacgaacggggtaaccgtaccgggtaccggtttaacctaacgttacggttaacggccggttaagggaaacgggttaagggtacgtcggtagtccggtacgtccggttccgacgttaccctaacgtacgtattacggtaggtccggtaggtacgggacggtaacgaacggtccgttccggaccgttaccgtcccgtaccttaccgcggtacccgtcccgtaccgaacccggtccgtacccgttccgtccccggttaccgtccccgtaccgtccccttccccgtaccggtaccaccggtacccgtaccgggtacccggtacggtacgggaccccgtacgggtcccgtccccgggg

SEQ ID NO: 156391 - DNA, 712 bp, Homo sapiens
  misc_feature: GYAE6OF01EWCSL.37.55.E11.1.454.CMB.1.raw
  modified_base (403)..(403): a, c, t, g, unknown or other
  misc_feature (403)..(403): n is a, c, g, or t
  modified_base (436)..(436): a, c, t, g, unknown or other
  misc_feature (436)..(436): n is a, c, g, or t
  modified_base (454)..(454): a, c, t, g, unknown or other
  misc_feature (454)..(454): n is a, c, g, or t
  modified_base (459)..(459): a, c, t, g, unknown or other
  misc_feature (459)..(459): n is a, c, g, or t
tcagtagtgtagatcacgaccggtgctcgatttagcactcgcacgttgggtttggggggaagaggaagactgacggtccccccaggagttcaggtgctgggcacggtgggcatgtgtgagttttgtcacaagatttgggctcaactctcctgtgcagcctctggattccacctttggcagtctttgccatgagcgtgggtacccgccgaggctaccggaaggggaacggggctagggtaagtcgggttctacgagcctagtttaaggtagtagtgggtagaacgcaacgtaactacgctagaccgtccggtaggaacgggtcccggttaccgcccctccgtaccaagacgaaccaacctaccaaacgaaccacgtctcgtcgtactacgacctaacttacgcncgtagacgagaccgaggacacggtctatatcgngtacgacggaaggtagtntaagngtagtcggtccgtacggtacctaccgtaatacgtaatacgtcggtacgtgggacgggaaacgaaaggtacgtcggacccgtcgtaccgtccttacctcggacccgtaccctaacccgaaccggtaaccggacccctaacgttccccgttcccgttaccccccgtcggacccccgtcccgttacccaacccgtaacgtacgccccaaaccggtccgggtacggggaccctacggccgggccccgggtacccggg

SEQ ID NO: 156392 - DNA, 819 bp, Homo sapiens
  misc_feature: GYAE6OF01AOVRW.37.55.E11.1.454.CMB.1.raw
  modified_base (181)..(181): a, c, t, g, unknown or other
  misc_feature (181)..(181): n is a, c, g, or t
  modified_base (214)..(214): a, c, t, g, unknown or other
  misc_feature (214)..(214): n is a, c, g, or t
  modified_base (270)..(270): a, c, t, g, unknown or other
  misc_feature (270)..(270): n is a, c, g, or t
  modified_base (417)..(417): a, c, t, g, unknown or other
  misc_feature (417)..(417): n is a, c, g, or t
tcagtagtgtagatcacgaccggtgctcgatttagcactcgcacgttggggtttgggggggaagagggaagactgaccggtccccccagggagttcaggtgcgtgggcgacggtgggcatggtggtgtagtttttgtcacgaagagtttgggctacaacctctccgtagtcgcacgtcctntggatttccaccgtttgcagtctttgctatggncggttcgggtccgcgtacggcctaccggagggggacgggctaggagttcggtctancgactagttggtaggtggagggtgacgactacggtactcgacgtcgaccgtcggacgggtacgggtccggttcccaccgtctacgagaccgaacctaccaacccgaactaccagccgtttcgtacctcgacgtaacctaacgtcgcncgagacgggagacgtaggacccggtacgtactacgttaacgtcgtaggggtaaccggacggggttaaacgggggtaccgtttcgaacggttaccggtacggtacggttacccggttaccgtaaccgttacccgtaaacttaccggttaagtccggttaacggggggttacgtacgggttaacgggtaacggtaaccggtacggtacccggttcggtaacccgttcctcccgtaacccgtccggtaacccgtaccccgacccggtaacccgtccgggtacccgtaaccgttccccgttacccggtaccccgtaccgtccccgtacccgttacccgtaccgtacggaccccgtaccggaccgttccggggacccggtaccggccgacccgggtccggtacccgg

SEQ ID NO: 156393 - DNA, 646 bp, Homo sapiens
  misc_feature: GYAE6OF01DYV2J.37.55.E11.1.454.CMB.1.raw
  modified_base (588)..(588): a, c, t, g, unknown or other
  misc_feature (588)..(588): n is a, c, g, or t
tcagtagtgtagatcacgaccggtgctcgatttagcactcgcacgttgggtttggggggaagaggaagactgaccggtcccccaggagttcaggtgctgggcacggtgggcatgtgtgtagttttgtcacaagatttgggctcaactctcctgtgcagcctctggattctacctttggcagtctttgccatgagtcgtgggtccgccaggctccgaggggaagggctggaatgggtctcgagcctagttagtagtaggtggtaggagtcgaacgttactacgctcggtacctccggtaggaacgggtccgttccgaccctctacagacgacaaccgtccaaaccaacgcgtctgtacctcgtacgacctaacttaacgactccgagaacggacgacggacgacgacgacgtatagttcgtgacgaaggaaggtacggtcacggctaggtcgtccgtacgtacctacccgtactactagtagtacggtagtacggtagggaaccaaaggtactacggtacggtcctaaccgtcctaccgtacaccgtacctaccgacgaccgaccgtacgtcccgttacctcccgtacncccgtaccctactaccgagacccgtctaccgtcggacggacaccgcggccgtcccggg

SEQ ID NO: 156394 - DNA, 189 bp, Homo sapiens
  misc_feature: GYAE6OF01DNY4G.37.55.E11.1.454.CMB.1.raw
  modified_base (157)..(157): a, c, t, g, unknown or other
  misc_feature (157)..(157): n is a, c, g, or t
  modified_base (173)..(189): a, c, t, g, unknown or other
  misc_feature (173)..(189): n is a, c, g, or t
tcagtagtgtagatcacgaccggtgctcgatttagcactcgcacgttgggtttgggggggaagaggaagactgacggtccccccaggagttcaggtgctgggcacagcgcctgggctgcctggtcaaggactacttccatctacactactgagcggntggcaaggcgcaatgnnnnnnnnnnnnnnnnn

SEQ ID NO: 156395 - DNA, 765 bp, Homo sapiens
  misc_feature: GYAE6OF01D4VFP.37.55.E11.1.454.CMB.1.raw
tcagtagtgtagatcacgaccggtgctcgatttagcactcgcacgttgggtttgggctgaactggcttttcttgtggctattttaaaaggtgtccagtgtgaggtgcagctgtcggagtctgggggaggcttggtacagccgtggggggtccctgacactctctgtgcagcctcgtaggtacttccgtaccgtttggactagtctttcgccagttgacgtcggttcgggtacccgcccgaggtcctaccgggaaggggaacgggtcgtaggaagtcgggtctacgacgtactaagttacgtaggtaggttggtaggaacgaccgtacgtacctaccgtcgtacgacccgtcggtaagggaccgggtccggttcccgtccctacgtccgaagacgaactaacctaccaaacaccacgtcgtactctcgtacactaactacacgctaggacgacggacgaccggtacgaccgggtacttagtaacgttcgtggtaagaacggggtaaggtaacggttacggtagtacgtacggtaccggtaccgttacggtacccttacccgtaactaacgttaagtacgtacgggtacgtacggtacgggaacgtaaacgggacgtaccggtccggtaccgtaccgttccctcgtcgacccgtcctacccgaaccgtaccggaccctaccggtacccggttccccgtacccgtccgcccccgtaaccctccccgtaacctaacggacccctacccgtacggtccgggtaccccggg

SEQ ID NO: 156396 - DNA, 933 bp, Homo sapiens
  misc_feature: GYAE6OF01DDZGT.37.55.E11.1.454.CMB.1.raw
tcagtagtgtagatcacgaccggtgctcgatttagcactcgcacgttgggtttgggctgaactggtctttttcttgtggctattttaaaaggtgtccagttgtgaggtgcagctgtcggagtcgtgggggaggcgttggtacaggccgttggggggtcccctgaccactctccgtgtgcacgcctcgtggtattcctaccgtttggcctgtcctttgccagttggacgccgtcgggtcccgaccgtacggccgtaccggagggggtaacggggcgtagggtaaaggttcgggtacctacgaacgtaccgtaagtttaggtacggttaaggttagggtaggtaaacgacccgtacggttaactaccgggtacttacggtacccgttaccgggtaacggaaccggggtccccggtttcccgacccctttaccgaccgtaaaacggaacgaaaccgtaaaccctaccccgaaaacgaaccgtaccgtacgtttactctttaaccacggaacttaaaccgttaaccgacgtaaccggtagaaacggtacggaaaccggacgggtaaacccgccgggttaaaccgtaacgttttaaccgtacgtacgggttaaacgggaacgggtaaacgggtaacgggttacgtaacggtacggtaacggttacggtaaccgtacggttaacccgttacccgtaactaacgttaagttacgtacggtacggtacgtaacgggtaacggaagtaacgtacgtaccggtaccgacccggtttttttttaccgccgttaccgaccgtacccgtaacccggtaacccggtaacccggtaaccccgttaccgtacccggttaccccggtttacccccggtacccgtaccccgttaacccctacccgtaccgtaaaccggtacccgtaccgtacccggttcggaaccccgggg

SEQ ID NO: 156397 - DNA, 860 bp, Homo sapiens
  misc_feature: GYAE6OF01EVP56.37.55.E11.1.454.CMB.1.raw
  modified_base (313)..(313): a, c, t, g, unknown or other
  misc_feature (313)..(313): n is a, c, g, or t
tcagtagtgtagatcacgaccggtgctcgatttagcactcgcacgttggggtttggggggaagaggaagactgaccggtccccccaggagttcaggtgctgggcacgggtgggcatgtgtgtagtttttgtacacaagtatttgggcttcaactctcctgtcgcacgtccttcgtggtacttcctaccgttttggcagtcctttgccagtgagcgtcgggtcccgccgaggccgtaccggaggggaaggggtcgtagggtaagttgggtcctacgacgtaccgtagtttaaggtaggtaggtgggtaggaacncgtaacgtacgtacgcgtcgaccgtcggtggtaaccgggtccggttccgcccttcgaccgaggtaacaaccaacctaccgaaaccaccgacgtcgtcgtactcgtacgactaaacttacgaccgtccgtaggaacgtaacggaaccggaacgggaacccgtacgggaaccgtttatttaaaacgttccggttagaccgggtaaacgggaaagggtacgggtcgtaaggtccgtaacgtccggtacccgtttacggtttaaccccaccgttaacgttaacgtagtacggttaacggtaccgggttacgggaagggaaaaccgttaacgggacgttcccgggtacccggtacctacccggttcctacccggaaccgtccgtaccccctaaccgaaaccccgggttcccgacccggttaccccgttcccggttaccccttcccccggtaaccgtccccccgttacccctaccggtaacccgaccggacccttacccggtaaccccgcggggtaacccggacccgaaccgggcccggtccccgggtcccgg

SEQ ID NO: 156398 - DNA, 955 bp, Homo sapiens
  misc_feature: GYAE6OF01DSHCV.37.55.E11.1.454.CMB.1.raw
  modified_base (399)..(399): a, c, t, g, unknown or other
  misc_feature (399)..(399): n is a, c, g, or t
  modified_base (444)..(444): a, c, t, g, unknown or other
  misc_feature (444)..(444): n is a, c, g, or t
tcagtagtgtagatcacgaccggtgctcgatttagcactcgcacgttgggtttgggggaagaggaagactgacggtccccccaggagttcaggtgctgggcacggtgggcatgtgtgtagttttgtcacaagatttgggctcaactctcctgtgcagcctctggtattccaccgttttggctagtctttcgcctatgagtcgtcgggtcccgccacggctaccggaaggggaacggggctaggaagttcgggtcctacgagcctaattaggtaggtgtgggtaggacgcgaacgttactacgtctcgacgtcccggtaggaaccgggtccgtcccgtcccttcgaccaggacgaaccaacctccgaaacaaccgacgtctgtctctagactaaacctancgtcgtagagaacgacggagaaccgcgggtacttaattacgttancggtaggaaccgggtaaagggtaacgttcggacgtcgtaacgtccggtaccgttaccggttacccgtaccctaaaccgttaccgttaagttacggttacgggtaccgggtttagggtaaccggggtaaacggtaaacgggttaccgtacccggggtccggttaacccggtaaccccgtttcccgttaccccggtaccgtaacccggtacccccgttaaccccggtaaaccccgggaacccgggtaacccccgtacccgggtttaacccccggttttcccccggttaccccccccggttaaccccgggtaccccccgttaaaccccccccggtttaccccgttttaaaacccccgggaaacccgggtttaaaaacccccccggttacccccgttaaaccccccgggggttttaaaccccggggggtaaacccggggggtaaacccccccggtttaaccccgggggtaaaaccccccggggggttcccccggggggttaccccccccgggggg

SEQ ID NO: 156399 - DNA, 828 bp, Homo sapiens
  misc_feature: GYAE6OF01D4X98.37.55.E11.1.454.CMB.1.raw
tcagtagtgtagatcacgaccggtgctcgatttagcactcgcacgttgggtttggggggaagaggaagactgaccggtccccccaggagttcaggtgctgggcacggtgggcatgtgtgagttttgtcacaagtatttgggctcaactctccgtgtgcagcctcgtggtattctacctttggcagtctttgcagtgagtcgtcgggtccgaccgacggccgtaccggaaggggaacggggcgtagggaaagtcgggtctcgacgaccttaagttaaggtaggtaggttacgggtagggaaacggtaccgtaaccggttacctacggctacgtaaccgttccggaagggtaccggggtcccgtttcccgaccccttccgaccgaagaacgtaaccaaaccgttaacccgaaaccgaaccgaccgtccgttaccgtccgtaccgtacgaaaccttaaaacgttaaccgaaccgtccgtaggaacgaacggtaaccggaacggaacccgtacggtacgttaactacgtttacgtaggtacgaacgggtaaagggtaacggtacgagtacgtacggttaccgcgttaccggtaacctacccgtaaactacgttaagtaacgtacggtacgtacgggtaacgggaacgaaacggtacggtccggtaccgtacctaccgtcctacccgtacgtacccgtaccctaacccggaaccgtaacccggtccctacggttccccgttcccgtaccccgtcggtacccctcccgttacccaacggaaccgtaccgaccctaccggttcgggacgggtaccaccgtccggcccggtaccgg

SEQ ID NO: 156400 - DNA, 168 bp, Homo sapiens
  misc_feature: GYAE6OF02GV85P.37.55.E11.1.454.CMB.1.raw
  modified_base (168)..(168): a, c, t, g, unknown or other
  misc_feature (168)..(168): n is a, c, g, or t
tcagtagtgtagatcacgaccggtgctcgatttagcactcgcacgttggttgggaagaggaagactgacggtccccaggagttcaggtgctgggcacagcggccctgggctgcctggtcaaggactacttccatctacactactgagcgggctggcaaggcgcatagn

SEQ ID NO: 156401 - DNA, 179 bp, Homo sapiens
  misc_feature: GYAE6OF02G05Y1.37.55.E11.1.454.CMB.1.raw
  modified_base (173)..(179): a, c, t, g, unknown or other
  misc_feature (173)..(179): n is a, c, g, or t
tcagtagtgtagatcacgaccggtgctcgatttagcactcgcacgttgggtttgggggaagaggaagactgacggtcccccaggagttcaggtgctgggcacagcggccctgggctgcctggtcaaggactacttccatctacactactgagcgggctggcaaggcgcatagnnnnnnn

SEQ ID NO: 156402 - DNA, 535 bp, Homo sapiens
  misc_feature: GYAE6OF02IWOGM.37.55.E11.1.454.CMB.1.raw
  modified_base (387)..(387): a, c, t, g, unknown or other
  misc_feature (387)..(387): n is a, c, g, or t
tcagtagtgtagatcacgaccggtgctcgatttagcactcgcacgttgggtttgggctgaactggcttttcttgtggctattttaaaaggtgtccagtgtgaggtgcagctgtcggagtctgggggaggcttggtacagcctggggggtccctgacactctcctgtgcagcctctggattcacctttggcagctttgccatgagctgggtccgccaggctccagggaaggggctggaatggggtctcagccattagtagtagtggtggaagcacgtactacgctgactccgtgaagggccggttcgccctctccagagacaactccaacaacacgctgtctctgcaacttaacagcctgagagacgaggacacggccgtatattacngtgcgaaggaagggtctagcagtgcctggtactcccactactatatggacgtctgggcaaaggatcgcggtcaccgtctcctcacgcctcaccagggcccagtccggtcttccccgtgccaccctcctccaagcgccacctctcgggg

SEQ ID NO: 156403 - DNA, 170 bp, Homo sapiens
  misc_feature: GYAE6OF02IR2YZ.37.55.E11.1.454.CMB.1.raw
  modified_base (169)..(170): a, c, t, g, unknown or other
  misc_feature (169)..(170): n is a, c, g, or t
tcagtagtgtagatcacgaccggtgctcgatttagcactcgcacgttgggttgggaagaggaagactgacggtccccaggagttcaggtgctgggcacagcggccctgggctgcctggtcaaggactacttccatctacactactgagcgggctggcaaggcgcatagnn

SEQ ID NO: 156404 - DNA, 174 bp, Homo sapiens
  misc_feature: GYAE6OF02GP8PN.37.55.E11.1.454.CMB.1.raw
  modified_base (171)..(174): a, c, t, g, unknown or other
  misc_feature (171)..(174): n is a, c, g, or t
tcagtagtgtagatcacgaccggtgctcgatttagcactcgcacgttgggtttggggaagaggaagactgacggtccccaggagttcaggtgctgggcacagcggccctgggctgcctggtcaaggactacttccatctacactactgagcgggctggcaaggcgcatagnnnn

SEQ ID NO: 156405 - DNA, 172 bp, Homo sapiens
  misc_feature: GYAE6OF02F5PDQ.37.55.E11.1.454.CMB.1.raw
  modified_base (172)..(172): a, c, t, g, unknown or other
  misc_feature (172)..(172): n is a, c, g, or t
tcagtagtgtagatcacgaccggtgctcgatttagcactcgcacgttgggtttggggaagaggaagactgacggtcccccaggagttcaggtgctgggcacagcggccctgggctgcctggtcaaggactacttccatctacactactgagcgggctggcaaggcgcatagn

SEQ ID NO: 156406 - DNA, 174 bp, Homo sapiens; identical to SEQ ID NO: 156404
  misc_feature: GYAE6OF02GP2A0.37.55.E11.1.454.CMB.1.raw
  modified_base (171)..(174): a, c, t, g, unknown or other
  misc_feature (171)..(174): n is a, c, g, or t

SEQ ID NO: 156407 - DNA, 200 bp, Homo sapiens
  misc_feature: GYAE6OF02JGVXJ.37.55.E11.1.454.CMB.1.raw
  modified_base (172)..(200): a, c, t, g, unknown or other
  misc_feature (172)..(200): n is a, c, g, or t
tcagtagtgtagatcacgaccggtgctcgatttagcactcgcacgttgggtttgggggaagaggaagactgacggtcccccaggagttcaggtgctgggcacagcggccctgggctgcctggtcaaggctacttccatctacactactgagcgggctggcaaggcgcatagnnnnnnnnnnnnnnnnnnnnnnnnnnnnn

SEQ ID NO: 156408 - DNA, 175 bp, Homo sapiens; identical to SEQ ID NO: 156258
  misc_feature: GYAE6OF02ISJEG.37.55.E11.1.454.CMB.1.raw
  modified_base (173)..(175): a, c, t, g, unknown or other
  misc_feature (173)..(175): n is a, c, g, or t

SEQ ID NO: 156409 - DNA, 178 bp, Homo sapiens
  misc_feature: GYAE6OF02G0QQ3.37.55.E11.1.454.CMB.1.raw
  modified_base (173)..(178): a, c, t, g, unknown or other
  misc_feature (173)..(178): n is a, c, g, or t
tcagtagtgtagatcacgaccggtgctcgatttagcactcgcacgttgggtttgggggaagaggaagactgacggtcccccaggagttcaggtgctgggcacagcggccctgggctgcctggtcaaggactacttccatctacactactgagcgggctggcaaggcgcatagnnnnnn

SEQ ID NO: 156410 - DNA, 552 bp, Homo sapiens
  misc_feature: GYAE6OF02F2WBI.37.55.E11.1.454.CMB.1.raw
tcagtagtgtagatcacgaccggtgctcgatttagcactcgcacgttgggtttgggctgaactggctttttcttgtggctattttaaaaggtgtccagtgtgaggtgcagctgtcggagtctgggggaggcttggtacagcctggggggtccctgacactctcctgtgcagcctctggattcacctttggcagctttgccatgagctgggtccgccaggctccagggaaggggctggaatggggtctcagccattagtagtagtggtggaagcacgtactacgctgactccgtgaagggccggttcgccctctccagagacaactccaaacaacacgctgtctctgcaacttaacagcctgagagacgaggacacggccgtatattactgtgcgaaggaagggtctagcagtgcctggtactcccactactatatggacgtcgtgggcaaaggatcgcggtcaccgtctcctcacgcctccaccacgggcccagtccggtccttcccccgtcggccctaccctccctcccaacgacgccaccctcgtcgggg

SEQ ID NO: 156411 - DNA, 173 bp, Homo sapiens; identical to SEQ ID NO: 156246
  misc_feature: GYAE6OF02F8CHP.37.55.E11.1.454.CMB.1.raw
  modified_base (173)..(173): a, c, t, g, unknown or other
  misc_feature (173)..(173): n is a, c, g, or t

SEQ ID NO: 156412 - DNA, 174 bp, Homo sapiens; identical to SEQ ID NO: 156252
  misc_feature: GYAE6OF02GK8PY.37.55.E11.1.454.CMB.1.raw
  modified_base (173)..(174): a, c, t, g, unknown or other
  misc_feature (173)..(174): n is a, c, g, or t

SEQ ID NO: 156413 - DNA, 174 bp, Homo sapiens; identical to SEQ ID NO: 156252
  misc_feature: GYAE6OF02F4JVE.37.55.E11.1.454.CMB.1.raw
  modified_base (173)..(174): a, c, t, g, unknown or other
  misc_feature (173)..(174): n is a, c, g, or t

SEQ ID NO: 156414 - DNA, 173 bp, Homo sapiens; identical to SEQ ID NO: 156246
  misc_feature: GYAE6OF02FYDPB.37.55.E11.1.454.CMB.1.raw
  modified_base (173)..(173): a, c, t, g, unknown or other
  misc_feature (173)..(173): n is a, c, g, or t

SEQ ID NO: 156415 - DNA, 174 bp, Homo sapiens; identical to SEQ ID NO: 156252
  misc_feature: GYAE6OF02GXQ8Z.37.55.E11.1.454.CMB.1.raw
  modified_base (173)..(174): a, c, t, g, unknown or other
  misc_feature (173)..(174): n is a, c, g, or t

SEQ ID NO: 156416 - DNA, 192 bp, Homo sapiens
  misc_feature: GYAE6OF02G7LWQ.37.55.E11.1.454.CMB.1.raw
  modified_base (174)..(192): a, c, t, g, unknown or other
  misc_feature (174)..(192): n is a, c, g, or t
tcagtagtgtagatcacgaccggtgctcgatttagcactcgcacgttggggtttgggggaagaggaagactgacggtcccccaggagttcaggtgctgggcacagcggcctgggctgcctggtcaaggactacttccatctacactacctgagcgggctggcaaggcgcatagnnnnnnnnnnnnnnnnnnn

SEQ ID NO: 156417 - DNA, 545 bp, Homo sapiens
  misc_feature: GYAE6OF02IJNRT.37.55.E11.1.454.CMB.1.raw
  modified_base (334)..(334): a, c, t, g, unknown or other
  misc_feature (334)..(334): n is a, c, g, or t
  modified_base (355)..(355): a, c, t, g, unknown or other
  misc_feature (355)..(355): n is a, c, g, or t
tcagtagtgtagatcacgaccggtgctcgatttagcactcgcacgttgggtttgggctgaactggctttttcttgtggctattttaaaaggtgtccagtgtgaggtgcagctgtcggattctgggggaggcttggtacagcctggggggtccctgacactctcctgtgcagcctctggattcacctttggcagtctttgccatgagctgggtccgccaggctccgagggaaggggctggaatggggtctcagccattagtagtagtggtggaagcacgtactacgctgactccgtgagggccgttcgccctctccagagacaactccaacaacncgctgtctctgcaacttaacngcctgagagacgagacacggctatatactgtgacgaaggaggtctagcagtgccgtggtactcccactactatatggacgtcgtgggacaaaggatcgcgtcaccgtctcctcacgcctaccaccgacggcccacgtccgtccttccccgtcgcccacccgtcctaccgaacgacgccaccgtcgtcggg

SEQ ID NO: 156418 - DNA, 174 bp, Homo sapiens
  misc_feature: GYAE6OF02IA4YU.37.55.E11.1.454.CMB.1.raw
  modified_base (173)..(174): a, c, t, g, unknown or other
  misc_feature (173)..(174): n is a, c, g, or t
tcagtagtgtagatcacgaccggtgctcgatttagcactcgcacgttgggtttgggggaagaggaagactgacggtcccccaggagttcaggtgctgggcacagcggccctgggctgcctggtcaaggactaattccatctacactactgagcgggctggcaaggcgcatagnn

SEQ ID NO: 156419 - DNA, 174 bp, Homo sapiens; identical to SEQ ID NO: 156252
  misc_feature: GYAE6OF02F79C7.37.55.E11.1.454.CMB.1.raw
  modified_base (173)..(174): a, c, t, g, unknown or other
  misc_feature (173)..(174): n is a, c, g, or t

SEQ ID NO: 156420 - DNA, 174 bp, Homo sapiens; identical to SEQ ID NO: 156252
  misc_feature: GYAE6OF02JGPCX.37.55.E11.1.454.CMB.1.raw
  modified_base (173)..(174): a, c, t, g, unknown or other
  misc_feature (173)..(174): n is a, c, g, or t

SEQ ID NO: 156421 - DNA, 563 bp, Homo sapiens
  misc_feature: GYAE6OF02HRP6A.37.55.E11.1.454.CMB.1.raw
  modified_base (383)..(383): a, c, t, g, unknown or other
  misc_feature (383)..(383): n is a, c, g, or t
  modified_base (416)..(416): a, c, t, g, unknown or other
  misc_feature (416)..(416): n is a, c, g, or t
tcagtagtgtagatcacgaccggtgctcgatttagcactcgcacgttgggtttgggctgaactggctttttcttgtggctattttaaaaggtgtccagtgtgaggtgcagctgtcggagtctgggggaggcttggtacagcctggggggtccctgagactctcctgtgcagcctctggtttcatctttagcaactacgccatgagctgggtccgccaggctccgagggaaggggctggagtgggtctcgaggtattacgtggtagtggtaataccgcatactacgcagactccgtgacgggccgttcaccgtctccagagacaattccaagaatacggtctatctggaaatgaacagcctagagagccgaggacacggccctntattactgtgcgagagatcagacggagtatagnagcagctctgactacgtgggaccacggaaccctggtcaccgtcctcctcacgcctaccacccgaacggacccacgtccggtccttccccgtcggcccaccctcctacccaacgacgccaccgtccgtcggggccaccgacgcccggg

SEQ ID NO: 156422 - DNA, 548 bp, Homo sapiens
  misc_feature: GYAE6OF02G3GBO.37.55.E11.1.454.CMB.1.raw
tcagtagtgtagatcacgaccggtgctcgatttagcactcgcacgttgggtttgggggaagaggaagactgacggtcccccaggagttcaggtgctgggcacggtgggcatgtgtgagttttgtcacaagatttgggctcaactctcctgtgcagcctctggattcacctttggcagctttgccatgagctgggtccgccaggctccagggaaggggctggaatgggtctcagccattagtagtagtggtggaagcacgtactacgctgactccgtgaagggccgttcgccctctccagagacaactccaacaacacgctgtctctgcaacttaacagcctgagagacgaggacacggcctatattactgtgcgaaggagggtctagcagtgctggtactcccactactatatggacgtcgtggggacaaaggaatcgcggtcaccgtctcctcacgcctccaccaacgggcccagtccggtccttcccccgtcggccctacccctcctcccaacgacgcacctcgtacggggccacgacgcggcccg

SEQ ID NO: 156423 - DNA, 540 bp, Homo sapiens
  misc_feature: GYAE6OF02GSGZP.37.55.E11.1.454.CMB.1.raw
tcagtagtgtagatcacgaccggtgctcgatttagcactcgcacgttgggtttgggggaagaggaagactgacggtcccccaggagttcaggtgctgggcacggtgggcatgtgtgagttttgtcacaagatttgggctcaactctcctgtgcagcctctggattcacctttggcagctttgccatgagctgggtccgccaggctccagggaagggctggaatgggtctcagccattagtagtagtggtggaagcacgtactacgctgactccgtgaagggccggttcgccctctccagagacaactccaacaacacgctgtctctgcaacttaacagcctgagagacgaggacacggccgtatattactgtgcgaaggagggtctagcagtgctggtactcccactactatatggacgtcgtgggcgaaaggatcgcggtcaccgtctcctcacgcctccaccaacggcccagtccgtccttccccgtcggcctaccctccctccaacgacgcacctcgtcggggcacgacgcggcccg

SEQ ID NO: 156424 - DNA, 173 bp, Homo sapiens; identical to SEQ ID NO: 156246
  misc_feature: GYAE6OF02IQJLS.37.55.E11.1.454.CMB.1.raw
  modified_base (173)..(173): a, c, t, g, unknown or other
  misc_feature (173)..(173): n is a, c, g, or t

SEQ ID NO: 156425 - DNA, 550 bp, Homo sapiens
  misc_feature: GYAE6OF02F21IC.37.55.E11.1.454.CMB.1.raw
tcagtagtgtagatcacgaccggtgctcgatttagcactcgcacgttgggtttggggggaagaggaagactgacggtcccccaggagttcaggtgctgggcacggtgggcatgtgtgagttttgtcacaagatttgggctcaactctcctgtgcagcctctggattcacctttggcagctttgccatgagctgggtccgccaggctccagggaaggggctggaatgggtctcagccattagtagtagtggtggaagcacgtactacgctgactccgtgaagggccggttcgccctctccagagacaactccaacaacacgctgtctctgcaacttaacagcctgagagacgaggacacggccgtatattactgtgcgaaggaagggtctagcagtgcctggtactcccactactatatggacgtcgtggggcaaaggaatcgcggtcaccgtctcctcagcctccaccaacgggcccatccggtccttcccctcggccaccctcctacccaacgacgccaccgtccgtcggggcacgacgccggtcccgg

SEQ ID NO: 156426 - DNA, 552 bp, Homo sapiens
  misc_feature: GYAE6OF02ILE6C.37.55.E11.1.454.CMB.1.raw
  modified_base (513)..(513): a, c, t, g, unknown or other
  misc_feature (513)..(513): n is a, c, g, or t
tcagtagtgtagatcacgaccggtgctcgatttagcactcgcacgttggggtttgggggaagaggaagactgacggtccccccaggagttcaggtgctgggcacggtgggcatgtgtgagttttgtcacaagatttgggctcaactctcctgtgcagcctctggattcacctttggcagctttgccatgagctgggtccgccaggctccagggaaggggctgggaatgggtctcagccattagtagtagtggtggagcacgtactacgctgactccgtgaagggccggttcgccctctccagagacaactccaacaacacgctgtctctgcaacttaacagcctgagagacgaggacacggcgtaatattactgtgacgaagggaaggtctagacagtgcctggtactcccactactatatggacgtcgtgggacgaaaggatcgcggtcaccgtctcctcacgcctaccaccgaacgggcccagtccgtccttccccgtcggccaccctccnccaacgacgccacctcgtcggggacacgcgcggtcccgg

SEQ ID NO: 156427 - DNA, 593 bp, Homo sapiens
  misc_feature: GYAE6OF02HRIMG.37.55.E11.1.454.CMB.1.raw
tcagtagtgtagatcacgaccggtgctcgatttagcactcgcacgttgggtttggggggaagaggaagactgaccggtcccccaggagttcaggtgctgggcacgggtgggcatgtgtgagttttgtcacaagatttgggctcaactctcttgtgcagcctctggattcacctttggcagtctttgccatgagctgggtccgccaggctccgaggggaaggggctggaatgggtctcagccattagtagtagtggtggaagcacgtactacgctgactccgtagaacgggtccgttcgccctctccagacgacaactccaaacaacacgctgtctctgactaaacttaacagcctgagagacgagacacggctatacttacgtgtgacggaaagggaagggttcaagcgagtcgtccgtcggtacctcccactactatagtcggtacgtcgtacggggacaaacggtacgtcgcggtaccgtacgtcctacctcgacgcctcccaccgaacggcccacgtccgtcccttccccgtcgccctaccctccctaccaacgacgcctaccgtcggtcgggccacgcggccgtcccgg

SEQ ID NO: 156428 - DNA, 594 bp, Homo sapiens
  misc_feature: GYAE6OF02HC7VH.37.55.E11.1.454.CMB.1.raw
  modified_base (201)..(201): a, c, t, g, unknown or other
  misc_feature (201)..(201): n is a, c, g, or t
  modified_base (258)..(258): a, c, t, g, unknown or other
  misc_feature (258)..(258): n is a, c, g, or t
  modified_base (270)..(270): a, c, t, g, unknown or other
  misc_feature (270)..(270): n is a, c, g, or t
  modified_base (297)..(297): a, c, t, g, unknown or other
  misc_feature (297)..(297): n is a, c, g, or t
  modified_base (344)..(344): a, c, t, g, unknown or other
  misc_feature (344)..(344): n is a, c, g, or t
  modified_base (383)..(383): a, c, t, g, unknown or other
  misc_feature (383)..(383): n is a, c, g, or t
  modified_base (474)..(474): a, c, t, g, unknown or other
  misc_feature (474)..(474): n is a, c, g, or t
tcagtagtgtagatcacgaccggtgctcgatttagcactcgcacgttgggtttgggggaagaggaagactgaccggtcccccaggagttcaggtgctgggcacggtgggcatgtgtgtagttttgtcacaagatttgggctcaactctcctgtgcagcctctggattcaccttttggcagctttgccatgagctgggtccnccaggctccaggggaagggctggaatgggtctcagccattagtagtagtggtggaancacgtactacgntgactcgtgaacgggccgttcgccctntccagacgacaactccaaacaacacgctgtcctctgacaacttaacncgtcctggagacgacgaggacacggccgtaatacttacngtgacgaagggaggtctagcagtcgctggtacctcccactactatatcggacgtcgtagggacaaaggactcgcggtccaccgtctcctcncgcctcccaccgaacgggcccaagtccgtacccttcccccgtggaccctacccctccctaccaaacggcgacccgtacccgttccggtcggggacctaccgtacggacccgggtccccgg

SEQ ID NO: 156429 - DNA, 552 bp, Homo sapiens
  misc_feature: GYAE6OF02HFQB3.37.55.E11.1.454.CMB.1.raw
tcagtagtgtagatcacgaccggtgctcgatttagcactcgcacgttgggtttgggctgaactggctttttcttgtggctattttaaaaggtgtccagtgtgaggtgcagctgtcggagtctgggggaggcttggtacagcctggggggtccctgacactctcctgtgcagcctctggattcacctttggcagctttgccatgagctgggtccgccaggctccagggaaggggctggaatgggtctcagccattagtagtagtggtacttacatatactacgcagactcagtgaggggccgttcaccatctccagggacaattccaagaacacactgtctctgcaaatgaacagcctgagagtcgaggacacggccttaatatttactgtgtgaagggacctctacgccccttatacgcagcggctggtcctggttacttgacgacgtggggccacgggaccctggtcacccgtctcctcacgcctaccaccacggcccagtccggtccttccccgtcggcccgccctcgcctcccgacggacgcctacccg

SEQ ID NO: 156430 - DNA, 560 bp, Homo sapiens
  misc_feature: GYAE6OF02IN2ET.37.55.E11.1.454.CMB.1.raw
tcagtagtgtagatcacgaccggtgctcgatttagcactcgcacgttgggtttggggggaagaggaagactgacggtccccccaggagttcaggtgctgggcacggtgggcatgtgtgagttttgtcacaagatttgggctcaactctcctgtgcagcctctggattcacctttggcagctttgccatgagctgggtccgccaggctccagggaaggggctggaatgggtctcagccattagtagtagtggtggaagcacgtactacgctgactccgtgaagggccggttcgccctctccagagacaactccaaacaacacgctgtcctctgacaacttaacagcctgagagacgaggacacggccgtaatattactgtgacgaaggagggtctagcagtgctggtactcccactactatatggacgtcgtgggacaaaggaactcgcggtcaccgtctcctcacgcctccaccaacgggcccacgtccgtccttccccgtcgccctaccctccctccaacgacgaccaccgtcgtcggggccacgacggccggtcccgg

SEQ ID NO: 156431 - DNA, 544 bp, Homo sapiens
  misc_feature: GYAE6OF02IOB9H.37.55.E11.1.454.CMB.1.raw
  modified_base (297)..(297): a, c, t, g, unknown or other
  misc_feature (297)..(297): n is a, c, g, or t
  modified_base (339)..(339): a, c, t, g, unknown or other
  misc_feature (339)..(339): n is a, c, g, or t
  modified_base (347)..(347): a, c, t, g, unknown or other
  misc_feature (347)..(347): n is a, c, g, or t
  modified_base (370)..(370): a, c, t, g, unknown or other
  misc_feature (370)..(370): n is a, c, g, or t
  modified_base (446)..(446): a, c, t, g, unknown or other
  misc_feature (446)..(446): n is a, c, g, or t
tcagtagtgtagatcacgaccggtgctcgatttagcactcgcacgttgggtttggggggaagaggaagactgacggtccccccaggagttcaggtgctgggcacggtgggcatgtgtgagttttgtcacaagatttgggctcaactctcctgtgcagcctctggattcacctttggcagctttgccatgagctgggtccgccaggctccagggaaggggctggaatgggtctcagccattagtagtagtggtggaagcacgtactacgctgactccgtgaagggccggttcgccctntccagagacaactcaaacaacacgctgtctctgcaattaacngcctgagngacgagacacggcgtatattacngtgcgaaggaggtctaagcagtcgctggtactacccactactatatcggacgtcgtgggacaaaggatcgcggtcncgtctcctcacgcctccaccaacgggcccagtcgtccttccccgtcggccaccctcctaccaacgacgcacctcgtcggggcacgacgccggtcccgg

SEQ ID NO: 156432 - DNA, 548 bp, Homo sapiens
  misc_feature: GYAE6OF02IL5S2.37.55.E11.1.454.CMB.1.raw
tcagtagtgtagatcacgaccggtgctcgatttagcactcgcacgttggggtttggggggaagaggaagactgacggtccccccaggagttcaggtgctgggcacggtgggcatgtgtgagttttgtcacaagatttgggctcaactctcctgtgcagcctctggattcacctttggcagctttgccatgagctgggtccgccaggctccgagggaaggggctggaatgggtctcagccattagtagtagtggtggaagcacgtactaagctgactccgtgaagggccggttcgccctctccagagacaactccaaacaacacgctgtctctgcaacttaacagcctgagagacgagacacggctatatactgtgcgaaggaggtctagcagtgctgtactcccactactatatgacgtcgtgggacaaggaatcgcgtcaccgtctcctcagcctaccaccgaacggcccaacgtccgtccttcccctcggtccaccctccctccaacgacgaccaccgtcgtccggggcaccgacgccggtcccgg

SEQ ID NO: 156433 - DNA, 565 bp, Homo sapiens
  misc_feature: GYAE6OF02F2KSW.37.55.E11.1.454.CMB.1.raw
  modified_base (202)..(202): a, c, t, g, unknown or other
  misc_feature (202)..(202): n is a, c, g, or t
  modified_base (208)..(208): a, c, t, g, unknown or other
  misc_feature (208)..(208): n is a, c, g, or t
  modified_base (216)..(216): a, c, t, g, unknown or other
  misc_feature (216)..(216): n is a, c, g, or t
  modified_base (218)..(218): a, c, t, g, unknown or other
  misc_feature (218)..(218): n is a, c, g, or t
  modified_base (220)..(220): a, c, t, g, unknown or other
  misc_feature (220)..(220): n is a, c, g, or t
  modified_base (222)..(222): a, c, t, g, unknown or other
  misc_feature (222)..(222): n is a, c, g, or t
  modified_base (224)..(224): a, c, t, g, unknown or other
  misc_feature (224)..(224): n is a, c, g, or t
  modified_base (226)..(226): a, c, t, g, unknown or other
  misc_feature (226)..(226): n is a, c, g, or t
  modified_base (228)..(228): a, c, t, g, unknown or other
  misc_feature (228)..(228): n is a, c, g, or t
  modified_base (230)..(230): a, c, t, g, unknown or other
  misc_feature (230)..(230): n is a, c, g, or t
  modified_base (235)..(235): a, c, t, g, unknown or other
  misc_feature (235)..(235): n is a, c, g, or t
  modified_base (239)..(239): a, c, t, g, unknown or other
  misc_feature (239)..(239): n is a, c, g, or t
  modified_base (248)..(248): a, c, t, g, unknown or other
  misc_feature (248)..(248): n is a, c, g, or t
  modified_base (250)..(250): a, c, t, g, unknown or other
  misc_feature (250)..(250): n is a, c, g, or t
  modified_base (252)..(252): a, c, t, g, unknown or other
  misc_feature (252)..(252): n is a, c, g, or t
  modified_base (278)..(278): a, c, t, g, unknown or other
  misc_feature (278)..(278): n is a, c, g, or t
  modified_base (280)..(281): a, c, t, g, unknown or other
  misc_feature (280)..(281): n is a, c, g, or t
  modified_base (283)..(283): a, c, t, g, unknown or other
  misc_feature (283)..(283): n is a, c, g, or t
  modified_base (286)..(286): a, c, t, g, unknown or other
  misc_feature (286)..(286): n is a, c, g, or t
  modified_base (318)..(318): a, c, t, g, unknown or other
  misc_feature (318)..(318): n is a, c, g, or t
tcagtagtgtagatcacgaccggtgctcgatttagcactcgcacgttggggtttggggggaagagggaagacgtgaccggtcccccaggagttcgaggttcgcgtgggtccactaggcggccctgggctgcctggtacaaggactacgttccatcctacacgtacttgagcgggctgggtccaagggcgcgatagtcagtgngcatgngagtgcangngngngngngngntgcgngcgngcgtctcgngngntctctgtcgactcgtcgtcgtcgtcngnngnctntatcgcgtcgcgcgcgcgcgaggagcggcggngtgcgcgtagtagttgtagtgagatagtacgtacgacgactacgagtagaggcgacgtacgactacgtcgtcgtacgtacgtactactactacgacgacgtactactacgtactacaacgtacgtacgacgtacgtacggacggacggacggacgacgtacgtacgtacgtagtacgtacgtagtagtagttaggtaggtcgtgtacggtggtcggtacggtacgtacgtacgtacgtacggtacgg

SEQ ID NO: 156434 - DNA, 549 bp, Homo sapiens
  misc_feature: GYAE6OF02GAGC3.37.55.E11.1.454.CMB.1.raw
  modified_base (364)..(364): a, c, t, g, unknown or other
  misc_feature (364)..(364): n is a, c, g, or t
  modified_base (371)..(371): a, c, t, g, unknown or other
  misc_feature (371)..(371): n is a, c, g, or t
  modified_base (380)..(380): a, c, t, g, unknown or other
  misc_feature (380)..(380): n is a, c, g, or t
tcagtagtgtagatcacgaccggtgctcgatttagcactcgcacgttgggtttgggggaagaggaagactgacggtcccccaggagttcaggtgctgggcacggtgggcatgtgtgagttttgtcacaagatttgggctcaactctcctgtgcagcctctggattcacctttggcagctttgccatgagctgggtccgccaggctccagggaagggctggaatgggtctcaggtattactggtagtggtaataccgcatactacgcagactccgtgaccgggccggttcaccgtctccagagacaattccaagaatacggtctatctaggaaatgaacagcctgagagccgagacacggccctntattacngtgcgaganatcgagacggagtatagcagcagctctgactacgcgggaccaacggaccctcggtccaccgtctcctcacgcctccaccgacggccacgtccgtccttcccgtcgcctaccctcctaccaacgacgccaccgtcgtcggggccacgaccggccggcccgtcggcgtcgg

SEQ ID NO: 156435 - DNA, 546 bp, Homo sapiens
  misc_feature: GYAE6OF02H23R1.37.55.E11.1.454.CMB.1.raw
  modified_base (364)..(364): a, c, t, g, unknown or other
  misc_feature (364)..(364): n is a, c, g, or t
  modified_base (371)..(371): a, c, t, g, unknown or other
  misc_feature (371)..(371): n is a, c, g, or t
tcagtagtgtagatcacgaccggtgctcgatttagcactcgcacgttgggtttgggggaagaggaagactgacggtcccccaggagttcaggtgctgggcacggtgggcatgtgtgagttttgtcacaagatttgggctcaactctcctgtgcagcctctggattcacctttggcagctttgccatgagctgggtccgccaggctccagggaaggggctggaatgggtctcagccattagtagtagtggtggaagcacgtactacgctgactccgtgaagggccggttcgccctctccagagacaactccaacaacacgctgtctctgcaacttaacagcctgagagacgaggacacggccctntattacngtgcgagagatcagacggagtatagcagcagctctgactacgtcggggccacggaacccgtggtccaccgtctcctcacgcctccaccgaacggcccactccgtccttccccgtcgccacccgtcctacccaacgacgccaccgtcgtcggggccaccgacgccggcccgtcggg

SEQ ID NO: 156436 - DNA, 561 bp, Homo sapiens
  misc_feature: GYAE6OF02INCYA.37.55.E11.1.454.CMB.1.raw
  modified_base (377)..(377): a, c, t, g, unknown or other
  misc_feature (377)..(377): n is a, c, g, or t
tcagtagtgtagatcacgaccggtgctcgatttagcactcgcacgttgggtttggggggaagaggaagactgacggtccccccaggagttcaggtgctgggcacggtgggcatgtgtgagttttgtcacaagatttgggctcaactctcctgtgcagcctctggattcacctttggcagctttgccatgagctgggtccgccaggctccagggaaggggctggaatgggtctcagccattagtagtagtggtggaagcacgtactacgctgactccgtgaagggccggttcgcccctctccagagaccaactccaaacaacacgctgtctctgcaacttaacagcctgagagacgaaggacacggcctaatattacngtgacgaaaggaggtctagcagtgcctggtactcccactactatatggacgtcgtgggacaaaggaagtcgcggtacaccgtctcctcacgcctccgaccgaacgggcccacgtccgtccttcccccgtcggcccaccctccctacaacgacgcaccgtcgtcgggccacgcggccggtcccgg

SEQ ID NO: 156437 - DNA, 555 bp, Homo sapiens
  misc_feature: GYAE6OF02GOS8O.37.55.E11.1.454.CMB.1.raw
  modified_base (310)..(310): a, c, t, g, unknown or other
  misc_feature (310)..(310): n is a, c, g, or t
  modified_base (386)..(386): a, c, t, g, unknown or other
  misc_feature (386)..(386): n is a, c, g, or t
tcagtagtgtagatcacgaccggtgctcgatttagcactcgcacgttgggtttgggctgaactggctttttcttgtggctattttaaaaggtgtccagtgtgaggtgcagctgtcggagtctgggggaggcttggtacagcctggggggtccctgacactctcctgtgcagcctctggattcacctttggcagctttgccatgagctgggtccgccaggctccagggaaggggctggaatgggtctcagccattagtagtagtggtggaagcacgtactacgctgactccgtgaagggccgttcgccctntccagagacaactccaacaacacgctgtctctgcaacttaacagcctgagagacgaggacacggccgtatattacngtgcgaaggaggtctagcagtgcctggtactcccactactatatggacgtcgtgggacaaaggatcggcggtcaccgtctcctcacgcctccaccgacgggcccacgtccggttccttcccccgtggccctaccccgtccctccgaacgacgcctacccgtcgtcgggg

SEQ ID NO: 156438 - DNA, 702 bp, Homo sapiens
  misc_feature: GYAE6OF02ITQHV.37.55.E11.1.454.CMB.1.raw
  modified_base (306)..(306): a, c, t, g, unknown or other
  misc_feature (306)..(306): n is a, c, g, or t
tcagtagtgtagatcacgaccggtgctcgatttagcactcgcacgttgggtttgggggaagaggaagactgacggtcccccaggagttcaggtgctgggcacggtgggcatgtgtgagttttgtcacaagatttgggctcaactctctgtgcagcctctggattcacctttggcagctttgccatgagctgggtccgccaggctccgaaggggaacggggctggaatgggtctcagccagttagtagtagtggtaggaagcacgtactacgctgactccgtaggaacgggtccggttcgcccttcnccagacgacaactccaacaacacgctgtctctgactaaacgttaacagcctagagagacgaggacacggcgttaatatacgtgtacgacggaaagggtaggttctaggactaaggtcgtacccggttagggttacccctaccgaaccgttaattaaacctggttacgggaaccgtttaccggagggggaaacctaaaggtaacggttccgacgggtactaaccggttcctacccgttacgaccgtcccgtaccgaaaccggtaaaccgggtcccctaaagtcccgggtttccccttaccccgggacgtacccctaccccgttaccctaccggaaattccgggaccctaaccccggttgggacccggggaaccctacgaccgggtcccgtcccgggg

SEQ ID NO: 156439 - DNA, 610 bp, Homo sapiens
  misc_feature: GYAE6OF02J2G3E.37.55.E11.1.454.CMB.1.raw
  modified_base (313)..(313): a, c, t, g, unknown or other
  misc_feature (313)..(313): n is a, c, g, or t
  modified_base (386)..(386): a, c, t, g, unknown or other
  misc_feature (386)..(386): n is a, c, g, or t
  modified_base (390)..(390): a, c, t, g, unknown or other
  misc_feature (390)..(390): n is a, c, g, or t
tcagtagtgtagatcacgaccggtgctcgatttagcactcgcacgttgggtttgggctgaactggcttttcttgtggctattttaaaaggtgtccagtgtgaggtgcagctgtcggagtctgggggaggcttgggtacagcctggggggtccctggacactctcctgtgcagcctctggattcacctttggcagctttgccatgagctgggtccgccaggctccagggaaggggctggaatggggtctcgagccattagagtagtggtggaagcaacgtactacgctgactccgtgaagggccgttcgccctnccagagacaactccaacaacacgctcgtctactgcaaacttacagcctgacagacgaggacacggccgtaatntacngtagcgaaggaggctaagcagtgccgtggtacctcccgacttactatagtcggtacgtcgtggggtacaaagggtactcggcgtcaaccggttctacccgtcacggtccctacccgaccgacgggcccctacggttcccggttacccttccccggtaccggcctaacccccgttccctacccgaacggaccggaccctacccggtacgttacccgggggg

SEQ ID NO: 156440 - DNA, 544 bp, Homo sapiens
  misc_feature: GYAE6OF02GJFNB.37.55.E11.1.454.CMB.1.raw
tcagtagtgtagatcacgaccggtgctcgatttagcactcgcacgttgggtttgggctgaactggctttttcttgtggctattttaaaaaggtgtccagtgtgaggtgcagctgtcggagtctgggggaggcttggtacagcctggggggtccctgacactctcctgtgcagcctctggattcacctttggcagctttgccatgagctgggtccgccaggctccagggaaggggctggaatgggtctcagccattagtagtagtggtggaagcacgtactacgctgactccgtgaagggccgttcgccctctccagagacaactccaacaacacgctgtctctgcaacttaacagcctgagagacgaggacacggcctaatattactgtgacgaaggaaggtctagcagtgcctgtacctcccactactatatggacgtcgtgggacaaaggatcgcgtcaccgtctcctcacgcctccaccacggcccagtccggtccttccccgtcgcccaccctcccaccaacgacgccacctcgtcgggg

SEQ ID NO: 156441 - DNA, 198 bp, Homo sapiens
  misc_feature: GYAE6OF02FRLJQ.37.55.E11.1.454.CMB.1.raw
  modified_base (181)..(198): a, c, t, g, unknown or other
  misc_feature (181)..(198): n is a, c, g, or t
tcagtagtgtagatcacgaccggtgctcgatttagcactcgcacgttgggtttcgggggaaagaggaacgactggacggtccccccacggagttcaggtgctgggccacagcggccctgggctgcctggtcaaggactacttccatctacactactgagcgggcctggcaaggcgcatagnnnnnnnnnnnnnnnnnn

SEQ ID NO: 156442 - DNA, 173 bp, Homo sapiens; identical to SEQ ID NO: 156246
  misc_feature: GYAE6OF02JBEZC.37.55.E11.1.454.CMB.1.raw
  modified_base (173)..(173): a, c, t, g, unknown or other
  misc_feature (173)..(173): n is a, c, g, or t

SEQ ID NO: 156443 - DNA, 757 bp, Homo sapiens
  misc_feature: GYAE6OF02IDHSV.37.55.E11.1.454.CMB.1.raw
  modified_base (125)..(125): a, c, t, g, unknown or other
  misc_feature (125)..(125): n is a, c, g, or t
tcagtagtgtagatcacgaccggtgctcgatttagcactcgcacgttggttggggaagaggaagactgacggtcccccaggagttcaggtgctggcacggtggcatgtgtgagtttgtcacaagnttggctcgaactctcctgtgcagcctctggattcgaccttggctagctttgcctatgagtcgtggtccacctaggtccttccgagggtaacgggtcctaggtaacgtgggtacctcgacgtcctagtttacgcgttagtcggtacggaacgtctacggttactacggtctacggaaccttcgggttgaaaccgggtcccgttacgacccccgttacgtaccgtaaggacggtaaccctaaccgttcccgaaaaccttaacgaccggtctttacggtccctacgtacgtacgtaaaccgtttaaccgggtacccgttaggaacgtacgtaaccggtaggtacctaaccgggtcttaacgttaacgttacgttcgggtaacgtaccgtaaagggttacggttcaacggttaccgtacgttcggtaccgttacggtaaccgttacccgaacgttacgtacgttacgtcggtacgtcgtacgggtacaacggttacgtacgtcgtaccgtacgtccgtcgtacgtccgtacgtccaaccgtacgtccgtacgtcgtaccttcccgtagtaccgtaccgtcctaccgtaaccgtcgtacctaccgtcgtaccgggtctacgtacgtccgtaacccgg

SEQ ID NO: 156444 - DNA, 560 bp, Homo sapiens
  misc_feature: GYAE6OF02FVF5J.37.55.E11.1.454.CMB.1.raw
  modified_base (371)..(371): a, c, t, g, unknown or other
  misc_feature (371)..(371): n is a, c, g, or t
tcagtagtgtagatcacgaccggtgctcgatttagcactcgcacgttgggtttgggggaagaggaagactgacggtcccccaggagttcaggtgctgggcacggtgggcatgtgtgagttttgtcacaagatttgggctcaactctcctgtgcagcctctggattcacctttggcagctttgccatgagctgggtccgccaggctccagggaaggggctggaatgggtctcagccattagtagtagtggtggaagcacgtactacgctgactccgtgaagggccggttcgccctctccagagacaactccaacaacacgctgtctctgcaacttaacagcctgagagacgaggacacggccgtatattacngtgcgaaggaggtctagcagtgcctggtactccactactatatggacgtcgtgggcaaaggaatcgcggtcaccgtctcctcacgcctccaccgaacggcccagtccggtccttcccccgtcggccctacccctccctacccgaacgacgccgtaccctcggtcggggccaccgacggccggtccccgg

SEQ ID NO: 156445 - DNA, 175 bp, Homo sapiens
  misc_feature: GYAE6OF02G6OJN.37.55.E11.1.454.CMB.1.raw
  modified_base (174)..(175): a, c, t, g, unknown or other
  misc_feature (174)..(175): n is a, c, g, or t
tcagtagtgtagatcacgaccggtgctcgatttagcactcgcacgttgggtttgggggaagaggaagactgacggtccccccaggagttcaggtgctgggcacagcggccctgggctgcctggtcaaggactacttccatctacactactgagcgggctggcaaggcgcatagnn

SEQ ID NO: 156446 - DNA, 771 bp, Homo sapiens
  misc_feature: GYAE6OF02I5JC7.37.55.E11.1.454.CMB.1.raw
  modified_base (378)..(378): a, c, t, g, unknown or other
  misc_feature (378)..(378): n is a, c, g, or t
  modified_base (419)..(419): a, c, t, g, unknown or other
  misc_feature (419)..(419): n is a, c, g, or t
tcagtagtgtagatcacgaccggtgctcgatttagcactcgcacgttggggtttgggggaagaggaagacctgaccggtcccccaggagttcaggtgctgggcacggtcgggcatgtgtcgtacgttttgtccacaaggatttggggcctcgaacgtctcctgttgtcgaggcctcgtggattccacctttggcacgctttgccagtgagcgtgggtccgccaggctccgagggaggggctgggaagtgggtctcgagtccgattagtagtagtggtggaacgcacgtactaacgcttgactccgtgaagggcccgttacgcccttctccagacgacaacgtccaacaaccacggcctgtcctgtgtcaacgttaacngccgtagagacgacgaaggacacgggtcgtatacgttacgngtcgacgaaagggacggtctaacggcgtaacggtggtacccgtagggttaccctcccgtaacgttaccttaaggttacgttcgggtaaccgttccgggtacggggtacgaaaagggtaaccgtccgggaccggtaccgtaacccggttccggttaccctaccgtaccggtcccttaccgaaccgtaaccggggtcccctaacgttaccccgggttccccgtttcccccggtttacgggtacccctccccggttaccccgtacccggaaacccgggtacccgtacccgggaccccggttaccggggtaccgggggtacccgtaacccggtaccgggacccggtacccccgggg

SEQ ID NO: 156447 - DNA, 564 bp, Homo sapiens
  misc_feature: GYAE6OF02ITHWY.37.55.E11.1.454.CMB.1.raw
  modified_base (344)..(344): a, c, t, g, unknown or other
  misc_feature (344)..(344): n is a, c, g, or t
  modified_base (462)..(462): a, c, t, g, unknown or other
  misc_feature (462)..(462): n is a, c, g, or t
tcagtagtgtagatcacgaccggtgctcgatttagcactcgcacgttgggtttggggggaagaggaagactgacggtccccccaagagttcaggtgctgggcacggtgggcatgtgtgagttttgtcacaagatttgggctcaactctcctgtgcagcctctggattcacctttggcagctttgccatgagctgggtccgccaggctccaggggaaggggctggaatgggtctcagccattagtagtagtggtggaagcacgtactacgctgactccggtgaagggccgttcgcccctctccagagacaactccaaacaacacgctgtctctgacaacttaacngcctgagagacgaggacacggcgtatattactgtgacgaaaggagggtctagcagtgccgtggtacctcccactactatatggacgtcgtgggacaaaggatcgcgtcaccgtctccncgacgcctccaccgaacggcccacgtccgtccctccccgtcggccctaccctccctaccaacgacgccaccgtcggtacggggaccacgcggcccggcccgg

SEQ ID NO: 156448 - DNA, 583 bp, Homo sapiens
  misc_feature: GYAE6OF02HYF7S.37.55.E11.1.454.CMB.1.raw
  modified_base (355)..(355): a, c, t, g, unknown or other
  misc_feature (355)..(355): n is a, c, g, or t
  modified_base (382)..(382): a, c, t, g, unknown or other
  misc_feature (382)..(382): n is a, c, g, or t
tcagtagtgtagatcacgaccggtgctcgatttagcactcgcacgttgggtttgggctgaactggctttttcttgtggctattttaaaaggtgtccagtgtgaggtgcagctgtcggagtctgggggaggcttggtacagcctgggggggtccctgacactctcctgtgcagcctctggattcacctttggcagctttgccatgagctgggtccgccaggctccgagggaaggggctggaatgggtctcagccattagtagtagtggtggaagcacgtactagctgactccgtgaagggccggttcgccctctccagagacaactccaacaacacgctgtctctgcaacttaacngcctgagagacgaggacacggccgtanattactgtgcgaaggagggtctagcagtgctggtactcccactactatatggacgtcgtgggacaaaggaatcgcggtcaccgtctcctcgacgcctaccaccgaacgggccctaacgtcccggttccttccccccgtcgggtaccccaccccgttcccttacccgaaacggaccgtacccgtacccgtcgtaccgggggg

SEQ ID NO: 156449 - DNA, 174 bp, Homo sapiens; identical to SEQ ID NO: 156302
  misc_feature: GYAE6OF02FYEV7.37.55.E11.1.454.CMB.1.raw
  modified_base (174)..(174): a, c, t, g, unknown or other
  misc_feature (174)..(174): n is a, c, g, or t

SEQ ID NO: 156450 - DNA, 178 bp, Homo sapiens
  misc_feature: GYAE6OF02JEEJ2.37.55.E11.1.454.CMB.1.raw
  modified_base (174)..(178): a, c, t, g, unknown or other
  misc_feature (174)..(178): n is a, c, g, or t
tcagtagtgtagatcacgaccggtgctcgatttagcactcgcacgttgggtttgggggaagaggaagacgtgacggtcccccaggagttcaggtgctgggcacagcggccctgggctgcctggtcaaggactacttccatctacactactgagcgggctggcaaggcgcatagnnnnn

SEQ ID NO: 156451 - DNA, 584 bp, Homo sapiens
  misc_feature: GYAE6OF02G7H6X.37.55.E11.1.454.CMB.1.raw
tcagtagtgtagatcacgaccggtgctcgatttagcactcgcacgttgggtttggggctgaactggctttttcttgtggctattttaaaaggtgtccagtgtgaggtgcagctgtcggagtctgggggaggcttggtacagcctggggggtccctgacactctcctgtgcagcctctggattcacctttggcagctttgccatgagctgggtccgcaggctccagggaaggggctggtaatggggtctcgagccattagtagtagtggtggaagcacgtactacgctgacctcggtgaacgggccgttcgccctctccagacgaccaactccaacaacacgctgtctctcgactaaacttaacagcctagaagacgaacgaggaacacgggtccgttaattacttacgtgtacgacggaaaggtaacgggttactaaggactaggtcgccgtagggtacctcccaactactatatcggacgtcgtagggacaaaggactcgccgtacaccgtctcctcacgcctacacacggccagtccgtcctcccgtgcctaccctcctaccaagcgcctaccgtcgtcggg

SEQ ID NO: 156452 - DNA, 178 bp, Homo sapiens; identical to SEQ ID NO: 156409
  misc_feature: GYAE6OF02IGOT6.37.55.E11.1.454.CMB.1.raw
  modified_base (173)..(178): a, c, t, g, unknown or other
  misc_feature (173)..(178): n is a, c, g, or t

SEQ ID NO: 156453 - DNA, 178 bp, Homo sapiens; identical to SEQ ID NO: 156409
  misc_feature: GYAE6OF02IT229.37.55.E11.1.454.CMB.1.raw
  modified_base (173)..(178): a, c, t, g, unknown or other
  misc_feature (173)..(178): n is a, c, g, or t

SEQ ID NO: 156454 - DNA, 554 bp, Homo sapiens
  misc_feature: GYAE6OF02G89Q6.37.55.E11.1.454.CMB.1.raw
  modified_base (341)..(341): a, c, t, g, unknown or other
  misc_feature (341)..(341): n is a, c, g, or t
  modified_base (373)..(373): a, c, t, g, unknown or other
  misc_feature (373)..(373): n is a, c, g, or t
tcagtagtgtagatcacgaccggtgctcgatttagcactcgcacgttgggtttggggggaagaggaagactgacggtccccccaggagttcaggtgctgggcacggtgggcatgtgtgagttttgtcacaagatttgggctcaactctcctgtgcagcctctggattcacctttggcagctttgccatgagctgggtccgccaggctccagggaaggggctggaatgggtctcagccattagtagtagtggtggaagcacgtactacgctgactccgtgaagggccggttcgccctctccagagacaactccaaacaacacgctgtctctgcaacttaacngcctgagagacgaggacacggcctatattacngtgcgaaggaggtctagcagtgcctggtactccactactatatggacgtcgtgggacaaaggactcgcgtcaccgtctcctcacgcctaccaccgaacggcccacgtccggtccttccccgtcggccctacccctcctaccgaacgacgccaccgtcgtcggggccacgacgcggtcccgg

SEQ ID NO: 156455 - DNA, 598 bp, Homo sapiens
  misc_feature: GYAE6OF02I2VBX.37.55.E11.1.454.CMB.1.raw
  modified_base (297)..(297): a, c, t, g, unknown or other
  misc_feature (297)..(297): n is a, c, g, or t
  modified_base (322)..(322): a, c, t, g, unknown or other
  misc_feature (322)..(322): n is a, c, g, or t
tcagtagtgtagatcacgaccggtgctcgatttagcactcgcacgttgggtttgggggaagaggaagactgacggtccccccaggagttcaggtgctgggcacggtgggcatgtgtgagttttgtcacaagatttgggctcaactctcctgtgcagcctctggattcacctttggcagctttgccatgagctgggtccgccaggctccgagggaagggctggaatgggtctcgagccattagtagtagtggtggaagcacgtactacgctgactccggtgaacggccgttcgccctntccagacgacaactccaacaacacnctgtactcgtgactaacttaacacgtcctgaacggcgccgaagaccgaccggtccctagtacttactgtacgccgagtacggactcgaaggacggagtatacgacgagcaagctcgtacgactacggcgggaccacggtaaccgtcgtactaccgtcctccgtacacgcctaccaccgacggcccacgtccgtcccttcccgcggtaccctacccgtccctaccgacgaccgtaccgaccgtcggccgggaccacgaccggccggtccgtaccggg

SEQ ID NO: 156456 - DNA, 558 bp, Homo sapiens
  misc_feature: GYAE6OF02I19QA.37.55.E11.1.454.CMB.1.raw
  modified_base (336)..(336): a, c, t, g, unknown or other
  misc_feature (336)..(336): n is a, c, g, or t
tcagtagtgtagatcacgaccggtgctcgatttagcactcgcacgttgggtttgggggaagaggaagactgacggtcccccaggagttcaggtgctgggcacggtgggcatgtgtgagttttgtcacaagatttgggctcaactctcctgtgcagcctctggattcacctttggcagctttgccatgagctgggtccgccaggctccagggaagggctggaatgggtctcagccattagtagtagtggtggaagcacgtactacgctgactccgtgaagggccgttcgccctctccagagacaactccaacaacacgctgtctctgctaacttacngcctgagagacgaggacacggccgtatacttactgtgacgaagggaggtctagcgagtcgccgtggtactcccactactatatggacgtcgtgggacgaaaggacgtcgcggtccaccgtctcctcacgcctccgaccgacggcccacgtccgtccttccccgtcggcccaccctccctaccaacgacgccaccgtcgtcggggccacgacgccggtcccgg

SEQ ID NO: 156457 - DNA, 555 bp, Homo sapiens
  misc_feature: GYAE6OF02I7FTM.37.55.E11.1.454.CMB.1.raw
  modified_base (339)..(339): a, c, t, g, unknown or other
  misc_feature (339)..(339): n is a, c, g, or t
  modified_base (367)..(367): a, c, t, g, unknown or other
  misc_feature (367)..(367): n is a, c, g, or t
  modified_base (373)..(373): a, c, t, g, unknown or other
  misc_feature (373)..(373): n is a, c, g, or t
tcagtagtgtagatcacgaccggtgctcgatttagcactcgcacgttgggtttgggggaagaggaagactgacggtcccccaggagttcaggtgctgggcacggtgggcatgtgtgagttttgtcacaagatttgggctcaactctcctgtgcagcctctggattcacctttggcagctttgccatgagctgggtccgccaggctccagggaagggctggaatgggtctcagccattagtagtagtggtggaagcacggtactacgctgactccgtgaagggccgttcgccctctccagacgacaactccaacaacgacgctgtctctgcaacttaacngcctgagagacgaggacacggccgtaanattacngtgcgaaggaaggtctaagcagtgcctggtactcccatactatatggacgtctgggacaaaggatcgcgtacacgtctcctcgagcctaccaccgaacggcccaagtccgtccttccccgtgccctaccctcctaccgaacgtacgccaccctcggtcgggaccacgaccggccgtccccgg

SEQ ID NO: 156458 - DNA, 704 bp, Homo sapiens
  misc_feature: GYAE6OF02ISWXH.37.55.E11.1.454.CMB.1.raw
  modified_base (286)..(286): a, c, t, g, unknown or other
  misc_feature (286)..(286): n is a, c, g, or t
  modified_base (350)..(350): a, c, t, g, unknown or other
  misc_feature (350)..(350): n is a, c, g, or t
tcagtagtgtagatcacgaccggtgctcgattttagcactcgcacgttgggtttgggggaagaggaagactgacggtcccccaggagttcaggtgctgggcacggtgggcatgtgtgagttttgtcacaagatttgggctcaactctcctgtgcagcctctaggattcaccttttggcagtctttagccaatgagcgtgggtccgccaggctccgagggaagggctggaagtgggtctcgagcctagttagtagtagtggtggaagcacgtactacgctgactcgngaacggtcgtcgcctctccagacgacaactccaacaccacgctgtcctctacgcctaacttacncgcctgaacgagaacggacgaacaccgggtacgtaattacgtttaacgtggtacgggacggaaacggggtaagggttccaaggccgacggtcgtacccgttcgtaccgtaaccctaccttaacttacgtaagtacggtaccggttcggtacgggacggtaaacgggtaacggtaccggtaccggtccgtaccgtctccctcgaccgtccctaccgaacccgaaccggcccgtaacgtcccggttcccttcccccgtacggtaccccgccccttaccccgtacccgaacgtaccgacccgtacccggttaccgggttccggggacccgtaccggtaccgggcccgggtccccggg

SEQ ID NO: 156459 - DNA, 561 bp, Homo sapiens
  misc_feature: GYAE6OF02J1QLP.37.55.E11.1.454.CMB.1.raw
  modified_base (520)..(520): a, c, t, g, unknown or other
  misc_feature (520)..(520): n is a, c, g, or t
tcagtagtgtagatcacgaccggtgctcgatttagcactcgcacgttgggtttgggggaagaggaagactgacggtcccccaggagttcaggtgctgggcacggtgggcatgtgtgagttttgtcacaagatttgggctcaactctcctgtgcagcctctggattcacctttggcagctttgccatgagctgggtccgccaggctccagggaaggggctggaatgggtctcagccattagtagtagtggtggaagcacgtactacgctgactcgtgaagggccgttcgccctctccagagacaactccaacaacacgctgtcctctgcaacttacagcctgagagacgaggacacggccgtaatacttactggtacgacggaagggaacggggtctaggcaggtcgccgtaggtacctcccacgttactatagtacggacgtcgtacggggactaaagggactcgcggtcaccgtctcctacgacgcctaccaccgacgggaccacgtcgtccttcccgngaccaccctcaccaagccacacctacgacacgcacgcgccg

SEQ ID NO: 156460 - DNA, 610 bp, Homo sapiens
  misc_feature: GYAE6OF02IWF4I.37.55.E11.1.454.CMB.1.raw
  modified_base (312)..(312): a, c, t, g, unknown or other
  misc_feature (312)..(312): n is a, c, g, or t
  modified_base (552)..(552): a, c, t, g, unknown or other
  misc_feature (552)..(552): n is a, c, g, or t
tcagtagtgtagatcacgaccggtgctcgatttagcactcgcacgttgggtttgggctgaactggcttttcttgtggctattttaaaaggtgtccagtgtgaggtgcagctgtcggagtctgggggaggcttggtacagcctgggggtccctgacactctcctgtgcagcctctggattcacctttggcagctttgccatgagctgggtccgccaggctccgagggaaggggctgggaatggggtctcagccattagtagtagtggtggaagcacgtactacgctgactccgtgaagggccgttcgccctcnccagacgacaactccaacacacgctgtctctgcaacttaacgcctagagacgacgacggacacgggccttaatacttactggtgaccggtaaagggacgggtctaagcgtagtcgcctggtacctcccaactactagtactggaccgttcgtgggaccaaaggaatcggacggtccacggtcctccgtcgacgtccctacccgaccgacgggtcccagtcccgggttcctttccccccgngggtcccctaaccccgttccctaccgaacggaccgccctaccccgtcggtaccggggg

SEQ ID NO: 156461 - DNA, 545 bp, Homo sapiens
  misc_feature: GYAE6OF02HVFCR.37.55.E11.1.454.CMB.1.raw
tcagtagtgtagatcacgaccggtgctcgatttagcactcgcacgttgggtttggggggaagaggaagactgacggtccccccaggagttcaggtgctgggcacggtgggcatgtgtgagttttgtcacaagatttgggctcaactctcctgtgcagcctctggattcacctttggcagctttgccatgagctgggtccgccaggctccagggaaggggctggaatgggtctcagccattagtagtagtggtggaagcacgtactacgctgactccgtgaagggccgttcgccctctccagagacaactccaacaacacgctgtctctgcaacttaacagcctgagagacgaggacacggcctatatactgtgacgaaggaggtctagcagtcgctggtacctccactactatatggactcgtgggacaaaggactcgcggtacaccgtctcctcacgtcctccaccaacggccacgtccgtccttccccgtggccctaccctcctccaacgcaccgacctcggcgggccacgcgccggtcccgg

SEQ ID NO: 156462 - DNA, 174 bp, Homo sapiens; identical to SEQ ID NO: 156252
  misc_feature: GYAE6OF02FU9JP.37.55.E11.1.454.CMB.1.raw
  modified_base (173)..(174): a, c, t, g, unknown or other
  misc_feature (173)..(174): n is a, c, g, or t

SEQ ID NO: 156463 - DNA, 572 bp, Homo sapiens
  misc_feature: GYAE6OF02F2JHW.37.55.E11.1.454.CMB.1.raw
tcagtagtgtagatcacgaccggtgctcgatttagcactcgcacgttgggtttgggctgaactggctttttcttgtggctattttaaaaggtgtccagtgtgaggtgcagctgtcggagtctggggggaggcttggtacagcctggggggtccctgacactctcctgtgcagcctctggattcacctttggcagctttgccatgagctgggtccgccaggcctccgaggggaaggggctgggaatgggtctcagccattatagtagtggtggaagcacgtactacgctgactccgtggaagggccggttcgccctctccagacgaccaactccaaacaacacgctgtctctgctaacttaacagcctgagagacgaggacacggctatattactgtgacgaaggaaggtcagcagtgccgtgtacctcccacttactatatcggacgtcgtaggggacaaaggactcggacggtccaccgtctcctcacgcctaccaccgacggccctagtcccggtccttccccgtcgccctaccccgtcctaccgaacgacgaccctaccgtcggtcggg

SEQ ID NO: 156464 - DNA, 576 bp, Homo sapiens
  misc_feature: GYAE6OF02I16Z9.37.55.E11.1.454.CMB.1.raw
tcagtagtgtagatcacgaccggtgctcgatttagcactcgcacgttgggtttggggggaagaggaagactgacggtcccccaaggagttcaggtgctgggcacggtgggcatgtgtgagttttgtcacaagatttgggctcaactctcctgtgcagcctctggattcacctttggcagctttgccatgagctgggtccgccaggctccagggaaggggctggaatgggtctcagccattagtagtagtggtggaagcacgtactacgctgactccgtgaagggccgttcgccctctccagagacaactccaacaacacgctgtctctgcaacttaacagcctgagagacgaggacacggcgtatatactgtgcgaaggaaggtctagcagtcgcctggtacctcccactactatatggacgtcgtagggacaaaggactcgcggtccgaccgtctacctcacgccctccgaccaacggcccacgtccggtcccttcccccgtgcccgtacccctccctaccgaacgaccgaccgtacccgtccggttccggggaccaccgacggcccggccccgg

SEQ ID NO: 156465 - DNA, 548 bp, Homo sapiens
  misc_feature: GYAE6OF02JI8GV.37.55.E11.1.454.CMB.1.raw
  modified_base (342)..(342): a, c, t, g, unknown or other
  misc_feature (342)..(342): n is a, c, g, or t
  modified_base (502)..(502): a, c, t, g, unknown or other
  misc_feature (502)..(502): n is a, c, g, or t
tcagtagtgtagatcacgaccggtgctcgatttagcactcgcacgttgggtttggggggaagaggaagactgacggtccccccaggagttcaggtgctgggcacggtgggcatgtgtgagttttgtcacaagatttgggctcaactctcctgtgcagcctctggattcacctttggcagctttgccatgagctgggtccgccaggctccaggggaagggctggaatgggtctcagccattagtagtagtggtggaagcacgtactacgctgactccgtgaacgggccgttcgccctctccagagacaactccaaacaacacgctgtcctctgacaacttacngcctgagagacgagacacggcctatattactgtgacgaagggaggtctaagcagtcgctgtactccactactatagtcggacgtcgtgggacgaaaggagtcgcgtcaccgtctcctcacgcctccaccgaacggcccacgtccgtccttcccgtcgccnccctcctccaacgacgcgaccgtcgtcgggccacgacgccggtccg

SEQ ID NO: 156466 - DNA, 175 bp, Homo sapiens; identical to SEQ ID NO: 156445
  misc_feature: GYAE6OF02HJ4FE.37.55.E11.1.454.CMB.1.raw
  modified_base (174)..(175): a, c, t, g, unknown or other
  misc_feature (174)..(175): n is a, c, g, or t

SEQ ID NO: 156467 - DNA, 552 bp, Homo sapiens
  misc_feature: GYAE6OF02HMWOI.37.55.E11.1.454.CMB.1.raw
  modified_base (375)..(375): a, c, t, g, unknown or other
  misc_feature (375)..(375): n is a, c, g, or t
tcagtagtgtagatcacgaccggtgctcgatttagcactcgcacgttgggtttggggggaagaggaagactgacggtccccccaggagttcaggtgctgggcacggtgggcatgtgtgagttttgtcacaagatttgggctcaactctcctgtgcagcctctggattcacctttggcagctttgccatgagctgggtccgccaggctccgagggaaggggctggaatgggtctcaggtattacgtggtagtggtaataccgcatactacgcagactccgtgacgggccggttcaccgtctccagagacaattccaagaatacggctatctggaaatgaacagcctgagagccgaggacacggccctactattacngtgcgagagatcagacgagtatagcagcagctctgactacgtcggggccaaccggaacccgtggtccaccgtcctcctcacgcctccaccgaacggcccacgtccggtccttccccgtcgccaccctcctcccgaacgcgccaccgtcgcgggcacgacgccgccgtcggcgtccgg

SEQ ID NO: 156468 - DNA, 181 bp, Homo sapiens
  misc_feature: GYAE6OF02HJDC8.37.55.E11.1.454.CMB.1.raw
  modified_base (173)..(181): a, c, t, g, unknown or other
  misc_feature (173)..(181): n is a, c, g, or t
tcagtagtgtagatcacgaccggtgctcgatttagcactcgcacgttgggtttgggggaagaggaagactgacggtcccccaggagttcaggtgctgggcacagcggccctgggctgcctggtcaaggactacttccatctacactactgagcgggctggcaaggcgcatagnnnnnnnnn

SEQ ID NO: 156469 - DNA, 605 bp, Homo sapiens
  misc_feature: GYAE6OF02I4JRD.37.55.E11.1.454.CMB.1.raw
  modified_base (352)..(352): a, c, t, g, unknown or other
  misc_feature (352)..(352): n is a, c, g, or t
  modified_base (355)..(355): a, c, t, g, unknown or other
  misc_feature (355)..(355): n is a, c, g, or t
  modified_base (366)..(366): a, c, t, g, unknown or other
  misc_feature (366)..(366): n is a, c, g, or t
  modified_base (433)..(433): a, c, t, g, unknown or other
  misc_feature (433)..(433): n is a, c, g, or t
tcagtagtgtagatcacgaccggtgctcgatttagcactcgcacgttgggtttgggctgaactggctttttcttgtggctattttaaaaggtgtccagtgtgaggtgcagctgtcggagtctgggggaggcttggtacagcctggggggtccctgacactctcctgtgcagcctctggattcacctttggcagctttgccatgagctgggtccgccaggctccgaggggaagggctaggaatggggtctcagccagttagtagtagtggtggaagcacgtactacgctgactccggtaggaacgggtccggttcgccctctccagacgaccaactaccaacacacgctgtcnctnacaacttaacncgcctgagacgacggaaggacgacggacgtaatacttactgtagacggaaggacgggtctagcagtnccgtgtacctccgaactactagtagtcggacgtacgtacgggacaaaggtaagtccggacggttccgaccgttcctcctcaccgaccctaccaaccgacggccctacggtccgtcccgttccccgtcgaccctaccctcccgtacgaccgacgccctaccgtcggtaccggg

SEQ ID NO: 156470 - DNA, 175 bp, Homo sapiens; identical to SEQ ID NO: 156258
  misc_feature: GYAE6OF02JBZ1R.37.55.E11.1.454.CMB.1.raw
  modified_base (173)..(175): a, c, t, g, unknown or other
  misc_feature (173)..(175): n is a, c, g, or t

SEQ ID NO: 156471 - DNA, 583 bp, Homo sapiens
  misc_feature: GYAE6OF02I3AE9.37.55.E11.1.454.CMB.1.raw
  modified_base (296)..(296): a, c, t, g, unknown or other
  misc_feature (296)..(296): n is a, c, g, or t
  modified_base (338)..(338): a, c, t, g, unknown or other
  misc_feature (338)..(338): n is a, c, g, or t
tcagtagtgtagatcacgaccggtgctcgatttagcactcgcacgttgggtttggggggaagaggaagactgacggtccccccaggagttcaggtgctgggcacggtgggcatgtgtgagttttgtcacaagatttgggctcaactctcctgtgcagcctctggattcacctttggcagctttgccatgagctgggtccgccaggctccagggaagggctggaatgggtctcagccattagtagtagtggtggaagcacgtactacgctgactccgtgaagggccgttcgccctcnccagagacaactccaacacacgctgtcctctgacaacttacngcctgagagacgaggacacggctatactactgtgcgaaggaggtctagcagtgccgtgtactcccgactactatagtaggacgtcgtgggacaaaggactcgccggtaccgaccgtctccgtcgacgtcctccgacccgaaccggccctacgtccgttcccttccccgtcggtcccgacccctacccgtacccaacgtacgaccgtacccgtcggccggggaccaccgacggacccggtccccgg

SEQ ID NO: 156472 - DNA, 174 bp, Homo sapiens; identical to SEQ ID NO: 156252
  misc_feature: GYAE6OF02GWJNT.37.55.E11.1.454.CMB.1.raw
  modified_base (173)..(174): a, c, t, g, unknown or other
  misc_feature (173)..(174): n is a, c, g, or t

SEQ ID NO: 156473 - DNA, 568 bp, Homo sapiens
  misc_feature: GYAE6OF02HJFR1.37.55.E11.1.454.CMB.1.raw
  modified_base (300)..(300): a, c, t, g, unknown or other
  misc_feature (300)..(300): n is a, c, g, or t
  modified_base (362)..(362): a, c, t, g, unknown or other
  misc_feature (362)..(362): n is a, c, g, or t
  modified_base (395)..(395): a, c, t, g, unknown or other
  misc_feature (395)..(395): n is a, c, g, or t
tcagtagtgtagatcacgaccggtgctcgatttagcactcgcacgttgggtttgggctgaactggctttttcttgtggctattttaaaaaggtgtccagtgtgaggtgcagctgtcggagtctggggggaggcttggtacagcctggggggtccctgacactctcctgtgcagcctctggattcacctttggcagctttgccatgagctgggtccgccaggctccgaggggaaggggctggaatggggtctcgagccattagtagtagtggtggaagcacggtactacggctgactccgnggaagggccgttcgccctctccagagacaactccaacaacacgctgtctctgcaacttaacngcctgagagacgaggacacggccgtatattacngtgacgaaggaaggtctagcagtgctacggtactaccactactatagtcgacgtcgtgggacaaaggactcgcgtcaccgtctcctcacgcctccaccgacggccctacgtccggtcccttccccgacgtcccacccgtccctaccgaacgaccgtacctaccgtcgtcgggg

SEQ ID NO: 156474 - DNA, 636 bp, Homo sapiens
  misc_feature: GYAE6OF02IT7T0.37.55.E11.1.454.CMB.1.raw
  modified_base (258)..(258): a, c, t, g, unknown or other
  misc_feature (258)..(258): n is a, c, g, or t
tcagtagtgtagatcacgaccggtgctcgatttagcactcgcacgttgggtttggggggaagaggaagactgacggtccccccaggagttcaggtgctgggcacggtgggcatgtgtgagttttgtcacaagatttgggctcaactctcctgtgcagcctctggattcacctttggcagctttgccatgagctgggtccgccaggctccgagggaaggggctggaatgggtctcagccattagtagtagtggtaggancgacgtactacgctgactccggtgaacgggtccggttccgccctctccagacgacaactccaaacaacgacgctgtcctctagctaaacttacagtcctagagacgacgaggacgacggtaccgtatacgttacgtgtaggacggtaagggtaagggtctaggactaaggtcgtaccgtagtaccctccctaactacttactagtcggacgtcgtaggggacaaaggtactaccggcgtaccgacgttcctacctacacgtccctaccgaaccgaacgggccctaacgttccgtcccgttccccgacggccctaccccgtccgtaccgaacgtaccgaccctacccgtcggtaccgggcaccggtcggcccggtccgg

SEQ ID NO: 156475 - DNA, 542 bp, Homo sapiens
  misc_feature: GYAE6OF02GSDST.37.55.E11.1.454.CMB.1.raw
  modified_base (422)..(422): a, c, t, g, unknown or other
  misc_feature (422)..(422): n is a, c, g, or t
tcagtagtgtagatcacgaccggtgctcgatttagcactcgcacgttgggtttggggggaagaggaagactgacggtccccccaggagttcaggtgctgggcacggtgggcatgtgtgagttttgtcacaagatttgggctcaactctcctgtgcagcctctggattcacctttggcagctttgccatgagctgggtccgccaggctccagggaaggggctggagtgggtggccaacatacagggaggtggtggtacgaaaaactatgtggactctgtgcggggccgattcaccatctccagagacaacgccaaaaactcactgtatctgcaaatggacggcctgagatccgaggacacggctgtgtattatgtgcgagagatttagactacaaagtttcgagtgactggtatgatgcttangatacgtgggaccaagggaccagtcggtcctacgtcctcttcagtccctccaccgaacgggcccagttccgtccttcccccgtgccgccctcgcctcgacggcgaccgacctccgagacg

SEQ ID NO: 156476 - DNA, 1019 bp, Homo sapiens
  misc_feature: GYAE6OF02GZL8D.37.55.E11.1.454.CMB.1.raw
tcagtagtgtagatcacgaccggtgctcgatttagcactcgcacgttggggttttgggggggaacgaaacggaagaccctcgtacgggtcccccaggtaccgttcaggtgcctgggcccacggtcgggcagtcgtggtcgaggttttgtccactaacgttatttggggctcaactctcctgtagcgagccctctcggattcctacctttaggcgaggcctttgcctagtcgaggcgtgggtaccgaccgacggtccgtcccgtagggggaacggggtcgttcgggtaaacgttcgggggtccttacggaccgtccctaaggttttaacgttaacggttttacggtagggttaggaaagtccgtaaccggttaacgttacggcgtacggaccgttccgggtacggtaacgggggcccggtttaccgggcccccttacggttacccggaggaacggtaaccggtaaccttacccggaaaaccccgaaaccgtaccggtaccgtttaacgggttaaccgttccgttaggtaaccgtaaaccgttttaaacggacgtaccgttaggtaacggaacggaacgtaacgggaaccttaccggggtccgtaaacgttaacgtttacggttacgttcggtaaggtaaaccgggtccgggttaagggggaacgttacggggggggtaaccttaccgggtacggggggaacccgtaacgggggtaacccgttacgggttaccggaaccggttaccgttacccggtacgacccgtaccccgtacccgaaacccggtaaccggtacccgttaacggtttccccgggttacccgttccccggtacgggaccccgtaccccggtacccgttaccgtaaccggtaaccggtacccttaaccgttccgggttaaccgggttacctaaccggttccggtccggggttacccggttcgggtacccggttaccggtaacccggttccgggtaaccggtaaccggttaccccgttaccgtttaccccgagttaacccccg

SEQ ID NO: 156477 - DNA, 671 bp, Homo sapiens
  misc_feature: GYAE6OF02I7F11.37.55.E11.1.454.CMB.1.raw
  modified_base (198)..(198): a, c, t, g, unknown or other
  misc_feature (198)..(198): n is a, c, g, or t
  modified_base (256)..(256): a, c, t, g, unknown or other
  misc_feature (256)..(256): n is a, c, g, or t
  modified_base (294)..(294): a, c, t, g, unknown or other
  misc_feature (294)..(294): n is a, c, g, or t
  modified_base (316)..(316): a, c, t, g, unknown or other
  misc_feature (316)..(316): n is a, c, g, or t
  modified_base (399)..(399): a, c, t, g, unknown or other
  misc_feature (399)..(399): n is a, c, g, or t
tcagtagtgtagatcacgaccggtgctcgatttagcactcgcacgttgggtttgggggaagaggaagactgacggtcccccaggagttcaggtgctgggcacggtgggcatgtgtgagttttgtcacaagatttgggctcaactctcctgtgcagcctctggattcacctttggcagctttgccatgagctgggtccnccaggctccgagggagggctggaagtgggtctcagccagttagtagtagtggtggaancacgtactaggctgactcggtgaggtccgttcgccctntccgagacaccaactcccgaanaaccgacgcttgtctcctgaactaaccttaacgacgtcctaggagacgtaacgacggtacacgggtacctagttaacttacgngtacgacggaaaggtaaggtcctaagcgaggtcgccgttaggttacccgtaccctaacgtaccttagtacgtagggaccgttcggtacgggaaccgtaaaggtaacgtccggtacggtccgtacccgttcctaccgtccgacgtcccgttaacccaaccgggtaaccgacccggtaacgtccgttcccgtccccgtcggtaccctaccccgtacccttccgaacggtcccgactaccgttcggacgggtaccacggtaccggccggtcccgg

SEQ ID NO: 156478 - DNA, 618 bp, Homo sapiens
  misc_feature: GYAE6OF02HF5U5.37.55.E11.1.454.CMB.1.raw
tcagtagtgtagatcacgaccggtgctcgatttagcactcgcacgttgggtttgggctgaactggctttttcttgtggctattttaaaaggtgtccagtgtgaggtgcagctgtcggagtctgggggaggcttggtacagcctggggggtccctgacactctcctgtgcagcctctggattcacctttggcagctttgccatgagctgggtccgccaggctccgaggggaagggctggaatgggtctcagccattagtagtagtggtggaagcacgtactacgctgactccgaggaacgggcccggtccgcccctctccagacgaccaactccaaacaacacgctgtcctctgaccaacttaacacgcctgaacgacgacgacggacacgggaccttatacgttactggtgacgaagggaagggtctaggctaggtcgtaccttgggtaacctcccgtaactaacgttaactagtcggacgttcggtaggggactaaagggacgtcggcggtaccaccgttctcctcgacgccctaccgaccgacggccctaccggtccgttcccttcccgtcgccctacccgtcctaccgaacgccgacctacccgtcggtaccggg

SEQ ID NO: 156479 - DNA, 558 bp, Homo sapiens
  misc_feature: GYAE6OF02JASVR.37.55.E11.1.454.CMB.1.raw
  modified_base (345)..(345): a, c, t, g, unknown or other
  misc_feature (345)..(345): n is a, c, g, or t
tcagtagtgtagatcacgaccggtgctcgatttagcactcgcacgttgggtttgggggaagaggaagactgacggtcccccaggagttcaggtgctgggcacggtgggcatgtgtgagttttgtcacaagatttgggctcaactctcctgtgcagcctctggattcacctttggcagctttgccatgagctgggtccgccaggctccagggaaggggctggaatgggtctcagccattagtagtagtggtggaagcacgtactacgctgactccgtgaagggccggttcgccctctccagagacaactccaacaacacgctgtctctgcaacttaacagcctganagacgaggacacggccgtatattactgtgcgaaggagggtctagcagtgcctggtactcccactactatatggacgtcgtgggcaaaggaatcgcggtcgaccgtctcctcacgcctccaccaacggcccacgtccgttcccttccccctcggccctacccctccctacccaacgacgccacctccgtcggggccaccgacgccggtccccgg

SEQ ID NO: 156480 - DNA, 552 bp, Homo sapiens
  misc_feature: GYAE6OF02GGQIX.37.55.E11.1.454.CMB.1.raw
tcagtagtgtagatcacgaccggtgctcgatttagcactcgcacgttgggtttggggggaagaggaagactgacggtccccccaggagttcaggtgctgggcacggtgggcatgtgtgagttttgtcacaagatttgggctcaactctcctgtgcagcctctggattcaccttttggcagctttgccatgagctgggtccgccaggctccagggaagggctggaatgggtctcagccattagagtagtggtggaagcacgtactacgctgactccgtgaagggccgttcgccctctccagagacaactccaacaacacgctgtctctgcaacttaacagcctgagacgccgaggacaccggccctatacttactgtaacgaaaatcggcctacggatatgactactattggactgtactcgatctcgtgggcgtgcaccgtggtcacttgtcctcctcgactcctccaccgaacggccctagtccggtccttcccccgtggcccgtcccgtcgcctccgacgacgccacccgtccgacgaccgcacgtccgg

SEQ ID NO: 156481 - DNA, 601 bp, Homo sapiens
  misc_feature: GYAE6OF02IFDFG.37.55.E11.1.454.CMB.1.raw
  modified_base (239)..(239): a, c, t, g, unknown or other
  misc_feature (239)..(239): n is a, c, g, or t
  modified_base (347)..(347): a, c, t, g, unknown or other
  misc_feature (347)..(347): n is a, c, g, or t
  modified_base (378)..(378): a, c, t, g, unknown or other
  misc_feature (378)..(378): n is a, c, g, or t
tcagtagtgtagatcacgaccggtgctcgatttagcactcgcacgttgggtttggggggaagaggaagactgacggtccccccaggagttcaggtgctgggcacggtgggcatgtgtgagttttgtcacaagatttgggctcaactctcctgtgcagcctctggattcacctttggcagctttgccatgagctgggtccgccaggctccgaggggaacggggctgggaatgggtctcgngccattagtagtagtggtggaagcacgtactacgctgactccgtgagggccggttcgccctctccagagacaactccaacaacacgctgtctctcgactaacttaacngcctgagagacgaggacacggctatatacgngtagcgaaggaggtctagcgagtgccgtaggtactccctactactatacgtggacgttcgtagggacaaaggtaagtcgcggtccaccgtcctacctccgacgccctaccgacccgaacgggcccacgtccggttccctccccgtacggtaccctcccctacccgtccaacgtaccgtaccgacccgtccggtccggggaccaccggaccggccggtccccgg

SEQ ID NO: 156482 - DNA, 610 bp, Homo sapiens
  misc_feature: GYAE6OF02FG1K8.37.55.E11.1.454.CMB.1.raw
  modified_base (319)..(319): a, c, t, g, unknown or other
  misc_feature (319)..(319): n is a, c, g, or t
  modified_base (336)..(336): a, c, t, g, unknown or other
  misc_feature (336)..(336): n is a, c, g, or t
  modified_base (358)..(358): a, c, t, g, unknown or other
  misc_feature (358)..(358): n is a, c, g, or t
  modified_base (410)..(410): a, c, t, g, unknown or other
  misc_feature (410)..(410): n is a, c, g, or t
tcagtagtgtagatcacgaccggtgctcgatttagcactcgcacgttgggtttgggctgaactggctttttcttgtggctatttttaaaaggtgtccagtgtgaggtgcagctgtcggagtctgggggagcttggtacagcctggggggtccctgacactctcctgtgcagcctctggattcacctttggcagctttgccatgaactgggtccgcaggctccgagggaaggggctggagtgggtctcgatccattagtagtagtggtacttacatatactacgcagactcagtggaggggccattcaccatctccaganacaacgccaaagaactnactgtatctgacaaatgaaacngcctagagagccgaggacacggctgtgtattactgcgcgagcgccctccacncgagcagcacgtcggtacgacttcggcgggaccacgggaacccgttggtacctaacccgttcctaccctcgaccgtcccttaccgaacccgacggggcccctaaggttccccgggttaccctttccccccgacgggtcccctaccccgttacccgtaacccgaaacggttccgacccgtacccggttccggtaccggggg

SEQ ID NO: 156483 - DNA, 607 bp, Homo sapiens
  misc_feature: GYAE6OF02H9STI.37.55.E11.1.454.CMB.1.raw
  modified_base (200)..(200): a, c, t, g, unknown or other
  misc_feature (200)..(200): n is a, c, g, or t
  modified_base (341)..(341): a, c, t, g, unknown or other
  misc_feature (341)..(341): n is a, c, g, or t
  modified_base (379)..(379): a, c, t, g, unknown or other
  misc_feature (379)..(379): n is a, c, g, or t
  modified_base (491)..(491): a, c, t, g, unknown or other
  misc_feature (491)..(491): n is a, c, g, or t
tcagtagtgtagatcacgaccggtgctcgatttagcactcgcacgttgggtttgggggaagaggaagactgacggtccccccaggagttcaggtgctgggcacggtgggcatgtgtgagttttgtcacaagatttgggctcaactctcctgtgcagcctctggattcaccttttggcagctttgccatgagctgggtccnccaggctccgagggagggctggaatgggtctcagccattagtagtagtggtggaagaacgtactacgctgactccgtgaagggccgttcgccctctccagagacaactccaacaacacgctagtctctgctaaacttaacngcctgagagacgaggaccacggccgttaatacgttacngtagaccggaaagggagggtacttagactagtgccgtcggtacctcccactactatagtcggtacgtcgtacggggacaaaggataccgcggtaccaccggtcttccgtacncgtcctaccaccgaacggaccctacgtccgtccttccccgtcgcccgtaccctcccgtaccgaacgtacgaccgacccgtcgtcggggtaccaccgacggacccggtccgtacggg

SEQ ID NO: 156484 - DNA, 610 bp, Homo sapiens
  misc_feature: GYAE6OF02GOR1V.37.55.E11.1.454.CMB.1.raw
  modified_base (345)..(345): a, c, t, g, unknown or other
  misc_feature (345)..(345): n is a, c, g, or t
  modified_base (395)..(395): a, c, t, g, unknown or other
  misc_feature (395)..(395): n is a, c, g, or t
tcagtagtgtagatcacgaccggtgctcgatttagcactcgcacgttgggtttgggggaagaggaagactgacggtccccccaggagttcaggtgctgggcacggtgggcatgtgtgagttttgtcacaagatttgggctcaactctcctgtgcagcctctggattcacctttggcagctttgccatgagctgggtccgccaggctccgaggggaaggggctaggaatgggtctcgagccattagtagtaggtggtaggaagcacgtactacgctgactccgtgaaggtccggttcgccctctccagagacactccaacaacacgctgctctgactaacttaacngcctgagagacgagacacggcgtatatactgtagacggaaggaggtcagnagtgccgtagtacctcccactacgtatagtacggacgttcgtaggggactaaaggactccggcgtaccgtaccgtccttacccgtacgacgtccctaccgaacccgaacgggtccctaacgtcccgttacccttcccccgtcggaccctacccctccctaacccgaacgaccgtccgaccgttcggacggggccacggaccggcccggtacccgg

SEQ ID NO: 156485 - DNA, 612 bp, Homo sapiens
  misc_feature: GYAE6OF02GCR8C.37.55.E11.1.454.CMB.1.raw
  modified_base (353)..(353): a, c, t, g, unknown or other
  misc_feature (353)..(353): n is a, c, g, or t
  modified_base (450)..(450): a, c, t, g, unknown or other
  misc_feature (450)..(450): n is a, c, g, or t
tcagtagtgtagatcacgaccggtgctcgatttagcactcgcacgttgggtttgggggggaagaggaagactgacggtccccccaggagttcaggtgctgggcacggtgggcatgtgtgagttttgtcacaagatttgggctcaactctcctgtgcagcctctggattcaccttttggcagctttgccatgagctgggtccgccaggctccgagggaaggggctgggaatgggtctcagccattagtagtagtggtggaagcacgtactacgctgactccgtgaacgggccggttcgccctctccaggacgacaactccaacaaccacgctgtcctctgactaaccttaacancctgagagacgaggacaccggacgtatacttactgtgacgaaagggtagggtctagcagtcgccgtgtacctcccgactaactatatcggacgtcgngggacaaaggatcggacgtcaccgtcgtcctcgacgccctacgaccgaacggcccaacgtccggtacccttccccgtacggcccctacccgtccccgtaccgtaacggacgtcccgaaccgttccggtaccgggggaccaccggtacggcccggtccccggg

SEQ ID NO: 156486 - DNA, 177 bp, Homo sapiens; identical to SEQ ID NO: 156251
  misc_feature: GYAE6OF02GRKI6.37.55.E11.1.454.CMB.1.raw
  modified_base (173)..(177): a, c, t, g, unknown or other
  misc_feature (173)..(177): n is a, c, g, or t

SEQ ID NO: 156487 - DNA, 559 bp, Homo sapiens
  misc_feature: GYAE6OF02F7K5U.37.55.E11.1.454.CMB.1.raw
  modified_base (374)..(374): a, c, t, g, unknown or other
  misc_feature (374)..(374): n is a, c, g, or t
  modified_base (429)..(429): a, c, t, g, unknown or other
  misc_feature (429)..(429): n is a, c, g, or t
tcagtagtgtagatcacgaccggtgctcgatttagcactcgcacgttgggtttgggggaagaggaagactgacggtccccccaggagttcaggtgctgggcacggtgggcatgtgtgagttttgtcacaagatttgggctcaactctcctgtgcagcctctggattcacctttggcagctttgccatgagctgggtccgccaggctccagggaaggggctggaatgggtctcagccattagtagtagtggtggaagcacgtactacgctgactccgtgaagggccggttcgccctctccagagacaactccaaacacacgctgtctctgcaacttaacagcctgacgagacgaggacacggccgtatattacgngtgacgaagggaggtctagcagtgcctgtactcccactactatagtggacgtcgngggacaaaggactcgcgtccaccgtctccgtcacgccctaccaccgaacggcccagtccgtccttccccgtcgccctacccctcctaccaacgacgaccaccgtcgtcggggcacgacggccggtcccgg

SEQ ID NO: 156488 - DNA, 606 bp, Homo sapiens
  misc_feature: GYAE6OF02FOLYX.37.55.E11.1.454.CMB.1.raw
  modified_base (342)..(342): a, c, t, g, unknown or other
  misc_feature (342)..(342): n is a, c, g, or t
tcagtagtgtagatcacgaccggtgctcgatttagcactcgcacgttgggtttggggggaagaggaagactgacggtccccccaggagttcaggtgctgggcacggtgggcatgtgtgagttttgtcacaagatttgggctcaactctcctgtgcagcctctggattcacctttggcagctttgccatgagctgggtccgccaggctccagggaaggggctggaatgggtctcagccattagtagtagtgggtggaagcacgtactacgctgactcgtgaagggccggttcgccctctccagagacaacctccaacaacacgctgtctctgacaacttaacngcgtagagacgacgaggacacggccgtatattactgtcgcgaaagggagggtctaaggcaggtcgccgtggtacctcccaacttactaatagtcgacgttgtcgggacgaaaggagtccgcggtaccgaccgttcctccgtacacgtccctaccgaaccgaacggcccaacgttccgttcccttccccgtcggccctaccccgttccacccgtaacgacgacccgtaccgtcggccggggaccaccggtaccggccggtcccgg

SEQ ID NO: 156489 - DNA, 656 bp, Homo sapiens
  misc_feature: GYAE6OF02HWH2W.37.55.E11.1.454.CMB.1.raw
  modified_base (166)..(166): a, c, t, g, unknown or other
  misc_feature (166)..(166): n is a, c, g, or t
  modified_base (357)..(357): a, c, t, g, unknown or other
  misc_feature (357)..(357): n is a, c, g, or t
  modified_base (390)..(390): a, c, t, g, unknown or other
  misc_feature (390)..(390): n is a, c, g, or t
  modified_base (416)..(416): a, c, t, g, unknown or other
  misc_feature (416)..(416): n is a, c, g, or t
tcagtagtgtagatcacgaccggtgctcgatttagcactcgcacgttgggtttggggggaagaggaagactgacggtccccccaggagttcaggtgctgggcacggtgggcatgtgtgagtttttgtcacaagatttgggctcaactctcctgtgcagcctctggnttcacctttggcagctttgccatgagctgggtccgccaggctccaggggaaggggctggaattggggtctcgacgccattagtaggtagtgggtggaagcacgtactacgctgacctccggtaggaagggtccggttcgccctctccgagagaccaactccaaacacacgctgtctctgactaacttaacngcctgagagacgagaccacggtcctatattacngtcgacggaaagggacgggtctaggngtaggtcgccgtagttaccgtaccctacttactaagtacgtaggtacgtacggtcggggtaacaaaggtatacgggccgtactacccggtcctccgtccgccgtacctacccgaccgaaccgggccctaacgttcccgtaccccttccccggtcggtaccccgtaccccgtccctaccgtaacgaccgtacccgtacccgtccgggtcggggacccaaccggaccggcccggtacccggg

SEQ ID NO: 156490 - DNA, 556 bp, Homo sapiens
  misc_feature: GYAE6OF02F12XG.37.55.E11.1.454.CMB.1.raw
  modified_base (299)..(299): a, c, t, g, unknown or other
  misc_feature (299)..(299): n is a, c, g, or t
  modified_base (347)..(347): a, c, t, g, unknown or other
  misc_feature (347)..(347): n is a, c, g, or t
  modified_base (380)..(380): a, c, t, g, unknown or other
  misc_feature (380)..(380): n is a, c, g, or t
  modified_base (448)..(448): a, c, t, g, unknown or other
  misc_feature (448)..(448): n is a, c, g, or t
tcagtagtgtagatcacgaccggtgctcgatttagcactcgcacgttgggtttggggggaagaggaagactgacggtccccccaggagttcaggtgctgggcacggtgggcatgtgtgagttttgtcacaagatttgggctcaactctcctgtgcagcctctggattcacctttggcagctttgccatgagctgggtccgccaggctccgagggaaggggctggaatgggtctcagccattagtagtagtggtggaagcacgtactacgctgactccgtgaacgggccggttcgccctntccagacgacaactccaaacaacacgctgtctctgactaaacttaacngcctgagagacgaggacacggcctatacttacngtcgcgaaggaaggtcagcagtcgctggtactcccactactatatggacgtcgtagggacaaaggtancgcgtccgaccgtctcctcacgcctccaccgaacggcccacgtccgtccttccccgtcgtccgccctcctccaacgacgccaccgtcgacgggcacgcgcggtcccgg

SEQ ID NO: 156491 - DNA, 574 bp, Homo sapiens
  misc_feature: GYAE6OF02JCBXG.37.55.E11.1.454.CMB.1.raw
  modified_base (390)..(390): a, c, t, g, unknown or other
  misc_feature (390)..(390): n is a, c, g, or t
tcagtagtgtagatcacgaccggtgctcgatttagcactcgcacgttgggtttgggctgaactggctttttcttgtggctattttaaaaggtgtccagtgtgaggtgcagctgtcggagtctgggggaggcttggtacagcctggggggtccctgacactctcctgtgcagcctctggattcacctttggcagctttgccatgagctgggtccgccaggctccagggaagggctggaatgggtctcagccattagtagtagtggtggaagcacgtactacgctgactccgtgaagggccgttcgccctctccagagacaactccaacaacacgctgtctcagcaacttaacagcctagagagacgaggacacggcgtatattactggtanacggaaggaacgggtctaagcgaggtcgccgtaggtacctcccacttactatatcggacgttctggggacaaaggatccgacggtcaccgtctcctacgacgtcctaccgaccgacggcccagtccggtaccttccccgtcgccaccccgttcctaccgaacgacgccgtaccgtcgtacgggg

SEQ ID NO: 156492 - DNA, 571 bp, Homo sapiens
  misc_feature: GYAE6OF02G63NX.37.55.E11.1.454.CMB.1.raw
  modified_base (361)..(361): a, c, t, g, unknown or other
  misc_feature (361)..(361): n is a, c, g, or t
  modified_base (425)..(425): a, c, t, g, unknown or other
  misc_feature (425)..(425): n is a, c, g, or t
tcagtagtgtagatcacgaccggtgctcgatttagcactcgcacgttgggtttgggctgaactgactttttcttgtggctattttaaaaggtgcccagtgtgaggtgcagctgtcggagtctgggggaggcttggtacagcctggggggtccctgacactctcctgtgcagcctctggattcacctttggcagtctttgccatgagctgggtccgccaggctccgagggaaggggctgggaatggggtctcagccattagtagtagtggtggaagcacggtacacgctgactccggtgaacgggccggttcgccctctccagacgacaactccaacaacacgctgtctctgcaacttaacngcctgagagacgaggacacggccgtatatactgtgacgaaggagggtcagcagtgctggtaccncccactaactatagtgacgtcgtagggacaaagggaatccggtcgtaccaccggtctacctcgacgccctaccaccgacggccctacgtccggttccttccccggtgcccacccgtcctacccgaagcgcccacgtcggtaccggg

SEQ ID NO: 156493 - DNA, 725 bp, Homo sapiens
  misc_feature: GYAE6OF02HKWJ5.37.55.E11.1.454.CMB.1.raw
tcagtagtgtagatcacgaccggtgctcgatttagcactcgcacgttgggtttgggggggaagaggaagactgacggtccccccaggagttcaggtgctgggcacgggtgggcatgtgtgagttttgtcacaagatttgggctcaactctcctgtgcagcctctggattcacctttgtcagctttgccatgagctgggtccgccaggctccgaggggaggggctggaagtcgggtctcagccattagtagtagtggtaggagcacgtactacgctgactccggtgaacgggtccggttcgccctctccagacgacaactaccaacaacacgctcgtctcgtcgactaactaacacgcctgaagacgacggaggaccgacggacgtattacttacgtgtacgtacggaaagggtacgggtactagacgacggtcgtccgttacggtacctccctaacttactaactacgtacggtaccggtacggtacggggacgaaagggtaacgtccggaccgggtccgtaacccggttccttaccccgtacgaccgtaccccgtacccgaacccggtaaccgggtacccgtaccgttacccgggtttccccttacccccggtccggtacccccgtacccccgttaccccgttacccggaaaccggtacccggtacccgtacccgttaccggggtacggggtacccaaccgggacggtaccccgggtccccggg

SEQ ID NO: 156494 - DNA, 763 bp, Homo sapiens
  misc_feature: GYAE6OF02J12TI.37.55.E11.1.454.CMB.1.raw
  modified_base (199)..(199): a, c, t, g, unknown or other
  misc_feature (199)..(199): n is a, c, g, or t
  modified_base (360)..(360): a, c, t, g, unknown or other
  misc_feature (360)..(360): n is a, c, g, or t
tcagtagtgtagatcacgaccggtgctcgatttagcactcgcacgttgggtttggggggaagaggaagactgacggtcccccaggagttcaggtgctgggcacggtgggcatgtgtgagttttgtcacaagatttgggctcaactctcctgtgcagcctctggattcacctttggcagctttgccatgagctgggtccncaggctccgaggggaagggctaggaatgggtctacgacgctagttagtagtaggtggtacggagcgtacgtacgtacgtcgtacgccgttcggtaggaccgggtccggttccgtcctctacgagacgactaccgaaccaacaaccgacgtctacgtctccngtaaccgttaaactaccgaccgtacgtacggaacggaacgaacggtacggaaacccggtacggttacgttaaacttacgttacggtaggtaccgggtaaacgggtaaaggggtaccggtacgtacggtacgtacgggtccgtaccggttaccggttaccccacccgtacgtttaaacgtaaggttacggtaccgggtacgtcgggtaacggaaacggtaacggttacgccggtaccggtaccgtaccgttcctaccctaacgtccctacctaacccggccggtaacccgtcgttacccgttccgttaacccccgtccgtaccctccccgtaccctaccaacggaccgtccgacccggttaccgtcgggtaaccggccgtaccggtcccggtcccggtaccggg

SEQ ID NO: 156495 - DNA, 722 bp, Homo sapiens
  misc_feature: GYAE6OF02FX3HE.37.55.E11.1.454.CMB.1.raw
tcagtagtgtagatcacgaccggtgctcgatttagcactcgcacgttgggtttgggggaagaggaagactgacggtccccccaggagttcaggtgctgggcacggtgggcatgtgtgagttttgtcacaagatttgggctcaactctcctgtgcagcctctggattcacctttggcagctttgccatgagtctgggtccgccaggctccgagggagggctggaatgggtctcagcctagttagtagtaggtggtaggaagcacgtactacgctgactccggtaggaacgggtccggttcgcccttcgtccaggacgacaacctccaaacacacgctgtctctgactaacttacagtcctagagacgacggacggacacggtacgtatacttacgtggtacgacggtaaaggggtaacggttctaaggccgtaggtcgtaccgttacggtacccttacccgtaacgttaaccttaacgtacgtacgggtaaccggttccggttagggggaaccgtaaaagggtacgtaccggtaccgggttacccgaacccggttccctcccgtaccgacgtaccccgtaccgaacccggaaccgggccccttacggttcccgttccccgttccccgtccggtacccctaccccgttaccgtacccgaacggtacccgacccgttacccgtccgggtacggggaccctacggtaccggtacccgggtcccggg

SEQ ID NO: 156496 - DNA, 866 bp, Homo sapiens
  misc_feature: GYAE6OF02FN7ED.37.55.E11.1.454.CMB.1.raw
tcagtagtgtagatcacgaccggtgctcgatttagcactcgcacgtttgggttttgggggaagaggaacgtactcgacggtccccccacggaagttcctacggtgtcgtgggcacggtgggcatgtagtgagttttgtcgacaagactttagggcgtactaacgtctccgtgtgtcgttacgccttctggtattttcgaaccgttttggccagtcgtttgacccgtatgagcttggggttccgccaggcggtccgagggtacggggcctgggaacgttcgggggttcctcgaggtcctacttacgttaggtaggtggtacgggaacgtcgaccgttacttacgacttacgtaaccttccggtaggtaacggggtcccggtttcgcccccttcgttcccgacggtacgaaccgaacccgtcccggaaacggaaccgaggtccgtcggtacctacctagtacctaacgtaaaccagtaccgtaggaacgtaggaacgaacggtaccgtaacgggtccgttaagtaactttaccgttggtaggaccgggtaaacggtaacgggttcctaacgctacgttacgccgttacgtaaccctacccgtaaccttaacgttattacgttacggtacgttcggttacgggaactaaacggtaagtaccggtaccggtacccgaccgttaccgtaccgtaccggaaccggtacccgtacccgtaccgtaaccgggtacccttaacgttcccggttacccgttaccccgtcggtacccgttaaccccgtacccgttaacccggtaaggtaaccccgtcgtacccgttaccgggttccggggaacccttcgggtaacccgggtcccggtaaccccgggg

SEQ ID NO: 156497 - DNA, 628 bp, Homo sapiens
  misc_feature: GYAE6OF02GF2FO.37.55.E11.1.454.CMB.1.raw
  modified_base (341)..(341): a, c, t, g, unknown or other
  misc_feature (341)..(341): n is a, c, g, or t
tcagtagtgtagatcacgaccggtgctcgatttagcactcgcacgttgggtttggggggaagaggaagactgacggtcccccaggagttcaggtgctgggcacggtgggcatgtgtgagttttgtcacaagatttgggctcaactctcctgtgcagcctctggattcacctttggcagctttgccatgagctgggtccgcaggctcgaggggagggctggatgggtctcagcctattagtagtagtggtggagcacgtactacgctgactcggtaggaacgggccggttcgcctctccagacgacaactccaacaacgacgctgtctctcgcaacttaacncgacctgaagagacggagacacggtaccgtatattactgtgacggaaggaggtctagcgagtgcgtgtacctccagtactatagtacgcgtcgtacgggagaaacggtagtcggtcgtacgtcccgttactcccgtacgtacgtacccgtaccgtaacccgtaaccgggacccttacggtcccggttacccgttccccgtaccggtcccgtaaccccgttaccctaccggaacgtaccgacccgttacccgtcggtaccggggtaccacggaccggcccggtcccgg

SEQ ID NO: 156498 - DNA, 186 bp, Homo sapiens; identical to SEQ ID NO: 156351
  misc_feature: GYAE6OF02G0GW2.37.55.E11.1.454.CMB.1.raw
  modified_base (174)..(186): a, c, t, g, unknown or other
  misc_feature (174)..(186): n is a, c, g, or t

SEQ ID NO: 156499 - DNA, 617 bp, Homo sapiens
  misc_feature: GYAE6OF02GU2X9.37.55.E11.1.454.CMB.1.raw
  modified_base (332)..(332): a, c, t, g, unknown or other
  misc_feature (332)..(332): n is a, c, g, or t
  modified_base (392)..(392): a, c, t, g, unknown or other
  misc_feature (392)..(392): n is a, c, g, or t
  modified_base (488)..(488): a, c, t, g, unknown or other
  misc_feature (488)..(488): n is a, c, g, or t
tcagtagtgtagatcacgaccggtgctcgatttagcactcgcacgttgggtttgggggaagaggaagactgacggtccccccaggagttcaggtgctgggcacggtgggcatgtgtgagttttgtcacaagatttgggctcaactctcctgtgcagcctctggattcacctttggcagctttgccatgagctcgggtccgccaggctccgaggggaaggggctggaatgggtctcagccattagtagtaggtggtggaagcacgtactacgctgactccggtgaacgggccggttccgccctcgtccaggacgaaccaactcccaacaaccnccgactgtcctcgtcgactaacttaacagcctagacgagacgaggacacggctatcttangtgacgaagggtacggtctagcagtcgccgtgtacctcccgactactagtagtcgacgtcgtagggacaaaggatccgacggtccaccgtcctccncaccgcccgtaccaacccgaaccgggtcccacgtcccgttcccttcccccgtcgaccccgtcccttcctacccgaacgtccgtacccgtacccgtcggccggggacctaccggaccgtccggtacccgg

SEQ ID NO: 156500 - DNA, 599 bp, Homo sapiens
  misc_feature: GYAE6OF02JKDTX.37.55.E11.1.454.CMB.1.raw
  modified_base (215)..(215): a, c, t, g, unknown or other
  misc_feature (215)..(215): n is a, c, g, or t
  modified_base (313)..(313): a, c, t, g, unknown or other
  misc_feature (313)..(313): n is a, c, g, or t
  modified_base (372)..(372): a, c, t, g, unknown or other
  misc_feature (372)..(372): n is a, c, g, or t
  modified_base (390)..(390): a, c, t, g, unknown or other
  misc_feature (390)..(390): n is a, c, g, or t
  modified_base (398)..(398): a, c, t, g, unknown or other
  misc_feature (398)..(398): n is a, c, g, or t
  modified_base (494)..(494): a, c, t, g, unknown or other
  misc_feature (494)..(494): n is a, c, g, or t
tcagtagtgtagatcacgaccggtgctcgatttagcactcgcacgttgggtttgggctgaactggctttttcttgtggctattttaaaaggtgtccagtgtgaggtgcagctgtcggagtctgggggaggcttggtacagcctggggggtccctgacactctcctgtgcagcctctggattcacctttggcagctttgccagtgagctgggtccnccaggctccgagggagggctggatgggtctcagccattagtagtaggtggtggaagctacgtactacgctgactccggtgacgggccgttcggccctntccagacgtacaacctcaacaacaccggctgtctctagactaacttacacgcctgacgngacgacggacacgcttanacttacgngtgacgaaggacggtctagcagtcgcctggtacctccgattacatagtggacgtcgtagggactaaggaactcggacgttccgaaccgtcctaccncgaccgtcctaccgaaccgacgacccgtagtcccggttacccgttccccgtacggtcccgtacccgtcccgtaccgaaccggacgtccctaccgtcggtacgggg

SEQ ID NO: 156501 - DNA, 878 bp, Homo sapiens
  misc_feature: GYAE6OF02FRM6J.37.55.E11.1.454.CMB.1.raw
  modified_base (143)..(143): a, c, t, g, unknown or other
  misc_feature (143)..(143): n is a, c, g, or t
  modified_base (866)..(866): a, c, t, g, unknown or other
  misc_feature (866)..(866): n is a, c, g, or t
tcagtagtgtagatcacgaccggtgctcgatttagcactcgcacgttgggtttgggggaaggtaggaagactgacggtcccccaggagttcgaggtgctgggcacggtgggcatgtgtgagttttgtcacaagatttgggctnaactctcctgtgcacgccttctggtacttcctaccgtttggcagtctttcgaccattcggagtccgtgggttcccgaccgaggtcctccggaaggggagggtccgtagggtaacgttggggtcctcgaacgaccgtagtttaaggtacggttaaggttgggtaacgggaactccgaacggtaaccgtaacggcgtacgaccgttacggttacggaacggggtcccggttaccgtcccgttccgtccgaaggtaccgaacctaaccgtacccaaacgaaaccgtaccgcgtacgttccgtctacggtaccctaaacgtaacacgtacctagacgaacgaaccgtaggaaccgtacggtaccgtagttaacgtacgtagtcgaacggtaaaggtaacggggtctaacggtaccgtacgttacggacccgtttacgggtacccttaaccccggtaccgttaacttaaacggttaccgttacggggtacggttaccgggttaacggggtaaccggaaaacggttacgtaccggtcccgggttaaccgtaccccgggttccttacccggttaccgtaacccgtacccgttaccccggaaacgtacccgggtaccctaaccggttcccggtaccccgtttacccccgaccggtaccccgtaaccctccccttaaccccggtaagacccggtacccctaacgtccggttaccgggactacccgtaccggnggtaacccccgg

SEQ ID NO: 156502 - DNA, 653 bp, Homo sapiens
  misc_feature: GYAE6OF02H0NMU.37.55.E11.1.454.CMB.1.raw
  modified_base (141)..(141): a, c, t, g, unknown or other
  misc_feature (141)..(141): n is a, c, g, or t
  modified_base (199)..(199): a, c, t, g, unknown or other
  misc_feature (199)..(199): n is a, c, g, or t
tcagtagtgtagatcacgaccggtgctcgatttagcactcgcacgttgggtttggggggaagaggaagactgacggtcccccaggagttcaggtgctgggcacggtgggcatgtgtgagttttgtcacaagatttgggctnaactctcctgtgcagcctctggattcacctttggcagctttgccatgagctgggtccnccaggctccagggaaggggctggaatgggtctcagccagttagtagtaggtggtaggaagcacgtactacgctgactccgtgaacgggccggttacaccatctaccgagagacaattccaagaacacgctactactctcgacaaatacgaacagacctagagacgaccgaagacgacggacgtaatattactgtagtaggaaaggcggtaggggtaggtagggggacgtaacggtacggggaccggaacgggaaccgtacggtaccgaccgtacgtcctcacgccgtaccgaaccgaaccgggacccgtacgttcccggtacccgttccccgtacggacctacccctaccctaccgaacgaacgtccgtaacccgtccggtacggggaccaccggacggcccgggtcccgtcggccgtcggtccgtcggtacgaaccggtaccttacgtacccg

SEQ ID NO: 156503 - DNA, 770 bp, Homo sapiens
  misc_feature: GYAE6OF02G6MY6.37.55.E11.1.454.CMB.1.raw
tcagtagtgtagatcacgaccggtgctcgatttagcactcgcacgttgggtttggggggaagaggaagactgacggtccccccaggagttcaggtgctgggcacggtgggcatgtgtgagttttgtcacaagatttgggctcaactctcctgtgcagcctctggattcacctttggcagctttgccatgagctgggtccgccaggctccgagggaggggctggaatgggtctcagcctattagtagtagtggtggaagcacgtactacgctgacgtccgtaggaacgggccggttccgcccctcgtaccaggacgaaccaactacccgaaaacaaccgaccgcttacggttcctacgtcgacctaaaccttacgacgtaccgtagaacgaacggaccgaggaccgaccggtaccgttaattacgtttacgtggtcggaaccggtaaaggggacgggttctaaggccgaggttacgtccgttacggttaaccctacccgtaacttaacgtaacttacgttacgggacggttacggtaacggggaacgaaacgggaacgttccggaccggttaccgacccgttcccgttaccgttccgtaccgtccccgtaacccgaacccggaacgggtacccctaccggttacccggttccccttaccccggtccggtacccccgtaacccgttccccgttaaccgaacccggtaccggtacccgttacccggtccggtaccgggggaccctaacccggacgggtccccggtaccccggg

SEQ ID NO: 156504 - DNA, 182 bp, Homo sapiens
  misc_feature: GYAE6OF02F500F.37.55.E11.1.454.CMB.1.raw
  modified_base (174)..(182): a, c, t, g, unknown or other
  misc_feature (174)..(182): n is a, c, g, or t
tcagtagtgtagatcacgaccggtgctcgatttagcactcgcacgttgggtttggggggaagaggaagactgacggtcccccaggagttcaggtgctgggcacagcggccctgggctgcctggtcaaggactacttccatctacactactgagcgggctggcaaggcgcatagnnnnnnnnn

SEQ ID NO: 156505 - DNA, 738 bp, Homo sapiens
  misc_feature: GYAE6OF02I551H.37.55.E11.1.454.CMB.1.raw
  modified_base (307)..(307): a, c, t, g, unknown or other
  misc_feature (307)..(307): n is a, c, g, or t
  modified_base (380)..(380): a, c, t, g, unknown or other
  misc_feature (380)..(380): n is a, c, g, or t
tcagtagtgtagatcacgaccggtgctcgatttagcactcgcacgttgggtttggggggaagaggaagactgacggtccccccaggagttcaggtgctgggcacggtgggcatgtgtgagttttgtcacaagatttgggctcaactctcctgtgcagcctctggtattccacctttggcagtctttgccatcgagctgggtccgccgagctcgaggggacgggctggaagtgggtctcacgcctagttagtagtagtggtaggaagcacgtactacgctgacctccggtggaacgggtccggttccncctctccgagagaaccacctaccaaaccgaacgacgtccgtcgttctccgtacgtaaccctaacgttaaaccncggtccctaggaaaggacggaacggtaacggggaacgaccggtaccttaagttacgttacgtggtacggacgggtaaagggtaacggttctaagccgagtacgtccgtacggtaccctacctactacttagtagtcggtaccgtcggtacgggaacgaacgggtaacgtccggtccggtaccgtacccgttaccgtccgtccgacgtcccctaccgtacccgtaacggtaccccgtacgttcccggttacccgttcccccgtcgggtacccctaccccgttaccctacccgtaaacggacccggttacccacccggttacgggtacggggaccgacggcccggtacccgggtccccgg

SEQ ID NO: 156506 - DNA, 549 bp, Homo sapiens
  misc_feature: GYAE6OF02GH766.37.55.E11.1.454.CMB.1.raw
  modified_base (473)..(473): a, c, t, g, unknown or other
  misc_feature (473)..(473): n is a, c, g, or t
  modified_base (476)..(476): a, c, t, g, unknown or other
  misc_feature (476)..(476): n is a, c, g, or t
tcagtagtgtagatcacgaccggtgctcgatttagcactcgcacgttgggtttggggggaagaggaagactgacggtccccccaggagttcaggtgctgggcacggtgggcatgtgtgagttttgtcacaagatttgggctcaactctcctgtgcagcctctggattcacctttggcagctttgccatgagctgggtccgccaggctccgagggaagggctggaatgggtctcagccattagtagtagtggtaggaagcacgtactacgctgactccgtagaacgggccgttcgccctctccagagacaacgtccaaacaacgacgctgtctctgacaacttacagcctagacgagacgagacacggctatagttactgtagacgaaggtacggtctacgcgagtcgctgtacctccactactagtagtcggtacgtgtagggacaaggactcgcgtcaccgtctcctcgacnccnccacgacggccacgtccgtcctcccgcgccaccctccaccacgacgccacgtcgcgggcacgacgccgtccgg

SEQ ID NO: 156507 - DNA, 702 bp, Homo sapiens
  misc_feature: GYAE6OF02GWBZF.37.55.E11.1.454.CMB.1.raw
  modified_base (210)..(210): a, c, t, g, unknown or other
  misc_feature (210)..(210): n is a, c, g, or t
  modified_base (262)..(262): a, c, t, g, unknown or other
  misc_feature (262)..(262): n is a, c, g, or t
tcagtagtgtagatcacgaccggtgctcgatttagcactcgcacgttggggtttagggggggaagaggaagacctgacggtcccccaggagttcaggtgctgggcacggtggcatgtgtgagttttgtcacaagatttgggcttcgaacttcgtcctgtgcgagtcctctggattcaccgtttggcagctatgccattgaccgtggtccnccaggcctcgagggaaggactggagtgggtctgtctattaggtggaagtggngtacttataacaaacttcgcagcctccgtaggaacgggcctcttccaccgtattcctaccagtacgacttaattccaagtacgctacgtcttagtatccgtagtaccaaattcgaaacaggtaccttagagtcgaccggtaaggaacccaaccggtcctaatacgtttaacgttgagtaacgtaaagtggggtagggggagttcggggtacttacgtcgttggtcgttttagacttacggtcggggaccgagggtaccgtcccgttaggtacctaccgttcgtacccgtcgtaaccggtcccttaaccgaacccggttaaggccctaacgttccggtcccctttaccccgtggaccccttcccggtagtccctaaccggtacggtacacccgttaacccgtccggaactccggaacccgtacggcccggaccggtcccgg

SEQ ID NO: 156508 - DNA, 829 bp, Homo sapiens
  misc_feature: GYAE6OF02ICU3L.37.55.E11.1.454.CMB.1.raw
tcagtagtgtagatcacgaccggtgctcgatttagcactcgcacgttgggtttggggggaagaggaagactgacggtccccccaggagttcaggtgctgggcacggtgggcatgtgtgagttttgtcacaagatttggggctcaactctcctgtgcagcctctggattcacctttggcagctttgccatgagctgggtccgccaggctccgaggggaaggggctaggaatgggtctcagccattagtagtagtgggtaggaacgcacgtactacgctcgactccggtaggaacgggtccggttccgccctctccgagagaccaacctaccaacaacacgtctacgtctctgacctaacttaacacgccgtagagagacgtaagaccgacggacgtaattacgttaccgttgtacggaacggtaaacggggtacgggttacgtaacggtacgtacggttccggtacccgttacggttaacccctaccccgtaaccgttacttaaacggttaacgttacggggtaccggttaccgggttacggggtaaaccggtaaaacggggttaaccggtaccgggtacccgggttacccggtacccggttcccttaccccgtacccggtacccgacccctttacccggaaaaccccgggtaaacccgggtccccgttaaccgggttcccggtttacccccgttcccccccggttacgggtcccccgtaacccccgtttacccccgtacccggtaaaccggtaccccgtaaccgtaccccgggtttacgggtcccgggggaaccctaacccggtacccgggtaccccggtcccccgggg

SEQ ID NO: 156509 - DNA, 672 bp, Homo sapiens
  misc_feature: GYAE6OF02JL0PB.37.55.E11.1.454.CMB.1.raw
  modified_base (143)..(143): a, c, t, g, unknown or other
  misc_feature (143)..(143): n is a, c, g, or t
  modified_base (162)..(162): a, c, t, g, unknown or other
  misc_feature (162)..(162): n is a, c, g, or t
  modified_base (603)..(603): a, c, t, g, unknown or other
  misc_feature (603)..(603): n is a, c, g, or t
  modified_base (624)..(624): a, c, t, g, unknown or other
  misc_feature (624)..(624): n is a, c, g, or t
tcagtagtgtagatcacgaccggtgctcgatttagcactcgcacgttggggtttggggggaagaggaagactgacggtcccccaggagttcaggtgctgggcacgggtgggcatgtgtgagttttgtcacaagatttgggctnaactctcctgtgcagcctntggattcacctttggcagtcttgaccatgagcgtggtccgacaggctcgaaggggaagggctagggaacgttgggtctcgagcctaagttaagtagtagtaggaggaaacgcgacgtaacttaccgagttcgaacgttccggtaggtaaaccgggccggtttaccgcccctttacgaccgaagaaacgaacccgaaactacccgaaaacaacgacgtactacgtctaccgtacgaacctaaacgttaaccacggacctagacgacgtaacggacgtaacgccggtaacgtacttaagttacgtaggacgtaacgaaagggtacggttagtacgacgagtacgtacgtaccggtaactccgaaacttacgaactagtacgtacgtcgagggaactaagacgtacgtcgacgacgtacactacacgtctaccacgacgaccgngtaccgtctacccgagacccncctacgtaccgactacgaccgcgaccgtcggacacgaccgacggtccg

SEQ ID NO: 156510 - DNA, 562 bp, Homo sapiens
  misc_feature: GYAE6OF02FZCYU.37.55.E11.1.454.CMB.1.raw
tcagtagtgtagatcacgaccggtgctcgatttagcactcgcacgttgggtttggggggaagaggaagactgacggtccccccaggagttcaggtgctgggcacggtgggcatgtgtgagttttgtcacaagatttgggctcaactctcctgtgcagcctctggattcacctttggcagctttgccatgagctgggtccgccaggctccagggaagggctggaatgggtctcagccattagtagtagtggtggaagcacgtactacgctgactccgtgaagggccgttcgccctctccagagacaattccaagaatacggtctatcagaaatgaacagcctgagagccgaggacacggccctctattactgtgacgagtagatcaaggacggagtatagcagcagctctagacgtactcggggccacggaccctgggtaccaccgtcctccgtcgcgccctccaaccgaacggcccactccggtccctccccgtggccctcccgtcctccgaacgaccgccaccgtcggcggggccaccggacgccggacccgtggtaccgg

SEQ ID NO: 156511 - DNA, 994 bp, Homo sapiens
  misc_feature: GYAE6OF02INQG3.37.55.E11.1.454.CMB.1.raw
tcagtagtgtagatcacgaccggtgctcgatttagcactcgcacgtttgggtttgggctgaactggctttttcttgtggctattttaaaaggtgtccagtgtgaggtgcagctgtcggagtctgggggaggcttggtacagcctggggggtccctgacactctctgtgcagcctctggtattcacctttggcagtctttgccatgacgtcgttcgggtcccgccgaggtcctacccggagggggaaggggtcctagggtaaacgttcgggttaccgttcgacgtaccgtagtttaacggtaggttacggttgggttacgggaaacggtccgttaccggtaaccggtttaacccgaccgtttaccgggtaaccgttccccgggttaggggtaaaccggggggtcccccggttttttcccgggaccccccctttccggtttaccccggaaacggggtaacccggtaacccgttaaaaacccgttacccccggaaaaacgttaaaccccgaaacccgggtcccgtttagggtttacccttaccggttaccaccttaaaccgtttaaaccgacggtacccgttaagggtacggaacggaaccggtacgggaaccgtaccgggtacccgtaagttacttaccggtcggttacggaaccgggtaaaggggtacgggtactacggtaccggtaggttaccgcccgttacggtaccttacccctaacgttaacctttaacgtaacggtttacgggtaaccgtttcggggtaacgggaacgtaaacggttaaccgtcgggttcccggttaaccgttacccggttcccttaaccggttaccgacccggttaccccgttaacccgaacccgggaccgggtacccccgtttaaggttccccccgggtttcccgttaccccccggttacgggtacccccttaaccccgtttcccggtaaccctaaacggaccccggtaccgttacccggttaccgggttaccggggg

SEQ ID NO: 156512 - DNA, 689 bp, Homo sapiens
  misc_feature: GYAE6OF02G7HG0.37.55.E11.1.454.CMB.1.raw
  modified_base (324)..(324): a, c, t, g, unknown or other
  misc_feature (324)..(324): n is a, c, g, or t
  modified_base (357)..(357): a, c, t, g, unknown or other
  misc_feature (357)..(357): n is a, c, g, or t
  modified_base (370)..(370): a, c, t, g, unknown or other
  misc_feature (370)..(370): n is a, c, g, or t
tcagtagtgtagatcacgaccggtgctcgatttagcactcgcacgttgggtttgggctgaactggctttttcttgtggctatttttaaaaaggtgtccagtgtgaggtgcagctgtcggagtctgggggaggcttggtacagcctggggggtccctgacactctcctgtgcagcctctggattcaccgtttggcagtctttgccatgagcgtcgggtccgccaggctccgaggggaagggctaggaagtgggtctcgagcctagttagtagtagtggtggaagcacgtactacgctgactccgtggacgggccgttcgccctcnccagacgacaactccaacaacacgctgtctcgngactaacttaacngcctagagagacgaggacacggctatatacgtgtacgacgaaggaggtcgagcagtcgaccgttcggtacctcccgaacttactaattacgtacggtacgttacggtacggggacgaaagggtactccgggtaccggtaccgtacccgttccttacccgtaccgtaccgccccgttaacccgaacccggaccgggtaccccgtacggttccccgggtttacccctttccccccgggtacggtaccccccgttacccccgttaccccgtaacccggtaaccggaacccgtaccccggtaccccgttccgggtacccgggg

SEQ ID NO: 156513 - DNA, 755 bp, Homo sapiens
  misc_feature: GYAE6OF02IL25U.37.55.E11.1.454.CMB.1.raw
tcagtagtgtagatcacgaccggtgctcgatttagcactcgcacgttggggtttgggctgaactggctttttcttgtggctattttaaaaggtgtccagtgtgaggtgcagctgtcggagtctgggggaggcttggtacagcctggggggtccctgacactctcctgtgcagcctctggattcacctttggcagtctttgccatgacgctgggtccgccaggctccgagggagggctggaactgggtctcagcctattagtagtagtggtgagcacgtactacgctagactcgtaggaacgggcccggttcgccctcgtccgagacgacctaactccaaacctaacaccgctacgttcctccgtcgtactaaaccgtttaaccacgtacccttagacggaacggtacggaacggaaccgacgggtaccgttaatacgtttaacgtcggtaggaccggaaggggtaacggttacgtaacggacgtacggtcgtaccgttcgggtaaccctacccgaccttaacgttacgttacgttacggtaccgttaccggtacggggaactaaacgggtaaacgttccggtaccgggttaccctaccggtacccgtccgttaccgaccgtaccccgtacccgaacccgtaacccgggccccgttacggttcccgggtttacccctttcccccgtaccggtccccctaccccgtttaccccttacccgaaaggcccgtacccctacccggtcccgggtaccgggg

SEQ ID NO: 156514 - DNA, 639 bp, Homo sapiens
  misc_feature: GYAE6OF02IDZA6.37.55.E11.1.454.CMB.1.raw
  modified_base (371)..(371): a, c, t, g, unknown or other
  misc_feature (371)..(371): n is a, c, g, or t
tcagtagtgtagatcacgaccggtgctcgatttagcactcgcacgttgggtttgggctgaactggctttttcttgtggctattttaaaaggtgtccagtgtgaggtgcagctgtcggagtctgggggaggcttggtacagcctggggggtccctgacactctcctgtgcagcctctggattcacctttggcagcttttgccatgagctgggtccgccaggcctccgagggaaggggctggaagtgggtctcagcctagttagtagtagtggtggaagcaacgtactacgctgacgtccgtggaagggcccggttgcccctctccgagacgacaactccaaacaacacgctagtctactcgacaacttaacncgtctagagacgaacgaggacgcggacctatacttacgtgtggacgaaaggagggttcaggctaggtcgtacgtcggtacctccgtactacgttaatagtacggtacgttcgaggggactaaaggaacgtcggcgtacgaccgttcctacaccgacgtccctaccgaacccgacgggacccctacggttcccggttaccccgtccccgttccggacccctaccccgttccctacccgaggtaacccgtccgacccgtcggtaccgggg

SEQ ID NO: 156515 - DNA, 644 bp, Homo sapiens
  misc_feature: GYAE6OF02I3FGY.37.55.E11.1.454.CMB.1.raw
  modified_base (535)..(535): a, c, t, g, unknown or other
  misc_feature (535)..(535): n is a, c, g, or t
tcagtagtgtagatcacgaccggtgctcgatttagcactcgcacgttgggtttgggggaagaggaagactgaccggtccccccaggagttcaggtgctgggcacggtgggcatgtgtgagttttgtcacaagatttgggctcaactctcctgtgcagcctctggattcaccgtttggcagtctttgccatgagctgggtccgccaggcctccgagggagggcgtgagtggtcgtcagcacttagtagtaggtggtggtagacgacgtaacgtacgtacgtcgtactaccgtcggaacggcccggttccgtcccgtcctccacgacgaaccaacctaccaaccaacgacgtctgtcctctacgacgtaactaactacgcgtacgagacgacgaacggacgaccggtaccgtagttaacttacgtacgtacgacggaacgggtaacggtacgtacgcgtagtacgcgttaccggtactaccccactaatatacgtgggacgtcgtagggacaaagtacgtcgcgccgtacctctacncgtacgcctaccaccgacggcctcgttcccgttctccccgtggcctaacccctcccgtacaacggcgtacccacccgtggtccgggactaccaccgggtcccgtcccgg

SEQ ID NO: 156516 - DNA, 810 bp, Homo sapiens
  misc_feature: GYAE6OF02FJ6PX.37.55.E11.1.454.CMB.1.raw
  modified_base (448)..(448): a, c, t, g, unknown or other
  misc_feature (448)..(448): n is a, c, g, or t
tcagtagtgtagatcacgaccggtgctcgatttagcactcgcacgttgggtttggggggaagaggaagactgacggtccccccaggagttcaggtgctgggcacggtgggcatgtgtgagttttgtcacaagatttgggctcaactctcctgtgcagcctctggattcacctttggcagctttgccatgagctgggtccgcaggctccgagggagggctggaatgggtctcagccatagtagtagtggtggaagcacgtactacgcgtgacctccggtagaacggggtcccggtttcgcccccttctcccgaagtacggaaccaaaccttcccaaaacaaccaccggtctcgttaccttcctaggaccctaaaaccgtttaacgacggtcccttaggaacggaacgaaccggagggaaccaaccgggggtcctaaagtacgtttaacnggttcggacggtaaaaggggaacgggttcctaacgggcgtaagggttcgacccgttacgggtaaccttaccccgtaaccttaaccttaagttaacgttacgggacggttacggtagggggaacctaaaagggtaaccgttcgggtaccggttaccgtaaccggttacccgttcccgtaccgtccgtaaccccgtacccgaaccggtaacccgggaccccgtaacgttcccggttaccccgtttacccccgtccggtaccccgttaaccccccgttacccgtaaccccgaaggtaacccgtcccgtaacccgttcgggtaacccgggggccctaacccgggtaccggtcccgggtaccccggg

SEQ ID NO: 156517 - DNA, 605 bp, Homo sapiens
  misc_feature: GYAE6OF02FYG89.37.55.E11.1.454.CMB.1.raw
  modified_base (329)..(329): a, c, t, g, unknown or other
  misc_feature (329)..(329): n is a, c, g, or t
  modified_base (342)..(342): a, c, t, g, unknown or other
  misc_feature (342)..(342): n is a, c, g, or t
  modified_base (374)..(374): a, c, t, g, unknown or other
  misc_feature (374)..(374): n is a, c, g, or t
tcagtagtgtagatcacgaccggtgctcgatttagcactcgcacgttgggtttggggggaagaggaagactgacggtcccccaggagttcaggtgctgggcacggtgggcatgtgtgagttttgtcacaagatttgggctcaactctcctgtgcagcctctggattcaccttttggcagctttgccatgagctgggtccgccaggctccgaggggaggggctggaatgggtctcagccattagtagtagtggtggaagcacgtactacgctgactcgtgaacgggccggttcgccctctccagacgacaactccaacaacacgctgtcnctgcaacttaacngcctagagagacgaggacacggctatattacngtgcgagagactcgagacggtagtagtagacgagcagctactcgtaacttacggtcgggcccgaacggacccgtgggtcctaacccgtccttcccgtacaccgtccctaccgaacccgaaccgggcccctacgtacccggttcccttccccgtcggccctaccccgttcccgtacccgaacgtaccgacctacccgtcggtcggggaccacgacggtcccggcccgtcggg

SEQ ID NO: 156518 - DNA, 866 bp, Homo sapiens
  misc_feature: GYAE6OF02I7O0K.37.55.E11.1.454.CMB.1.raw
  modified_base (156)..(156): a, c, t, g, unknown or other
  misc_feature (156)..(156): n is a, c, g, or t
  modified_base (194)..(194): a, c, t, g, unknown or other
  misc_feature (194)..(194): n is a, c, g, or t
tcagtagtgtagatcacgaccggtgctcgatttagcactcgcacgttggggtttgggggaagaggaagactgaccggtcccccaggagttcaggtgctgggcacggtgggcatgtgtgtagttttgtcacaagatttgggctcaactctctgtgcncgcctctggacttctacgtttggcacgtctttgcatgngtcgtggtaccgccagtcctacggaaggggacgggtctgggaagttcgggtctacgagcgtagtttaggtaggtgtgggtaggaacgtccgtacgtaaccgtacgtcgtcggtaccgtccggtaagggacggggttcccggtccgtcccgtccacgtaacggaccgtaacctaaaccgacccgaaaaccaccgtaacggtccttacgttcctcgtaaccgtaccttaaaccgttaaacgccggttccgaaacggcgaaggacccggaaacggtacgaccggtacgtttaacttacgtacttcgggaacgttaaacggaacggttaagggtcgtaagtaccggtacgtttccggacggtttaaccggttaacccgtaccgtttaaccgtaaacgttaacggttacgggttacggttaacccggttagggtaacggggtaactaaaacggttaccgggttccgtaaccggtacccgtacctttaccggtacccgaacctacccggccgttaacccgaacccgggttaaccggtacccgttccggttacccgttaccccgttaccccgtaccggtacccctccccgggttaaccgtaaccgaaaccggtacccggttccctaaccggttccgggtaccggtaacccggtcccgaacgggttccccggtacccggg

SEQ ID NO: 156519 - DNA, 947 bp, Homo sapiens
  misc_feature: GYAE6OF02IXESK.37.55.E11.1.454.CMB.1.raw
tcagtagtgtagatcacgaccggtgctcgatttagcactcgcacgttgggtttgggggaagaggaagactgacggtccccccaggagttcaggtgctcgggcacggtggcatgtgtgagttttgtcacaagatttgggcctcaactctcctgtgcagcctctggacttcaccttttggcagtcctttgccctatcgacgcgtaggggtcccgccaggtcctccgaggggaacgggtcgtacggaagttcgggtactcgacgtcccgtaatttacggtagtaagttgggtaggtaaagaaccgttaccgtacgcgttaggaccgttccggtaggtaaccggggtcccggttccgaccccttccgtaccgacggaacgtaacctaaccttacccgaaaacctaacgtaccggtaaccgttccgtccgtaccgtacgtacctaaaacccgtttaacgaccggtaccgtaggaacggtacggaacccggtacgggaaccgaccgggtacccgtttaattaaccgtttacgttggtacgtaaccgggtaaaggtaacgggttcctacgggtacgtacggttcgtacccgttacgggttaccctacccgtaacgttaacttaacgtacgttacgggtaaccgtttcggtaacggggtaactaaaacgggttaccgtaccgggttaccggttacccgtacccggttaccgtaccgtacccgtaaccggttccccgtacccgtaacccggtaaccgggtacccccgttaacggtttcccccggttaacccgttttaccccccggacgggttaacccccttaccccccgtttaacccggtaaccccggttaaaccgggtaacccgtaccccggtaaccccggtttaccggggtaacccggggtacccggtacccggttaacccggggtaccccggttaccccgggttaccccgggg

SEQ ID NO: 156520 - DNA, 649 bp, Homo sapiens
  misc_feature: GYAE6OF02IMUYJ.37.55.E11.1.454.CMB.1.raw
  modified_base (292)..(292): a, c, t, g, unknown or other
  misc_feature (292)..(292): n is a, c, g, or t
  modified_base (300)..(300): a, c, t, g, unknown or other
  misc_feature (300)..(300): n is a, c, g, or t
  modified_base (304)..(304): a, c, t, g, unknown or other
  misc_feature (304)..(304): n is a, c, g, or t
  modified_base (350)..(350): a, c, t, g, unknown or other
  misc_feature (350)..(350): n is a, c, g, or t
  modified_base (388)..(388): a, c, t, g, unknown or other
  misc_feature (388)..(388): n is a, c, g, or t
  modified_base (429)..(429): a, c, t, g, unknown or other
  misc_feature (429)..(429): n is a, c, g, or t
  modified_base (513)..(513): a, c, t, g, unknown or other
  misc_feature (513)..(513): n is a, c, g, or t
tcagtagtgtagatcacgaccggtgctcgatttagcactcgcacgttgggtttgggctgaactggctttttcttgtggctattttaaaaggtgcccagtgtgaggtgcagctgtcggagtctgggggagcttggtacagcctggggggtccctgacactctcctgtgcagcctctaggatttcaccttttggcagtctttgccatcgagcgtcgggtcccgcctagggcctccgaaggggacggggctaggaacgtggggtctcagcctacgttagtagtaggtggtggaancacgttanacgntgaactccgtggaacggcccggttcgcctctccgagagacctaacncaacacaccgctgtctctgcacgtaacagcctagaganacggagaccgacgtacgtatattcgtgagacgaaggaggtngtcagtcacgtgtactaccctatactagtaatcggactccgtgggacaagtacgcgtaccggacctaccgggtcctacccgttnacccgtacccgtaccgaacccgaccggtacccgtacgtccgggtttaccccttccccgtccgggtacccgtacccccctttacccggaacccttacccggtaaccggtaccgtaaccccgttcggggtaaccgggg

SEQ ID NO: 156521 - DNA, 697 bp, Homo sapiens
  misc_feature: GYAE6OF02JM38T.37.55.E11.1.454.CMB.1.raw
  modified_base (329)..(329): a, c, t, g, unknown or other
  misc_feature (329)..(329): n is a, c, g, or t
  modified_base (350)..(350): a, c, t, g, unknown or other
  misc_feature (350)..(350): n is a, c, g, or t
  modified_base (387)..(387): a, c, t, g, unknown or other
  misc_feature (387)..(387): n is a, c, g, or t
tcagtagtgtagatcacgaccggtgctcgatttagcactcgcacgttgggtttgggggaagaggaagactgacggtcccccaggagttcaggtgctgggcacggtgggcatgtgtgagttttgtcacaagatttgggctcaactctcctgtgcagcctctggattcacctttggccagtctttcgccatgagcgtggggtcccgccaggctccgaaggggagggctggaatgggtctcagcctagttaggtaagttgtgggtggaagcacgtactacgcctgacctccggtagaacgggtccggtcgccctctccgagacgaacaaccncaaaccactcgctcggtctcngacaaccttaacgcgcctagacgacggacgacggacncggtccgtaatacgtactggtcgacggaaggtaggtactagcgtcgtacgtccgtcggtacctacccgtaccttagtacgtagttacggacgttcggacgggtacaaaacggtacgtccgggtaccgtccaaccggttccacccgttacgaccgtcccgtaacccaacccggtaacggaccccgtagttcccgtcccgttacccccgtcggaccccgttaaccccgtacccttaacccgaacggacccgtaacccttccccggtacgggttccggggaaccctaacccggaccggtaccccggtccccgg

SEQ ID NO: 156522 - DNA, 770 bp, Homo sapiens
  misc_feature: GYAE6OF02HS35G.37.55.E11.1.454.CMB.1.raw
  modified_base (206)..(206): a, c, t, g, unknown or other
  misc_feature (206)..(206): n is a, c, g, or t
tcagtagtgtagatcacgaccggtgctcgatttagcactcgcacgttgggtttgggggaagtagggaagactgacggtcccccaggagttcaggtgctgggcacggtgggcatggtcgtgagttttgtcacaaggatttgggctcaactctcctgtgcagcctctggattcaccgtttggcagtctttgccatgagctcgggtccnccgaggcctaccgaggggaagggtcttagggaaactggggtacctacgagcctaagtttacggtagttaggttcgggtagaaagaccgtaacgtacgtaacgtctagtacttacggtaggacgggtccgttcgccctcgtaccgagacgacaacctaccaacgaacacgctgtctcacgacctaacttaacgacgtccgtagaacgacgacggaaggaaccgacggacctaagtaatttacgttaacgtcggtaaggaacggtaaacgggtaagggttacctaggaccgtaacgtcgtaccgttacgtaaccgtaccctaacttaaccgttaattaacggtacggtaccgttacggtacggggtaactaaacggtaacgtaccggaccggttacgtaacccgttaccgtacccgtccgaccgtaccctaacccgaaccgtaaccggacccgtacggttcccggttacccgttccccggtacggacccttacccctaccgtaacccgtaacggaccgaccgtacccggttacggtaccgggtaaccctacggtacggtccccggg

SEQ ID NO: 156523 - DNA, 560 bp, Homo sapiens
  misc_feature: GYAE6OF02HFE7Z.37.55.E11.1.454.CMB.1.raw
  modified_base (329)..(329): a, c, t, g, unknown or other
  misc_feature (329)..(329): n is a, c, g, or t
  modified_base (471)..(471): a, c, t, g, unknown or other
  misc_feature (471)..(471): n is a, c, g, or t
tcagtagtgtagatcacgaccggtgctcgatttagcactcgcacgttgggtttggggggaagaggaagactgacggtccccccaggagttcaggtgctgggcacggtgggcatgtgtgagttttgtcacaagatttgggctcaactctcctgtgcagcctctggattcacctttggcagctttgccatgagctgggtccgccaggctccaggggaagggctggaatgggtctcagccattagtagtagtggtggaagcacgtactacgctgactccgtgaaggggccgttcgccctctccagagacaactccaacaacacgctgtctcngcaacttaacagtcctagagagacgaggacaccggccgtatattactgtcgacggaagggaggtctagcagtcgcgtgtactccactactatagtcggacgtcgtgggacgaagagtcgcgtcgaccgtcgtctcacgtccnccaccgaacggccacgtccgtccttccccgtcggcctcccctcctaccaacgcgacaccgtcggtcggggaccacgcggccggtcccgg

SEQ ID NO: 156524 - DNA, 830 bp, Homo sapiens
  misc_feature: GYAE6OF02FFY7J.37.55.E11.1.454.CMB.1.raw
  modified_base (208)..(208): a, c, t, g, unknown or other
  misc_feature (208)..(208): n is a, c, g, or t
  modified_base (527)..(527): a, c, t, g, unknown or other
  misc_feature (527)..(527): n is a, c, g, or t
tcagtagtgtagatcacgaccggtgctcgatttagcactcgcacgttgggtttgggggaagaggaagactgacggtcccccaggagttcaggtgctgggcacggtgggcatggtgtgagtttttgtcacaagatttgggcttcaactctcctgtgcacgccttctggtattcacctttggctagtctttcgccatgagcgtgggtccnccgaggctccggaggggagggctgggaacgttgggtactcgacgtcctaagttagttaggttaaggtgggttacgggaaacgtccgtaaccggttacctacggtcgtacggtaacccgttccgggtagggtaaccgggggtccccggtttaccggtcccccttaccgttacccggaaaggaccggtaaaccctaaacccgttaccccgaaaaaccgtaaccgtaccgtacgttacggttccttacgtacgaaaccgttaaaccttaaccgcggtcctaggacggacgacgtacggacgaccggtctaattacgttacgngtacgaggaaacgggtcggtacaggcgtagtcgtcgttacgtaccctaccgtatacttagttacgtacggacgttcgggaacggaacgtaacggtacgtccggtacggtaccgttaccgttccgtaccgttaccgaccgttcccgtaacccggaccgtaaaccggtcccgttaccggttcccgttacccgttccccggacgtcccccgttaaccccgttacccgtaccgaacccggtaccgtacccggtaacccggttccgggtaaccggggaccacccgggtaccggtccccggtacccggg

SEQ ID NO: 156525 - DNA, 839 bp, Homo sapiens
  misc_feature: GYAE6OF02HKNJD.37.55.E11.1.454.CMB.1.raw
  modified_base (122)..(122): a, c, t, g, unknown or other
  misc_feature (122)..(122): n is a, c, g, or t
  modified_base (174)..(174): a, c, t, g, unknown or other
  misc_feature (174)..(174): n is a, c, g, or t
  modified_base (537)..(537): a, c, t, g, unknown or other
  misc_feature (537)..(537): n is a, c, g, or t
tcagtagtgtagatcacgaccggtgctcgatttagcactcgcacgtttggggtttggggcttgaactggcttttcttgtggctattttaaaaggtgtccagtgtagaggtgcagctgtcggngtctgggggagcttggtacagccgtggggggtccctggaccactctcctgtncagcctcgtggattcaccttggcgagctttcgccagtgagtcgtcggtccgacgaggcttaccgaagggagggtccgtaggaagttcgggtactcgacggtcctagttacgtaggtagtacgggttaggaacgtaccgtaccgttaaccgtaacggccgttaacggacgttacccggtagggaaacggggtttccccggttcgaccccttcgttaaccgacggaccgtaaccgaaccttacccggaaacctaaaccggaccggttcgtacggttcccttacggtacgtaacctaacgtttaaccgcggtacctaggaacgacggtaacgacgaaacggtccgtaaccgtactacgtttaccgngggttaccggaaacggtacgggtaacggtacgtaacgcggtaaggtccgtacgttacggtaaccctaccccgtaaagttaccgtaagttacgtacgggttaccgttaccggtaagggaaccggtaaagtaccggtaccggttaaccggtcgtacccggttacccgtacgttcccggaacgttccccggtaccgtaaccggacccgtaccgttacggtacccggttcccgtttaacccggtcggaccccttacccgtcccgtaacggacccggtaccggttacccgtaccgtacccggtcggg

SEQ ID NO: 156526 - DNA, 819 bp, Homo sapiens
  misc_feature: GYAE6OF02GA0LI.37.55.E11.1.454.CMB.1.raw
  modified_base (313)..(313): a, c, t, g, unknown or other
  misc_feature (313)..(313): n is a, c, g, or t
tcagtagtgtagatcacgaccggtgctcgatttagcactcgcacgttgggtttggggggaagaggaagactgacggtccccccaggagttcaggtgctgggcacggtgggcatgtgtgagttttgtcacaagatttgggctcaactctcctgtgcagcctctggattccacctttggcagtctttgccatgagctgggtccgccaggctccgagggagggtctggaagtgggtctcgacgcctagttacgtagtagtggtaggaagcgtacgtactacgctgactccggtaggaacgggtccgttccgccctntccgagacgaccaactccaacaacacgtctagtctcgtcgactaacttaacgcgtacctagaggacgtacggaggaccgacggtaccgttaatacgtttacgtggtacgaaccgggtaaagggtacggttacgacggacgtacggtaccggtcccgttaacgggtacccctaccccgtaacgttaacgttaacgttaaggttaccgggtaaccggtttcgggtaaacggggtaacgtaaaacgggtaccggttcccggttaccggttacccgtaacccgtttcccgtacccgtaccgtacccggttacccctaacccggaaacccgggtaaccggtacccccgttaacggttcccccgggtttaccccgttaccccccggcggttacccccgttaacccccgttaccccgtaacccggtaaacgtacccccggtcccgttaaccccgggtttggggtaccccggggtaacacccggggtacccgggtacccccggttccccggggg

SEQ ID NO: 156527 - DNA, 246 bp, Homo sapiens
  misc_feature: GYAE6OF02GD9LJ.37.55.E11.1.454.CMB.1.raw
  modified_base (177)..(180): a, c, t, g, unknown or other
  misc_feature (177)..(180): n is a, c, g, or t
  modified_base (182)..(183): a, c, t, g, unknown or other
  misc_feature (182)..(183): n is a, c, g, or t
  modified_base (185)..(246): a, c, t, g, unknown or other
  misc_feature (185)..(246): n is a, c, g, or t
tcagtagtgtagatcacgaccggtgctcgattttagcactcgcacgttgggggtttgggggaagaggaagactgacggtccccccaggagttccaggtgctgggtcacaggcggccctgggctgcctggtcaaggctacttccgatctacactactgacgcggctggcagcgcatgnnnngnngnnnnnnnnnnnnnnnnnnnnnnnnnnnnnnnnnnnnnnnnnnnnnnnnnnnnnnnnnnnnnn

SEQ ID NO: 156528 - DNA, 671 bp, Homo sapiens
  misc_feature: GYAE6OF02GJ486.37.55.E11.1.454.CMB.1.raw
  modified_base (333)..(333): a, c, t, g, unknown or other
  misc_feature (333)..(333): n is a, c, g, or t
  modified_base (341)..(341): a, c, t, g, unknown or other
  misc_feature (341)..(341): n is a, c, g, or t
  modified_base (348)..(348): a, c, t, g, unknown or other
  misc_feature (348)..(348): n is a, c, g, or t
  modified_base (359)..(359): a, c, t, g, unknown or other
  misc_feature (359)..(359): n is a, c, g, or t
  modified_base (377)..(377): a, c, t, g, unknown or other
  misc_feature (377)..(377): n is a, c, g, or t
  modified_base (421)..(421): a, c, t, g, unknown or other
  misc_feature (421)..(421): n is a, c, g, or t
tcagtagtgtagatcacgaccggtgctcgatttagcactcgcacgttgggtttggggggaagaggaagactgacggtcccccaggagttcaggtgcgtgggcacggtgggcatgtgtgagttttgtcacaagatttgggctcaactctcctgtgcagcctctggattcactttggcagtctttgcctatgagtcgtggtccgcaggctcgagggagggctaggaatgggtctacgagctaagttagtagtaggtggtaggaacgtcaacgtactacgcttagactcggtagaacgggtccgttccacctctaccgagacgacaacgtccaaanaacaccgntcgctcngacaacttacngcctgacgacgagagacncggtactataatcgtgtacgacggaaggtacggtcagcgtagtnacgtgtaacctccattactatacggtaccgtacgtacggtaggggaactaaaggtcgtacggtcccggtaactacccggtcctaccgtaccgtacgtcccgttacccgaaaccggtaacggtaccctaacggttacccgttccccgttaccccggtaggaccccgtaccccgttaccgtacccgaacgtaccggaccctaccggttccggggtacgggaccctaacggtaccgggttacccggacccggg

SEQ ID NO: 156529 - DNA, 737 bp, Homo sapiens
  misc_feature: GYAE6OF02IJCKI.37.55.E11.1.454.CMB.1.raw
tcagtagtgtagatcacgaccggtgctcgatttagcactcgcacgttgggtttggggggaagaggaagactgacggtcccccaggagttcaggtgctgggcacggtgggcatgtgtgtagtttttgtcacaagatttgggctcaactctcctgtgcagcctctggattcctacctttggcagtctttgtcatgagcgtgggtccgccaggctccgaggggaacgggctggaatgggtctcgagctaagttaggtagtaggtggtaggaagcgaacgtacgaacgcgtagacctcggaggacgggtccgttcgccctctaccgagacgaccaacctacaaaccaaccgacgtctgtctcgtacgtaccaaacttaacacgtaccgtaggacgaaggaaccggaaggtaaccgaccgggtaactttaaacgttaacgttacggtcgtaaggaacggtaaggggtaacggttacgtacgaccgtaggtaccgtacggtaccggttacctaccctaacgttaactagttacgtacggtacggtacggaggggtaacgtaaacggtaacggtcgtaccggtacctacccgttcgtccgtacgaccgcctaccgaaccgtaaccggcccgtaccgttccggttccccgttcccgtccggtaccctcccctacccgtaaccgaaccgtaccgacccgttccggtccgggtccgggaccgtaaccggcgggtacccggtcccggg

SEQ ID NO: 156530 - DNA, 738 bp, Homo sapiens
  misc_feature: GYAE6OF02F8YGQ.37.55.E11.1.454.CMB.1.raw
  modified_base (201)..(201): a, c, t, g, unknown or other
  misc_feature (201)..(201): n is a, c, g, or t
  modified_base (340)..(340): a, c, t, g, unknown or other
  misc_feature (340)..(340): n is a, c, g, or t
tcagtagtgtagatcacgaccggtgctcgatttagcactcgcacgttgggtttggggggaagaggaagactgacggtccccccaggagttcaggtgctgggcacggtgggcatgtgtgagttttgtcacaagatttgggctcaactctcctgtgcagcctctggattcacttttggcagtctttgccatgagctgggtccnccaggctccgaggggagggctggaactgggtctcagccaagttagtagtagtgggtaggaagcaacgtacctagctgacgtccgtaggaacgggtccggttccgcccttcgtccgagacgactaacctccaaacaaccncgctcgtcctctagaccaaacgttacacgtacctggacgacgaccgaaggacgtaccggtacgttaataacgtttcgtagtggtaaccggaaagggtaaggtcctaaggtccgtaggtaccgccgttacggtaaccctacccgtaacgttaaccgtagttaacgtacggcgtacgggtaacgggactaaagggtaccgtacgggtaccgtaccgtacccgttccgtaccctcgaacccgttcccaacccggtaaccaccgggtacccgtcgttccccgggttcccgttaccccgtccggtaccccgtaccccgttacccgtaacccgaacggtaccgtacccccgtccggttacgggtacccggggtacaaccccgggttaccgtcccggtacccggg

SEQ ID NO: 156531 - DNA, 808 bp, Homo sapiens
  misc_feature: GYAE6OF02IY2QG.37.55.E11.1.454.CMB.1.raw
tcagtagtgtagatcacgaccggtgctcgatttagcactcgcacgttgggtttgggggaagaggaagactgaccggtccccccaggagttcaggtgctgggcacggtgggcatgtgtgagttttgtcacaagatttgggctcaactctcctgtgcagcctcgtaggattcacctttggcagctttgccatgagctgggtcccgcaggctccgaggggacgggctcggaatcgggtctcgatcctagttagtagtagtggtacggaagtctacgtacgtacgctagaccgttccgtaggacggggtacccggttccgtccctcgtcccaagacgaaccaccctaccgaaccaacgcgtccgtggttctctacgaacctaactttaacgaccgtacccgtaggaaccgaggtaaaccgacggtaaacccggtaccggtaaccgggtaaatttacgttaacgttcggtacggaacggtaaacgggtaacgggtcctaggtacgtacggtacgtaccgtcgtaccgtacctacgtaactagtacgtacgtaaccggtcgtacggggtaactaacgggtacgtaccggttaccggtacccggttacccggtctaccgttaccgaccggttacccaccgtaacccgtaacggtccccgtaaaccgttcccggtttaccccgttaccccggttaccggaccccgtttaacccccgtcccggttaaacccgtaaccggggtaccctaaccccgttaccggtacgggttacccggggaaccccgtaaccgggttacccggccccgggttacccgggg

SEQ ID NO: 156532 - DNA, 799 bp, Homo sapiens
  misc_feature: GYAE6OF02HXLBL.37.55.E11.1.454.CMB.1.raw
  modified_base (646)..(646): a, c, t, g, unknown or other
  misc_feature (646)..(646): n is a, c, g, or t
tcagtagtgtagatcacgaccggtgctcgatttagcactcgcacgttgggtttgggggaagaggaagactgaccggtcccccaggtagttcaggtgcgtgggcacggtgggcatgtgtgagttttgtcgacaagtatttgggctcaacctctcctgtgcacgccgtctaggattctaccgtttgctacgctttgccatgacgtcgtcgggtcccgaccgacggtaccgtaccgaacgggggaacggggtccgttagggtaacgttaggggttaccgttaccgaacggtacccgtaaagtttaagggttaaggttaacggttaggggttaggaaacgtacgaaccggttaaccgtaccgtaccgttccggaaccgttacccgggttaacgggaaccggggttaccccgggttacccgtaccccttacgttacccgaaagaaccgaccctaaaccgttaacccgaaacgaaccgacgtccttcttaccgtacgtccgtaacgtaacttaccgacgtcctacgaacggacgacgtacggaacgtacggactagttactacgtgacgacgtaaaggagctacgacgtgttacgacctacgttaccccacacgttatactagtcggtaccgtagtacggggaattaaacgngtcgtaccggtaccacgtacctcgtaccgtacctcgtacccgaaccgaccgaccgttaccggttccgtacccttcccgaccgtaccccgaaccctaccgaacgtacgaccttctaccggtacgggccggaacgtccgtaccgggccctacggg

SEQ ID NO: 156533 - DNA, 923 bp, Homo sapiens
  misc_feature: GYAE6OF02G3NFX.37.55.E11.1.454.CMB.1.raw
tcagtagtgtagatcacgaccggtgctcgatttagcactcgcacgttgggtttgggctgaactggctttttcttgtggctatttttaaaaggtgtccagtgtgaggtgcagctgtcggagtctgggggagcttggtacagccgtggggggtccctgactactctcctgtgcagcctcgtggtacttctaccgtttggcagtcgtttgcctagtggagcgttcgggtccgccgacggccgtaccggaagggggtaacggggtcgtagggaaggttcggggtacctcgagtccgtaagtttaggttaggtaggttagggtaggaacgcgtaccggttaacgtaccggcgttacgaccgttccgggtaaggtaaccggggtcccggtttacccggccccgtacgtacccggaggtaaccgaacccgtaaacctaaccccaaacgtaaaccgaccgtacgttacggttaccttaccgtacgtaaccttaaaccgttaaacgaccggtaccgtaaggtaaacggaaccggtaacgggaaccggtaaccggtaaccgggtaaccgtttaacgttaaccgtttacggtacgggtaaccggtaaacggggtaaaccggggtacggttaccgtaaggaccggttacggtcccggtaaccggttacgggttaaaccccttacccgtaacgttaacgttaggttaacgttacgggtacccgttagggtacgggaaacgtaaagggtcccgtttcggaacccggtccgttaccccgttacgtacccgttacgaccggtttaccctacccgggtaacggtaccggcccctttcggttccccgggtttccccgtaacccggttccgtaacccccggttacccctacggttaaccggaacccgttccgtaacccggttccggttacgggaaccccggg

SEQ ID NO: 156534 - DNA, 735 bp, Homo sapiens
  misc_feature: GYAE6OF02FQS7V.37.55.E11.1.454.CMB.1.raw
  modified_base (314)..(314): a, c, t, g, unknown or other
  misc_feature (314)..(314): n is a, c, g, or t
tcagtagtgtagatcacgaccggtgctcgatttagcactcgcacgttgggtttgggggaagaggaagactgacggtccccccaggagttcaggtgctgggcacggtgggcatgtgtgagttttgtcacaagatttgggctcaactctcctgtgcagcctctggattcctaccgttttggctagtctttgccagtgagcgtgggtcccgcaggctccgaggggagggctaggagttgggtctcgacgcctattagtagtaggtggtggaagctacgtactacgctgtacctacggtggaacgggtcccggttacnccccgtctccgaagacgaacacctaccaaaccaacgcgctcgtctctgacctaactaacgcgtacctgacacgaggacggacgacggcttaagtacgttacgtggtacgacggtaaaggacggtactaggacgtacgtgtccgttacggtaccctacctaaccgttacgtattacgacgggtaccgttacggtacgggtaacgaaagggtacctcgggttaccggtcctaacccggtttccgacccttaccgaccgttacccgaacccgaaccgacccggtacccgttaacggtccccgttacccgtttacccccgccggtacccccttaccccgttaccctaccggtaaacccggccgtaacccgaacccggttaccgggtacggggacctaacccgggaccggtacccgggtaccccgg

SEQ ID NO: 156535 - DNA, 943 bp, Homo sapiens
  misc_feature: GYAE6OF02HILOT.37.55.E11.1.454.CMB.1.raw
tcagtagtgtagatcacgaccggtgctcgatttagcactcgcacgttgggtttgggctgaactggctttttcttgtggctattttaaaaggtgtccagtgtgagtgcagctgtcggagtcgtgggggagcttgggtacagccgtggggggtccctgacactctcctgtgcagcctctggtactttcctaccgtttggctacgtcttttacgcctagtgacgcggttcgggtcccgaccgtacgggcctaccggagggggaaagggggtcctcgggtaaaggttcggggttcccgtacgttaacgggttaactttaaccggttaggttagggttacggttaaacgtacccgacgttaactaaccgtaccggtacaaaccggtaccgttaccggtccggtaaccgggggtcccggtttaccgtacccccggttaccttaccggaacgtaacggtaaccgttaaaaccgtttacccgaaaaggttaaaccggtttaacccgggtttacctttaaacggtttaccggtaaagggaaaaccgttaaggaaaccccgtaggtacccgtagggaaccgggaacccggtaaccgggtaacgggtaaccccgtacccggtacccctttagttaaccgtttacgttcgggtacgggaaccgtaaggtaccgtaacgttaccgggtaaacgggtacggtaacgggttagaaccggactaacggtacgaaccgttcgttaacggttacgtaaaccggtttacccggggacggggtaaccccaaacccgggtttaaccgtcccgggtaacccgttccgtacccttccgtacgcccgtacccacccggtaaccgaccggtcccctacggttccccgttcctacccccggctccccgttaccctccgaaccgacgtaccgaccgtacccggtacggtccggaccgccgttaacccggg

SEQ ID NO: 156536 - DNA, 211 bp, Homo sapiens
  misc_feature: GYAE6OF02H4GDR.37.55.E11.1.454.CMB.1.raw
  modified_base (171)..(171): a, c, t, g, unknown or other
  misc_feature (171)..(171): n is a, c, g, or t
  modified_base (176)..(211): a, c, t, g, unknown or other
  misc_feature (176)..(211): n is a, c, g, or t
tcagtagtgtagatcacgaccggtgctcgatttagcactcgcacgttgggtttgggtggaagaggaagactgacggtcccccaggagttcaggtgctgggcacagcggccctgggctgcctggtcaaggtactacttccatctacactactgagcggctggcaaggccganatagnnnnnnnnnnnnnnnnnnnnnnnnnnnnnnnnnnnn

SEQ ID NO: 156537 - DNA, 767 bp, Homo sapiens
  misc_feature: GYAE6OF02G86JM.37.55.E11.1.454.CMB.1.raw
  modified_base (201)..(201): a, c, t, g, unknown or other
  misc_feature (201)..(201): n is a, c, g, or t
  modified_base (234)..(234): a, c, t, g, unknown or other
  misc_feature (234)..(234): n is a, c, g, or t
  modified_base (261)..(261): a, c, t, g, unknown or other
  misc_feature (261)..(261): n is a, c, g, or t
  modified_base (301)..(301): a, c, t, g, unknown or other
  misc_feature (301)..(301): n is a, c, g, or t
  modified_base (318)..(318): a, c, t, g, unknown or other
  misc_feature (318)..(318): n is a, c, g, or t
tcagtagtgtagatcacgaccggtgctcgatttagcactcgcacgttgggtttgggggggaagaggaagactgacggtccccccaggagttcaggtgctgggcacggtgggcatgtgtgagttttgtcacaagatttgggctcaactctcctgtgcagcctctggattcacctttggcagctttgccatgagctgggtccnccaggctccagggaaggggctggaatgggtctnacgccattagtagtagtgggtaggaancacgtactacggctgaactccgtagaacgggtccggtacncccttctccaagcgaanaacctaccaaactaaccaacgcctcgtcctctcgactaaacgttaaccagcctagagacgacgaaggaacacggccgtaatacttacgtgtaggacggaaagggtaaggttcaaggtaccgtagtcgtacccgtacgggtaacctaccccgtaacttaacttaaatacggttacggtaaccggttcgggtacggggtaaaccgaaaagggtaacgtaccgggtaccgggtaacctacccggttaccttacccgtaccggacgtccccgtaaccctaaaccgggaaacccgggtaccccgtacggttaccgttacccccgtttaccccggtaccgggtacccctaacccccgttaccctaacccggtaaacggtacccggtaaccctaccccgggttaccggttaaccggggggccctaacccggacgggtcccccgggtacccccgggg

SEQ ID NO: 156538 - DNA, 720 bp, Homo sapiens
  misc_feature: GYAE6OF02G47F5.37.55.E11.1.454.CMB.1.raw
  modified_base (204)..(204): a, c, t, g, unknown or other
  misc_feature (204)..(204): n is a, c, g, or t
  modified_base (361)..(361): a, c, t, g, unknown or other
  misc_feature (361)..(361): n is a, c, g, or t
tcagtagtgtagatcacgaccggtgctcgatttagcactcgcacgttgggtttgggggggaagaggaagactgacggtccccccaggagttcaggtgctgggcacggtgggcatgtgtgagttttgtcacaagatttgggctcaactctcctgtgcagcctctggattcaccttttggcagtctttgccatgagcgtgggtccnccaggctccgagggaggggctggagtgggtctcagcctattagtagtagtggtaggaagcagttacacgctgactcggtaggaacgggtccggtcgccctcgtccagacgacaacctaccgaacaaccacgtctcgtcctctcgacctaacttaacncgcctagacgaacgacggaaggaccgacggtccgtaatacttacgtgtagacggtaagggaacggtcaggcaggtcgtcccgtacggtacctccctaacgttacttagtaagtcggtaccggtaggtacgggaacgtaagggtaacgtccggtaccggttacctacccggtcttaacccgtaccgaaccggttcccctaaccgtaaccccgggaaccggtcccctaacggttcccggttaacccccgttcccccggtcgtaacccccgtccccttaaccctacccggtaacgtccgtaccccttaaccgggtccgggtaacgggtaccccgagggaccccgggttccggtaccccgggg

SEQ ID NO: 156539 - DNA, 782 bp, Homo sapiens
  misc_feature: GYAE6OF02G5JC9.37.55.E11.1.454.CMB.1.raw
tcagtagtgtagatcacgaccggtgctcgatttagcactcgcacggttgggtttgggctgaactggcttttcttgtggctattttaaaaggtgtccagtgtgaggtgcagctgtcggatcctggggagcttggtacagcctggggggtccctgagctctcctgtgaagcctctgggacttccacctttgacctaagttgtcgcctatcgacctggtcccgccgtaggccgtccgaaggggacgggctggagtcgggtctacgagtttattagtggtacgtggtagtagaccacgagtactacggctagacctcggtagaagggtccgttcaactatcctaccgaggtacgacctaagttccaaacgacgtaccaacgtccgttagttaacgtttcaccggtaactacggttacgaacgtacggactagggaacgtacggacccggaaggaccctaaccgggtacttaacttacggttaatttcgttacggtacggtaaccgttaaaccttttccggttttaacggacgttttacggttactttaaccgttacccgttacttaccggtaaccgttccggtacggggttacccaaccgggtaccccgtggtaacccgttccggttcccgttaccgtacccgtacgtcccgttaacccgtaccgggaaccgtacccgaccgttcccggtcccttacccccggtcgtaccccgtaccccgttacctaccgaaaccgtcgtacccgtacgtccgggtcggacccgtacgacccggtcccggtcccgg

SEQ ID NO: 156540 - DNA, 867 bp, Homo sapiens
  misc_feature: GYAE6OF02JURNP.37.55.E11.1.454.CMB.1.raw
tcagtagtgtagatcacgaccggtgctcgatttagcactcgcacgttgggtttgggggaagaggaagactgacggtcccccaggagttcaggtgctggtcacggtgggcatgtgtgtagttttgtcacaagatttgggctcaactctcctgtgcagcctcgtggacttcaccgtttggccagtctttgccatgagtcgtgggccgaccaggctcgaaggggtaagggctaggaacgtgggtacctcgaggtcctaagtttaggtagttacggtgggtaacggaagtcctaacggttacgtaacggtcttaacggaacccttccgggtaggtaaaccgggggtccccggtttccgccccgttacggttaaccgtaaggaaacgtacccgaacctaacccgaaaacgtaacccaacgggttccctttcggttacctacgttaccgaacccttaaaccttaaacggccggtacctaggaacggagacccggtaacgggacaccgggtctaagtttccgtaagtcggtaacgaccgggtaaaaggtccggtctaaggcgtacgtacggtccgttacggttaccctaccgttaacttacgttacgttacggtaaccgggttaccgtacgggttaacgggtaaccgtaaacggtacgttaccgggccggttaccgtaccggttaccctacccgtaccgtaccgtaccccgtaacccgtaacccgtaaccgggcccttaaaccgggttaccccgttacccgtttaccccgtcgggtacccccgtacccggttaaccgtaacccgaacggccctttaacccgtaccggttaccgggccgggtacccgtaacggtacccggtacccggtccccggg

SEQ ID NO: 156541 - DNA, 238 bp, Homo sapiens
  misc_feature: GYAE6OF01EHUS0.44.33.C11.1.454.CMB.1.raw
  modified_base (223)..(238): a, c, t, g, unknown or other
  misc_feature (223)..(238): n is a, c, g, or t
tcagacagtatatacacgaccggtgctcgatttagagtgagctcgttgggttgggaaggtagtccttgaccacggtcgccgtctcctcagcctccaccaagggcccatcggtcttcccctggcaccctcctccaagagcacctctggggcacagcggccctgggctgcctggtcaaggactacttccacgtctactgctgagcgggctggcaaggcgcatagnnnnnnnnnnnnnnnn

SEQ ID NO: 156542 - DNA, 130 bp, Homo sapiens
  misc_feature: GYAE6OF01EBRUW.44.33.C11.1.454.CMB.1.raw
  modified_base (130)..(130): a, c, t, g, unknown or other
  misc_feature (130)..(130): n is a, c, g, or t
tcagacagtatatacacgaccggtgctcgatttagagtgagctcgttgggtttgggcacagcggccctgggctgcctggtcaaggactacttcctatatactgtctgagcgggctggcaaggcgcatagn

SEQ ID NO: 156543 - DNA, 138 bp, Homo sapiens
  misc_feature: GYAE6OF01AZTRA.44.33.C11.1.454.CMB.1.raw
  modified_base (130)..(138): a, c, t, g, unknown or other
  misc_feature (130)..(138): n is a, c, g, or t
tcagacagtatatacacgaccggtgctcgatttagagtgagctcgttgggtttgggcacagcggccctgggctgcctggtcaaggactacttcctatatactgtctgagcgggctggcaaggcgcatagnnnnnnnnn

SEQ ID NO: 156544 - DNA, 243 bp, Homo sapiens
  misc_feature: GYAE6OF01ELEF3.44.33.C11.1.454.CMB.1.raw
  modified_base (224)..(243): a, c, t, g, unknown or other
  misc_feature (224)..(243): n is a, c, g, or t
tcagacagtatatacacgaccggtgctcgatttagagtgagctcgttgggtttggggaagtagtccttgaccacggtcgccgtctcctcagcctccaccaagggcccatcggtcttcccctggcaccctcctccaagagcacctctggggcacagcggccctgggctgcctggtcaaggactacttcctatatactgtctgagcgggctggcaaggcgcatagnnnnnnnnnnnnnnnnnnnn

SEQ ID NO: 156545 - DNA, 156 bp, Homo sapiens
  misc_feature: GYAE6OF01BO1HJ.44.33.C11.1.454.CMB.1.raw
  modified_base (133)..(156): a, c, t, g, unknown or other
  misc_feature (133)..(156): n is a, c, g, or t
tcagacagtatatacacgaccggtgctcgatttagagtgagctcgttgggtttgggcgacagcggccctgggctgcctggtcaaggactacttcctattatactgtctgagcgggctggcaaggcgcagtagnnnnnnnnnnnnnnnnnnnnnnnn

SEQ ID NO: 156546 - DNA, 338 bp, Homo sapiens
  misc_feature: GYAE6OF01DK52M.44.33.C11.1.454.CMB.1.raw
  modified_base (191)..(191): a, c, t, g, unknown or other
  misc_feature (191)..(191): n is a, c, g, or t
  modified_base (224)..(224): a, c, t, g, unknown or other
  misc_feature (224)..(224): n is a, c, g, or t
  modified_base (316)..(338): a, c, t, g, unknown or other
  misc_feature (316)..(338): n is a, c, g, or t
tcagacagtatatacacgaccggtgctcgatttagagtgagctcgttgggtttgggggggtcacaagaggcagcgctctcgggacgtctccaccatggcctgggctctgctgctcctcactctcctcacccaggacaccagggtcctgggcccagtctgccctgactcagcctgcctccgtgtctgggtcnctggacagtcggtcaccatctcctgcactgganccagcggtcagcccaaggccaaccccatgtcactcctcgttccccgccctcctctatactactgtcctgagcgggctggcaaggcgcatagnnnnnnnnnnnnnnnnnnnnnnn

SEQ ID NO: 156547 - DNA, 496 bp, Homo sapiens
  misc_feature: GYAE6OF01ETUWM.44.33.C11.1.454.CMB.1.raw
  modified_base (439)..(439): a, c, t, g, unknown or other
  misc_feature (439)..(439): n is a, c, g, or t
  modified_base (461)..(461): a, c, t, g, unknown or other
  misc_feature (461)..(461): n is a, c, g, or t
tcagacagtatatacacgaccggtgctcgatttagagtgagctcgttgggtttgggggaagctcagcttcagctgtgggtagagaagacaggactcaggacgatctccagcatggccagcttccctctcctcctcaccctcctcactcactgtgcagggtcctgggcccagtctgtgatgtctcagccaccctcagcgtctgggacccccggcaggggtcaccatctcttgttctggaaggagtccaatatcggatcttatcctgtcaactggtatcgggactccaggcacggcccccgactcctatctatgctactaatcagcgccctcagggtccctgcccgattctctggctccaagtctggcactacaggctacctgccatcctgatctccagtctgagatgagctgattactactgtgcagcagtgggatgacngccggacggcgtgggtgtcggnggaggacagtcgaccgtctaggcacgcccaggtcc

SEQ ID NO: 156548 - DNA, 126 bp, Homo sapiens
  misc_feature: GYAE6OF01B167W.44.33.C11.1.454.CMB.1.raw
  modified_base (126)..(126): a, c, t, g, unknown or other
  misc_feature (126)..(126): n is a, c, g, or t
tcagacagtatatacacgaccggtgctcgatttagagtgagctcgttgggttggcacagcggccctggctgcctggtcaaggactacttccacgtctactgctgagcggctggcaaggcgcatagn

SEQ ID NO: 156549 - DNA, 130 bp, Homo sapiens; identical to SEQ ID NO: 156542
  misc_feature: GYAE6OF01EV6B0.44.33.C11.1.454.CMB.1.raw
  modified_base (130)..(130): a, c, t, g, unknown or other
  misc_feature (130)..(130): n is a, c, g, or t

SEQ ID NO: 156550 - DNA, 130 bp, Homo sapiens
  misc_feature: GYAE6OF01DQ13Z.44.33.C11.1.454.CMB.1.raw
  modified_base (130)..(130): a, c, t, g, unknown or other
  misc_feature (130)..(130): n is a, c, g, or t
tcagacagtatatacacgaccggtgctcgatttagagtgagctcgttgggtttgggcacagcggccctgggctgcctggtcaaggactacttcctcgatcgcgtctgagcgggctggcaaggcgcatagn

SEQ ID NO: 156551 - DNA, 157 bp, Homo sapiens
  misc_feature: GYAE6OF01DEQMS.44.33.C11.1.454.CMB.1.raw
  modified_base (130)..(157): a, c, t, g, unknown or other
  misc_feature (130)..(157): n is a, c, g, or t
tcagacagtatatacacgaccggtgctcgatttagagtgagctcgttgggttggggcacagcggccctgggctgcctggtcaaggactacttcctatatactgtctgagcgggctggcaaggcgcatagnnnnnnnnnnnnnnnnnnnnnnnnnnnn

SEQ ID NO: 156552 - DNA, 301 bp, Homo sapiens
  misc_feature: GYAE6OF01DUAI0.44.33.C11.1.454.CMB.1.raw
  modified_base (299)..(301): a, c, t, g, unknown or other
  misc_feature (299)..(301): n is a, c, g, or t
tcagacagtatatacacgaccggtgctcgatttagagtgagctcgttgggtttgggggtgtggtggtctccactcccgccttgacggggctgctatctgcctccctggccatcactgggctccaggctgaagatgagggtgattattactgccagtcctatgacagcagcctcagtggttgggtgttcggcggagggaccaagctgaccgtcctgggtcagcccaaggctgccccctcggtcactctcgttcccgccctcctctatatactgtctgagcgggctggcaaggcgcatagnnn

SEQ ID NO: 156553 - DNA, 578 bp, Homo sapiens
  misc_feature: GYAE6OF01D5VI1.44.33.C11.1.454.CMB.1.raw
  modified_base (315)..(315): a, c, t, g, unknown or other
  misc_feature (315)..(315): n is a, c, g, or t
  modified_base (437)..(437): a, c, t, g, unknown or other
  misc_feature (437)..(437): n is a, c, g, or t
  modified_base (526)..(526): a, c, t, g, unknown or other
  misc_feature (526)..(526): n is a, c, g, or t
tcagacagtatatacacgaccggtgctcgatttagagtgagctcgttgggtttgggggggaagctcagcttcagctgtgggtagagaagacaggactcaggacgatctccagcatggccagcttccctctcctcctcaccctcctcactcactgtgcagggtcctgggcccagtctgtgatgtctcagccaccctcagcgtctcgggacccccggcagggggtcacccatctcttgttctggaaggaagtccaatatcggatctatcctgtcaactgtatcgggactcccaggccaccggcccccgactccttanctatgctactaatcagccgcctcgacgggtccctgcccgtattctctggctccaagtctggcactacaggctacggtcgaccctagttccctagaccttcgtacctagttcctaggaacgtntagggaagtctaggtactttacacttggtctcgacgctaaggtcggattcggaactacggaccggaacgccggtaggggtcgttcgggnggtacgggacctaaggtcgacccgttcgacggtcacggtcccgaaggtcccg

SEQ ID NO: 156554 - DNA, 184 bp, Homo sapiens
  misc_feature: GYAE6OF01A0BH4.44.33.C11.1.454.CMB.1.raw
  modified_base (137)..(184): a, c, t, g, unknown or other
  misc_feature (137)..(184): n is a, c, g, or t
tcagacagtatatacacgaccggtgctcgatttagagtgagctcgttgggtttggggcacagccggccctgggctgcctggtcaaggactacttcctatagtacctgtctggagcgggctggccaaggcgcatagcnnnnnnnnnnnnnnnnnnnnnnnnnnnnnnnnnnnnnnnnnnnnnnnn

SEQ ID NO: 156555 - DNA, 130 bp, Homo sapiens
  misc_feature: GYAE6OF01B41NL.44.33.C11.1.454.CMB.1.raw
  modified_base (130)..(130): a, c, t, g, unknown or other
  misc_feature (130)..(130): n is a, c, g, or t
tcagacagtatatacacgaccggtgctcgatttagagtgagctcgttgggtttgggcacagcggccctgggctgcctggtcaaggactacttccacgtctactgctgagcgggctggcaaggcgcatagn

SEQ ID NO: 156556 - DNA, 580 bp, Homo sapiens
  misc_feature: GYAE6OF01B73GD.44.33.C11.1.454.CMB.1.raw
  modified_base (208)..(208): a, c, t, g, unknown or other
  misc_feature (208)..(208): n is a, c, g, or t
  modified_base (403)..(403): a, c, t, g, unknown or other
  misc_feature (403)..(403): n is a, c, g, or t
tcagacagtatatacacgaccggtgctcgatttagagtgagctcgttgggtttggggagcttcagctgtgggtagagaagacaggactcaggacgatctccagcatggccagcttccctctcctcctcaccctcctcactcactgtgcagggtcctgggcccagtctgtgatgtctcagccaccctcagcgtcgtgggacccccgggnagggggtcaccatctcttgttctggaagagtccaatatcggatcttatcctgtcaactggtatcgggactccaggccacggcccccgatcctatctatgctactaatcagccggccctcgacggggtccctgcccgtattctcgtcggctccaagttctggcactacaggcctactggcctagtccttgacttcncctagtctgacgatggagtctgtactttacacgtgtcgcagctagtgggatacgacgacggtaccggaacggtcggttgggtacggttcggggacgggacgggtaaccgtaaggttccggtaccgttaccggtaggtaccgacggtacccgaaggccgttcccgccccccgttacgg

SEQ ID NO: 156557 - DNA, 535 bp, Homo sapiens
  misc_feature: GYAE6OF01D0UB2.44.33.C11.1.454.CMB.1.raw
  modified_base (415)..(415): a, c, t, g, unknown or other
  misc_feature (415)..(415): n is a, c, g, or t
tcagacagtatatacacgaccggtgctcgatttagagtgagctcgttgggtttggggggggaagctcagcttcagctgtgggtagagaagacaggactcaggacgatctccagcatggccagcttccctctcctcctcaccctcctcactcactgtgcagggtcctgggcccagtctgtgatgtctcagccaccctcagcgtctgggacccccggcagggggtcaccatctcttgttctggaagagtccaatatcggatcttatcctgtcaactggtatcgggactccagcacggcccccgactcctatctatgctactaatcagcgccctcacgggtccctgcccgattctctggctccaagtctggcactacaggcctaccgtcggcctatccttgacttctcagtctggagntgagctgattactatgtgcagcagtgggatgacgagacccgggaaggcgtgggtggttcggggacgggtagggacccgaaggttcgacccgtccgtacggtcacgccccgaaggtccccg

SEQ ID NO: 156558 - DNA, 130 bp, Homo sapiens; identical to SEQ ID NO: 156555
  misc_feature: GYAE6OF01ADX3C.44.33.C11.1.454.CMB.1.raw
  modified_base (130)..(130): a, c, t, g, unknown or other
  misc_feature (130)..(130): n is a, c, g, or t

SEQ ID NO: 156559 - DNA, 145 bp, Homo sapiens
  misc_feature: GYAE6OF01EASZF.44.33.C11.1.454.CMB.1.raw
  modified_base (126)..(145): a, c, t, g, unknown or other
  misc_feature (126)..(145): n is a, c, g, or t
tcagacagtatatacacgaccggtgctcgatttagagtgagctcgttgggttggcacagcggcctgggctgcctggtcaaggactacttcctatatactgtctgagcggctggcaaggcgcatagnnnnnnnnnnnnnnnnnnnn

SEQ ID NO: 156560 - DNA, 533 bp, Homo sapiens
  misc_feature: GYAE6OF01A9GG0.44.33.C11.1.454.CMB.1.raw
  modified_base (420)..(420): a, c, t, g, unknown or other
  misc_feature (420)..(420): n is a, c, g, or t
tcagacagtatatacacgaccggtgctcgatttagagtgagctcgttgggtttggggggggaagctcagcttcagctgtgggtagagaagacaggactcaggacgatctccagcatggccagcttccctctcctcctcaccctcctcactcactgtgcagggtcctgggcccagtctgtgatgtctcagccaccctcagcgtctgggacccccgggcagggggtcaccatctcttgttctggaaggaagtccaatatcggatcttatcctgtcaactggtatcggggactcccaggccaccggcccccgactccttatctatgctactaatcagcggccctcacgggtccctgcccgattctctggctccaagtctggcactacaggctacctggccattcctgactctccagtctgagntggagctgattactactgtgcagctagtgggatggacaggcccgggaaggcgtgggttcggtcgggcgggaggccaaggttgacccgttcgaggtccacgcccgaaggtcccg

SEQ ID NO: 156561 - DNA, 543 bp, Homo sapiens
  misc_feature: GYAE6OF01APSFK.44.33.C11.1.454.CMB.1.raw
  modified_base (349)..(349): a, c, t, g, unknown or other
  misc_feature (349)..(349): n is a, c, g, or t
tcagacagtatatacacgaccggtgctcgatttagagtgagctcgttgggtttggggggggaagctcagcttcagctgtgggtagagaagacaggactcaggacgatctccagcatggccagcttcccctctcctcctcaccctcctcactcactgtgcagggtcctgggcccagtctgtgatgtctcagccaccctcagcgtctgggacccccgggcagggggtcaccatctcttgttctggaggagtccaatatcggatcttatcctgtcaactggtatcggggactcccaggcacggccccccgactcctatctatgctactaatcagcggccctcgacgggtccngcccgattctctggctccaagtctggcactacaggctacctggccatccttgactctccagtctgaggatgaggctgacttactacttgtgcagcgagtgggatcgacgagccgggaacgcgtaggggtcgttcgggcgggacgggccgaagttcggacccgttccgtacggttaccacggcccgaaggtcccg

SEQ ID NO: 156562 - DNA, 609 bp, Homo sapiens
  misc_feature: GYAE6OF01C2OBJ.44.33.C11.1.454.CMB.1.raw
tcagacagtatatacacgaccggtgctcgatttagagtgagctcgttgggtttggggagcttcagctgtgggtagagaagacaggactcaggacgatctccagcatggccagcttccctctcctcctcaccctcctcactcactgtgcagggtcctgggcccagtctgtgatgtctcagccaccctcagcgtctcgggacccccgggcgacgggggtcaccatctcttgttctggaaggagtccaatatcggatcttatcctgtcaactggtatcggggactcccgaggccaccggccccccgactccttatctatgacctactaatcacgccggccctcgacggggtcccctcgcccgtatttcgtcgtcggcctccgaagttctcggcctacgtacgacggcctaccgtcggcctactccttgacttcctccgagtctagaggtatggagtctagtattactacgttgtcgcagcagtagggatgacgacggaccgggacggtcgttgggggttcgttccggggagggaacggggaccaaggtccgtcggaccccggttcggtacgggtccaacggacccgaacgggcccgttccggtaccccccgg

SEQ ID NO: 156563 - DNA, 591 bp, Homo sapiens
  misc_feature: GYAE6OF01CJKX9.44.33.C11.1.454.CMB.1.raw
tcagacagtatatacacgaccggtgctcgatttagagtgagctcgttgggtttggggagcttcagctgtgggtagagaagacaggactcaggacgatctccagcatggccagcttccctctcctcctcaccctcctcactcactgtgcagggtcctgggcccagtctgtgatgtctcagcccaccctcagcgtcgtcgggacccccgggcagggggtcaccatctcttgttctggaaggaagtccaatatcggatcttatcctgtcaactggtagtcggggactcccgaggccaccggccccccgactccttatctatcgctactaatcacgccgccctcgacggggtccctcgcccgtattctcgtggctccaagtctggcactacacggctaccgtcggcctatccttgacttccgtccagtctagaggtatggaggtctgtaactttactactgtgcagcagtgggatgacacggaccggacggcgttggggtcgttaccggggacgggaacgggaccgtaaggttcggacccggttacccgtagggtaccacggaccccaagggccctccggtccccccgttccggg

SEQ ID NO: 156564 - DNA, 560 bp, Homo sapiens
  misc_feature: GYAE6OF01BTA20.44.33.C11.1.454.CMB.1.raw
  modified_base (410)..(410): a, c, t, g, unknown or other
  misc_feature (410)..(410): n is a, c, g, or t
  modified_base (453)..(453): a, c, t, g, unknown or other
  misc_feature (453)..(453): n is a, c, g, or t
tcagacagtatatacacgaccggtgctcgatttagagtgagctcgttgggtttggggagcttcagctgtgggtagagaagacaggactcaggacgatctccagcatggccagcttccctcgcctcctcaccctcctcactcactgtgcagggtcctgggcccagtctgtgatgtctcagccaccctcagcgtctgggacccccgggcagggggtcaccatctcttgttctggaaggagtccaatatcggatcttatcctgtcaactggtatcggggactcccaggcaccggccccccgactccttatctatcgctactaatcagcggccctcgaggggtcccctgcccgattctctggctccgaagtctggcactacaggctacctggcctatcctgactctccagttcngaggatgaggctgtacttactactgtgcagcagtgggatgacnggaccggaacggcgtggggtcgttccgggacggtacgggtaccgtaaggttcggacccggtaccgtaggtaccgacggcccgaaggcctccggtcccccgtaccggg

SEQ ID NO: 156565 - DNA, 594 bp, Homo sapiens
  misc_feature: GYAE6OF01ASD2J.44.33.C11.1.454.CMB.1.raw
tcagacagtatatacacgaccggtgctcgatttagagtgagctcgttgggtttggggggggaagctcagcttcagctgtgggtagagaagacaggactcaggacgatctccagcatggccagcttccctctcctcctcaccctcctcactcactgtgcagggtcctgggcccagtctgtgatgtctcagccaccctcagcgtctcgggacccccgggcgagggggtcaccatctcttgttctggaagagtccaatatcggatcttatcctgtcaactggtatcggggactcccaggccaccggcccccgactccttatctatcgctactatcagccgcctcgacgggtccctcgcccgtattccgtctcggcctccgaagtcgtggcctactacgacggtcctaccgtcggccctattcccgttgacttccctccgagttctaggaggtagtggaaggcctagtacttactacgtgtcgcagctagtgggatcggacacggccgggaacggtccggtaggggttcggttcgggagggacgggacctaaggttccgacccggttccgtaggtaccaccggcccgaagggtccccg

SEQ ID NO: 156566 - DNA, 540 bp, Homo sapiens
  misc_feature: GYAE6OF01A1KK6.44.33.C11.1.454.CMB.1.raw
tcagacagtatatacacgaccggtgctcgatttagagtgagctcgttgggtttggggggggaagctcagcttcagctgtgggtagagaagacaggactcaggacgatctccagcatggccagcttccctctcctcctcaccctcctcactcactgtgcagggtcctgggcccagtctgtgatgtctcagcccaccctcagcgtctcgggacccccggcagggggtcaccatctcttgttctggaaggagtccaatatcggatcttatcctgtcaactggtatcggggactcccaggccaccggccccccgactccttatctatgctactatcagcgccctcgacgggtccctgcccgattctctggctccaagtctggcactacaggctacctggccatccttgactcctccagtctggaggatggagctgacttactactgtgcagctagtgggatcgacaggccggaacggcgtgggtcggttcgggcgggacgggaccaggttcgacccgttccgtaggccacgcccgaaggtcccg

SEQ ID NO: 156567 - DNA, 798 bp, Homo sapiens
  misc_feature: GYAE6OF01CNAXP.44.33.C11.1.454.CMB.1.raw
tcagacagtatatacacgaccggtgctcgatttagagtgagctcgttgggtttgggggggggtcacaagaggcagcgctctcgggacgtctccaccatggcctgggctctgctgctcctcactctcctcactcaggacacagggtcctgggcccagtctgccctgactcagcctgcctccgtgtctggttctcctggacagtcgatcaccatcctcctgcactggacgccaggcggttaatatttcttagtcttaactttgtcttcctggtatacaacatcactaccgaggtaaaccgaccccaaactcatacatctatagaggtacctaagtaacggacggtcccctacggttaacggggttttactaacgttcggtaccttacctaaccgttcgtaccctacccgtaaacggttcccggaccaaaccgtaccgggtccccttaccccgtaggaaccctaactcccgttcgtacggggtccctaccggtaacgggccgttagggaacgggaaccgggtacgggtaccgttagggtaattttaacgtttagtttcggtttacgtaccgttacgtaaggttaacgtttcggtttccggttacggtacctaactttaccgttaacttttagttaccgtttaccgggttacggggttaaaccgggttacggggtaaacccggttaaaccgggttaccctaaccccggggttacccgtttaacgggtaacccgtaacccggtaacccccggtaaaaccgggtaccccccaaaacccccccgtcgttacccggttaacccccg

SEQ ID NO: 156568 - DNA, 845 bp, Homo sapiens
  misc_feature: GYAE6OF01BT71O.44.33.C11.1.454.CMB.1.raw
tcagacagtatatacacgaccggtgctcgatttagagtgagctcgttgggtttggggagcttcagctgtgggtagagaagacaggactcaggacgatctccagcatggccagcttccctctcctcctcaccctcctcactcactgtgcgagggtcctcgggcccagtctgtgatgtctcacgcccacctcgacgtccgtccgtccggggacccccggggcgtacgggggtccaccgtacttccttcgtttcggttcgtaagggaaacggtaacgtaccaaagttacgtacggtacttacttacttccgtacgttacaacgtggtacgtaccggggacctcccgacggccgaaccccggcccccgtacttcgttactctatcgtactactactcgacgtccgcccgtacggccgggttcctaccggcccgttactccgtcgtcgtcctaccgacgttcgcgtacctaaccgtacgtacgaccgttccgtacggtccttaacgttccgttacgtaacctttcccgttaccgtacggttaccggtgggtaacgtacggttacggtacggttaccgttttaagtaaacccttttacccggtaaggttccggtacgtaacccgaacgggttctaacggggttacggggtaacaccggggtaaaccggtacccggggaaccggggttaaccggggttcgggttaggggtttccgggtaccggggaaccggggtaaccggtaaacccggttagggtttaccccgggaaccggttacggtaaaccgggttcccggaaaaccccgggttcccggaaaccggtccccggttaccccggtcccccggttaaaccgg

SEQ ID NO: 156569 - DNA, 721 bp, Homo sapiens
  misc_feature: GYAE6OF01C6458.44.33.C11.1.454.CMB.1.raw
  modified_base (412)..(412): a, c, t, g, unknown or other
  misc_feature (412)..(412): n is a, c, g, or t
tcagacagtatatacacgaccggtgctcgatttagagtgagctcgttgggtttggggggggaagctcagcttcagctgtgggtagagaagacaggactcaggacgatctccagcatggccagcttccctctcctcctcaccctcctcactcactgtgcagggtcctgggcccagtctgtgatgtctcagccaccctcagcgtcgtcggggacccccggcgacgggggtccaccatctcttgttcgtaggaaggagtccaatagtcggattcttatcctgtactaacgttggtacgtccggggacctcccgaggccaccccggcccccgtacttccttatctagtcgtactaactaatcgacgccgccctacgacgggtccctgtcccgtattctccgtcgctaccgagtccngcactacacgtctacgtgccatcctgactcgtcagtcgtggagagtggaggcttaggtaactttacgtacgttcggtcgacgtaacggccgtaaggttacggggtacgttaaccgggaccggaaccgggttaaccccgggggaaaccggttccgggggttagggggttaccggggtttacccgggggaacccgggggtaaacggggttaaccccggttaaacggggtttttcccgggaaacccccggttttacgggtaaccgggtttaacccggaacccgggtaccccggtaaacgggttccccccggg

SEQ ID NO: 156570 - DNA, 898 bp, Homo sapiens
  misc_feature: GYAE6OF01DN2AE.44.33.C11.1.454.CMB.1.raw
  modified_base (217)..(217): a, c, t, g, unknown or other
  misc_feature (217)..(217): n is a, c, g, or t
tcagacagtatatacacgaccggtgctcgatttagagtgagctcgttgggtttggggagcttcagctgtgggtagagaagacaggactcaggacgatctccagcatggccagcttccctctcctcctcaccctcctcactcactgtgcgagggtcctgggcccagtctgtgatgtctcacgcccaccctcgacgcgtccgtccggggacccccgggnggacgggggtccaccgtactccttcgtttggttcgtagggaaacggtaacgtacctaaagttacgttacggtaactttccgtttaactcccgttagtaaccgtaaaccgtttggggtaacgttacccgggggtacccttaccccggaacgggtccccgaacccccggggtcccccccgttaaccgtttacccctttaacgtacccttaagtaccggtacctttaaccgttaaacgtccgaccgggaccccggtaccccgttccggtaacccgggggttcccctacccggtacccggttaccgtttccgtccgtaccggtacccttaacccgtaagttcccggtacgtaccgtaaccgtaccggtaacccggtacgttacccgtccggtacctaaccgtttcccgttacgtactcccttacgtacgttcgtacggtaggtaacgtcgggaacgttacgttacgtaacgtttaacgttcggttagaccgtacgaacgtacgtacgggtaggtaacgtacggtaaccggtaccgggacccgggtaacggtccgggttagggttccgggttaccggggacgggtaacccggggtaacgtaaccgggtttccggacccgggtttaccggacggttaacccggacccggtaccgtaaccggtcccggtacccgtcccccgttacggg

SEQ ID NO: 156571 - DNA, 685 bp, Homo sapiens
  misc_feature: GYAE6OF01EM68X.44.33.C11.1.454.CMB.1.raw
tcagacagtatatacacgaccggtgctcgatttagagtgagctcgttggggtttggggggggaagctcagcttcagctgtgggtagagaagacaggactcaggacgatctccagcatggccagcttccctctcctcctcaccctcctcactcactgtgcgagggtcctgggcccagtctgtgatgtctcagcccaccctcacggcgtccgtcggggacccccgggcgacgggggtccaccatctcttgttctagggaaggaacgtaccaatagtcggattcttactcctgtacaacgttggtacgtccgggacctcccgacggccaccggcccccgtactccttactctatcgctaactatcagccgtcctcgaccgggtcctcgcctattccgtcgtcgcctacgtaacgtcgtcgcacctacgacggtcctaccgtcggaccctacgttccttgtaaccttccgtacctaggttcctagggtagtacgtgacggtactacggtaactttaccgtaacgtggtaacgtacgaacgttcgtaacgggtgggtaacgtacggaaccggtaacgggacccggggtaacgggtcgggttacggggttcgggttaccggggacggggtaaccgggtactacgggttaccgacccggttacgtacgtacgacccgccgtaacggtccccg

SEQ ID NO: 156572 - DNA, 667 bp, Homo sapiens
  misc_feature: GYAE6OF01BDE3L.44.33.C11.1.454.CMB.1.raw
tcagacagtatatacacgaccggtgctcgatttagagtgagctcgttgggtttggggagcttcagctgtgggtagagaagacaggactcaggacgatctccagcatggccagcttccctctcctcctcaccctcctcactcactgtgcagggtcctgggcccagtctgtgatgtctcagccaccctcagcgtctcggggacccccgggcgacgggggtcaccatctcttgttctggaaggaagtccaatatcggatcttatcctgtcaactggtatcggggactcccgaggccaccggccccccgactccttactctatcgctactaatcacgccgccctcgacgggtccctcgcccgtattcgtcgtcgcctccaagtcgtcggccacgtacgacggtcctaccgtcggtccctacttcccttagtacttcctccgtagttctaggaggatggacggtacttagtaactttacgtacgttggtcgactaggcgtaggtagggtactacggaaccgacgggacccgggtaacgggtcggttcgggttcgggttccggggaccggggtaacgggtaaccgtaagggttaccggtacccggttaccggtacgggtaccgtaccggaccccggtaaagggtccccgttcccgtccccccggttacccggg

SEQ ID NO: 156573 - DNA, 129 bp, Homo sapiens
  misc_feature: GYAE6OF01BZUCP.44.33.C11.1.454.CMB.1.raw
  modified_base (129)..(129): a, c, t, g, unknown or other
  misc_feature (129)..(129): n is a, c, g, or t
tcagacagtatatacacgaccggtgctcgatttagagtgagctcgttgggtttggcacagcggccctgggctgcctggtcaaggactacttcctatatactgtctgagcgggctggcaaggcgcatagn

SEQ ID NO: 156574 - DNA, 771 bp, Homo sapiens
  misc_feature: GYAE6OF01BVGOH.44.33.C11.1.454.CMB.1.raw
tcagacagtatatacacgaccggtgctcgatttagagtgagctcgttgggtttggggggggaagctcagcttcagctgtgggtagagaagacaggactcaggacgatctccagcatggccagcttccctctcctcctcaccctcctcactcactgtgcaggtcctggcccagtctgtgatgtctcacgccaccctcagcgtcgtcgggacccccgggcgagggggtccaccatctcttgttcgtaggaaggaagtccaatatcggattcttactcctgtactaacgtggtacgtcggggacctcccgaggccgacccggaccccccgtacttccgttactcctagtcgtacctaactaactcgaacggtcccggtacccgtcggaccggggtcccctcggtcccgtactttccgtccgtcggtaccctaccgtaacgtccgtacgggacctaaccgttaaccgacgggtacccttaacccgtcggtacccttaacgtttcccgtttaggtaaccttcccgttaccgtacggttaccgtaggtaacgggtacgttgggaaccggtcgttaaggttaacttttaaccgtaacgttggtaccgacgtaacgtcgtaaggtcgggtaataccgggacgtaaccggggacccgggtaacgggttcgggttacggggttacggtaccggggaacgggaaccgggtaaccgtaacggtccggttaccggtacccggttccggtaccgggtaccgaaccgggtaccccggtaacccggg

SEQ ID NO: 156575 - DNA, 1102 bp, Homo sapiens
  misc_feature: GYAE6OF01E2OM8.44.33.C11.1.454.CMB.1.raw
tcagacagtatatacacgaccggtgctcgatttagagtgagctcgttgggtttggggggggaagctcagcttcagctgtgggtagagaagacaggactcaggacgatctccagcatggccagcttccctctcctcctcaccctcctcactcactgtgcagggtcctgggcccagtctgtgatgtctcagccaccctcagcgtctcgggacccccgggcagggggtcaccatctcttgttctggaaggagtccaatatcggatcttatcctgtcaactggtactcggggacctcccgaggccaccggccccccgactccttatctatcgactactaatcacgccggcccctcgacggggtccctcgccccgtattctcgtcggtcctcccgaagtcgtcggacctacgtaccgacgggtcctaacccgttcggacccctaacgttccccgtttacgtaaccctttacccccccgtacggttacccgttacgggtaacgggtaacgttacgggtaacggggttacccgtttacggttaaaccgtttttaacccgtttaaacccgtttcgggttaccgggtaacccggtaaccgggtaaccccggttaaacggggttttaacggggggttaaacccggtttaaccggggttaaaacccccgggtaaacccgggggggtaacccccccgggggggttaaaaacccgggggggttccccggggggttttttaaacccggggggggggggtttaaccccgggggggttttttttaacccccgggggggggggtaacccccgggggggggttaaaacccccggggggggggggtttaaaaaaccccccccgggggtttttaaaaaaaccccggggggggtttttttaaaccccccccgggggggttttaaaaaccccccccccgggggggttttttaaaccccccccccggggggttttaaaacccggggggggttttttaaacccccccccgggggaaaaaaccccccgggggggtttaaaccccccccccccgggggttaaaaaaaacccccgggggggttcccccccccgggggttttttaaaaccccccccccccccgggggggg

SEQ ID NO: 156576 - DNA, 755 bp, Homo sapiens
  misc_feature: GYAE6OF01A1MZS.44.33.C11.1.454.CMB.1.raw
tcagacagtatatacacgaccggtgctcgatttagagtgagctcgttgggtttggggagcttcagctgtgggtagagaagacaggactcaggacgatctccagcatggccagcttccctctcctcctcaccctcctcactcactgtgcagggtcctgggcccagtctgtgatgtctcagccaccctcagccgtcgtcgggacccccgggcagggggtcaccatctcttgttctggaagagtccaatatcgatcttatcctgtcaactggtagtcgggactccgaggcaccggccccccgactccttatcctatcgaccttactaatccagccggcccctcgacggggtcccctgccccggtattccgtcgtcggctcctaaggtctcgggcactacacgggtacctaccgtggacctactccttcgtacttctaccgtagtcctaggtaacggagttacggacgggtaccgttaggtaactttaaccgttaacgttcggtacggtacgtacggtaccgtaagggttacgggtaaggttaacggacccggaacggggtaccccgggggtaaaccggggttcgggttaaccgggggttccgggttccggggtacccgggggtaaaccggggttacccggtaaacggggtttacccgggtaaccccgggttacccgggttaaccgggttaccggtaaccgggacccccggtaaacggggtcccggttacccccggtacccccccgggtttacccgggg

SEQ ID NO: 156577 - DNA, 809 bp, Homo sapiens
  misc_feature: GYAE6OF01CJYTY.44.33.C11.1.454.CMB.1.raw
tcagacagtatatacacgaccggtgctcgatttagagtgagctcgttgggtttggggagcttcagctgtgggtagagaagacaggactcaggacgatctccagcatggccagcttccctctcctcctcaccctcctcactcactgtgcagggtcctcgggcccaatctgtgatgtctcacgcccaccctcacgcgtccgtcgggacccccgggcgacggggtcacctatctcttgttcgtaggaaagagtaccaatagtcggtattcttacttcctagttaccgaacgttagggttaacgtccggggtaacctcccgaacggacccgaccccgggacccccccgtacttaccctttaactccttaacgtcgtaccttaaactaactcgacggtccggcccgtacggacgggttcccctcggaccgttacgttcgtccgttcggtacccttaccgtaaacgttcgtacggtaacctaaccgtaacgacggtaccttaacccgtcggtaaccctagttacccggtttatacccgttaccgttaccgtaagttcccgtaaggaaggtacgtaggtacgtactagttaaacctttacgtaacgtgtacgacgtacgtacggtaaggtagggtaaacgttacgggaaaccgggtacccgggtaacgggttccgggttaggggttccgggttaccggggaaccggggttaaacggaacccgttaagggttacccggtaaccggttccggtaaggttccgaaacccggtacccgaacgggtccccgttaaccccgggtcccccgttcggttacccg

SEQ ID NO: 156578 - DNA, 772 bp, Homo sapiens
  misc_feature: GYAE6OF01A5RKK.44.33.C11.1.454.CMB.1.raw
  modified_base (276)..(276): a, c, t, g, unknown or other
  misc_feature (276)..(276): n is a, c, g, or t
  modified_base (373)..(373): a, c, t, g, unknown or other
  misc_feature (373)..(373): n is a, c, g, or t
tcagacagtatatacacgaccggtgctcgatttagagtgagctcgttgggtttggggggggaagctcagcttcagctgtgggtagagaagacaggactcaggacgatctccagcatggccagcttccctctcctcctcaccctcctcactcactgtgcagggtcctgggcccagtctgtgatgtctcagccaccctcagcgtcgtcggggacccccgggcgagggggtcaccatctcgttgttctggaaggagtccaatatcggattcttatcctntcaactggtatcggggactccgaggccaccggcccccgacttccttatctatgctactaatcagccggccctcgacgggtccctcgcccgtattccncgtcggcctccaagtctggaccacgtacgacggccttaacccgtcggtccctacttccgttgtaacgttccctacccgtaagttcccgttaggaacgggtagttacgggaacgggtaccgtaggttaacgttttaaccgttacgttacgggttacggaccgttacggacccgtaagggtttgggggaaacttacgggaaccggtaacgggtacccccgggggtaaacggggtcccgggtttagggggggtttaccgggtttacccggggggtacccgggggtaaaccgggggtaaaccccggttaaaccggggtttacccgggtaaacccccgggtttaccccggttaagggttaacccccgggaaccggtaacccccggaaacggggttacccccggg

SEQ ID NO: 156579 - DNA, 635 bp, Homo sapiens
  misc_feature: GYAE6OF01BL2V1.44.33.C11.1.454.CMB.1.raw
  modified_base (459)..(459): a, c, t, g, unknown or other
  misc_feature (459)..(459): n is a, c, g, or t
  modified_base (592)..(592): a, c, t, g, unknown or other
  misc_feature (592)..(592): n is a, c, g, or t
tcagacagtatatacacgaccggtgctcgatttagagtgagctcgttggggtttggggggggaagctcagcttcagctgtgggtagagaagacaggactcaggacgatctccagcatggccagcttccctctcctcctcaccctcctcactcactgtgcagggtcctgggcccagtctgtgatgtctcagcccaccctcagcgtccgtcggggacccccgggcgagggggtccaccatctcttgttctagggaaggaacgtaccaatagtcggattcttatcctgtcaacgtggtacgtcggggacctccgaggccaccggcccccgtaactccttatctatcactactaatcacggccggtccctcgacgggtccctcgcccgtactttccgcgtcggcctaccgtaagtccgtcggccaacgtctacggtcccttaacgtcgacctacttccgttanacgttcctaccgtaggtcctaggaggtacgtggacggtcttaggtaactttactaacgttggtcgtaccgagtaccgtaggtgggtaatacggaacgtacgggacccggtacggtcggtgggtcggtacgggnggacggtacgtagtcggaccgtcgtacgcacgcgacggtcccg

SEQ ID NO: 156580 - DNA, 780 bp, Homo sapiens
  misc_feature: GYAE6OF01DCR9U.44.33.C11.1.454.CMB.1.raw
tcagacagtatatacacgaccggtgctcgatttagagtgagctcgttgggtttggggagcttcagctgtgggtagagaagacaggactcaggacgatctccagcatggccagccttccctctcctcctcaccctcctcactcactgtgcagggtcctgggcccagtctgtgatgtctcagcccaccctcacgcgtcgtcggggacccccgggcgagggggtccaccgattcctcttgcctcgtcggaacgccgcctaccaactagtcggaagtattaaattatgttaattagttagtaaactaaacagtcgacgaacgacggcccggacccccagtacctcctctacttacgaagtacgggactcgaaggacgccggtccctcggccgggttccctggaccgtacttccgtcgtggtcctaccgtaacgttccgtcggaccctacccgttcccggtccccttcccgtacggccctacgttaccgtacggggttcgggtccccgttcccggggtaccgaagggtacgtcgggtaacccggttcctaaacgtttagttttacgtttcggaccggtacaggtaccgtaagggttcggggacgtaggtaccggacggggtcccggggtaggacgggtccggtaggttcgggttaccgggaccgggggtaaaacggtaacccgggtaaacgggttcccgggaaccccggttaccggttaaccggggtacccgaaacccgggtaaccccggtaacgggtcccccgttaccccggggtacccccccg

SEQ ID NO: 156581 - DNA, 693 bp, Homo sapiens
  misc_feature: GYAE6OF01D0P9B.44.33.C11.1.454.CMB.1.raw
  modified_base (673)..(673): a, c, t, g, unknown or other
  misc_feature (673)..(673): n is a, c, g, or t
tcagacagtatatacacgaccggtgctcgatttagagtgagctcgttgggtttggggagcttcagctgtgggtagagaagacaggactcaggacgatctccagcatggccagcttccctctcctcctcaccctcctcactcactgtgcagggtcctgggcccagtctgtgatgtctcagccaccctcagcgtcgtcggggacccccgggcgacgggggtcacctatcttcttgttcgtaggaaggacgtccaatacgtcggattcttactcctgtactaacgtggtacgtccggggacctccgacggccgacccggccccccgtactccttactctatcgactactaactcgacgccgccctcgtacgggtcccacgcccgtacttccgtcgtcggtcctaccgtaacgtcgtcgacctacgtacgacggtcctaccgtcggcctagttccttgacttccgtcgtacgttcgtagaggtagtaggacgtcttaggtaacctttacgtacgtggtacgacgagtcgtaagggtggaacgttgaaccggacgggtaccgggaacgggttcggttacgggggttcgggtaccggggaacggggtaacggtaacccgtaaggttccggtacccggttacggtaccggtaccgaaccggtacccggaacgggttcccnccccgggtccccgttaccgg

SEQ ID NO: 156582 - DNA, 666 bp, Homo sapiens
  misc_feature: GYAE6OF01CJ53J.44.33.C11.1.454.CMB.1.raw
  modified_base (244)..(244): a, c, t, g, unknown or other
  misc_feature (244)..(244): n is a, c, g, or t
  modified_base (339)..(339): a, c, t, g, unknown or other
  misc_feature (339)..(339): n is a, c, g, or t
tcagacagtatatacacgaccggtgctcgatttagagtgagctcgttgggtttggggggggtcacaagaggcagcgctctcgggacgtctccaccatggcctgggctctgctgctcctcactctcctcactcaggacacagggtcctgggcccagtctgccctgactcagcctgcctcgtgtctggttctcctggacagtcgatcaccatctcctgcactgggtccagcaatgacagttggganatataacttgtctctggtatcaacaacatccaggacaaacgacccccaaactcaattacttttgactaccagtgagcggtccgtcgtaagggttntttactaactcgtctttctcgtcggcctccgaagttcgtcggacccacgtaccggcccttcccgtcgtacgtaattcctcgtccggggtcctccccgggtcctagggaacggaccggaggtcctacgtaccttaagttacctggacccggtcttacgtaacttttaaccgactttccgttagtacggttacgtttcggggttcgttaccgggtcggggtaacgggtacccttcgaacccgttcggtacccggtttacctacgggttccaaccggccccgtaaacggtcccggttacccgcccccccggtttcggtcccttaccccgg

SEQ ID NO: 156583 - DNA, 583 bp, Homo sapiens
  misc_feature: GYAE6OF01AWGIZ.44.33.C11.1.454.CMB.1.raw
tcagacagtatatacacgaccggtgctcgatttagagtgagctcgttgggtttggggggggaagctcagcttcagctgtgggtagagaagacaggactcaggacgatctccagcatggccagcttccctctcctcctcaccctcctcactcactgtgcaggtcctggcccagtctgtgatgtctcagcccaccctcagcgtctcgggacccccgggcaggggtcaccatctcttgtctggaaggagtccaatatcggatcttatcctgtcaactggtatcgggactccgaggccaccggcccccgactcctatctatgctactaatcagccgcctcgacgggtccctgcccgtattctcgtgcctccaagtcctggcctacgtacacggtacctaccgtcggcctacttcctagacttcctacctagtcctaggacgatcggacggtctaggtactttactaagttgtcgtacgagtccgtagtgggactagacgtacggccggaacggcggttgggtcggtcgggacgggtagggtacctaagggttcgaccgttccgtacggtaccacgcccgaggtcccg

SEQ ID NO: 156584 - DNA, 732 bp, Homo sapiens
  misc_feature: GYAE6OF01AJWNW.44.33.C11.1.454.CMB.1.raw
tcagacagtatatacacgaccggtgctcgatttagagtgagctcgttgggtttggggagcttcagctgtgggtagagaagacaggactcaggacgatctccagcatggccagcttccctctcctcctcaccctcctcactcactgtgcagggtcctgggcccagtctgtgatgtctcagccaccctcagcgtcgtcggggacccccgggcgacgggggtcaccatcctcttgttctgggaaggaacgtccaatatcggatcttatcctgtacaactggtacgtccggggacctcccgaggccgaccggccccccgtactccttatctatcgactactatcgacgccgccctcgacgggtcctcgcccgtattcgtcgtcggtctaccgtaagtccgtggcctaacgtacgacggtccttaccgtcggaccctactcccgtttacgaccttccttccgtacgttcgtacgggaacggtacgttacggacggtacgttagttaactttaccgttaccgttgttacgacgtacggtccgtaaggtacggggtactacgggtaaccgaacgggacccggggtaacgggtccgggttcggggtccgggttccgggggaaccggggtaacggggtaaccggttaacggggtttacccggtacccgggttacccggttacgggtaccggaacccgggtacccgtaaccggggtcccgtacccgggtccccccgtccggg

SEQ ID NO: 156585 - DNA, 185 bp, Homo sapiens
  misc_feature: GYAE6OF01EZRFD.44.33.C11.1.454.CMB.1.raw
  modified_base (125)..(125): a, c, t, g, unknown or other
  misc_feature (125)..(125): n is a, c, g, or t
  modified_base (131)..(185): a, c, t, g, unknown or other
  misc_feature (131)..(185): n is a, c, g, or t
tcagacagtatatacacgaccggtgctcgatttagagtgagctcgttgggtttgggcacagcggccctgggctggcctgggtcaaggactacttccagtctactgctgagcgggctggcaaggcncatagnnnnnnnnnnnnnnnnnnnnnnnnnnnnnnnnnnnnnnnnnnnnnnnnnnnnnnn

SEQ ID NO: 156586 - DNA, 981 bp, Homo sapiens
  misc_feature: GYAE6OF01B44N0.44.33.C11.1.454.CMB.1.raw
tcagacagtatatacacgaccggtgctcgatttagagtgagctcgttgggtttggggagcttcagctgtgggtagagaagacaggactcaggacgatctccagcatggccagcttccctctcctcctcaccctcctcactcactgtgcaggtcctgggcccagtctgtgatgtctcacgccaccctcagtcgtccgtccggggacccccgggcgacgggggtccaacctagttccttcgtttcggttaccgtaggggaaacggtaaaccgttaccgtaaagttaacggttaccggtactttaccgttaactttacccggttacgttaaccgtaaaacgttacgggggttaaccggttacccggggggtaacccgttcccccggaaaacggggtcccccggtaaacccccccggggtacccccccccgttaccgtttaacccccgttttaacgttacccgttaaccgttcggttaaccccttaaacgtttaaaccgttaccggaaccggtcccccgggttacccccggttaccgggttaaaccgggggttccccccgtaccgggtacccccgttaaccgttttccggtacgttccggggtaccccttaaccgtaacgggtttcccgttacgggaccctaacgttaaccgtacggtaccccttacccggtacggtaccctacggtttcccgttagtaccgttccgtaccgaacgtttcgtaacggaagggttactcggtaacgggtccttaagggtaacttttacccgtacggtttagtaccggtacgtcggtaaccgtaggtaacggggtacttacggaaccgggtaacgggtacccgggtacgggttacgggtccggggttaggggtaccgggaacggggtaccgggtaaccgttaagggttccgggtaacccggtttaccggacggttcccgaaccggacccgtaacggtccccgttcccccgggtccccgttaacccgg

SEQ ID NO: 156587 - DNA, 653 bp, Homo sapiens
  misc_feature: GYAE6OF01ANUEK.44.33.C11.1.454.CMB.1.raw
  modified_base (221)..(221): a, c, t, g, unknown or other
  misc_feature (221)..(221): n is a, c, g, or t
  modified_base (258)..(258): a, c, t, g, unknown or other
  misc_feature (258)..(258): n is a, c, g, or t
  modified_base (417)..(417): a, c, t, g, unknown or other
  misc_feature (417)..(417): n is a, c, g, or t
  modified_base (644)..(644): a, c, t, g, unknown or other
  misc_feature (644)..(644): n is a, c, g, or t
tcagacagtatatacacgaccggtgctcgatttagagtgagctcgttgggtttggggggggaagctcagcttcagctgtgggtagagaagacaggactcaggacgatctccagcatggccagcttccctctcctcctcaccctcctcactcactgtgcagggtcctgggcccagtctgtgatgtctcagccaccctcgagccgtcgtcggggacccccggngacgggggtcaccatctctgttctggaagagtcaatntcggatcttactctgtcaacgtggtagtcggggactccgacggccaccggcccccgacttccgttactctactgcctaactactcgacgccgtcctcggacgggtcctacgcccgtatttcctcgtcgtcctccgtaacgtcgtacggctaacgtacgnggtacctacgtcggtaccctacgttccttacggtacctccgtaccgtacgttcgtaggacggtagtcggtaacgtcgttagtaacttacttacgttcgtcgaggtacgcgtaggtagggactacggaccgacgggaccgggtaacggtcggttaggggtccggtccgggtacgggacgggtaccgttaacggtccggtacgttccggaacggtaccgacgacccggnggtaccccg

SEQ ID NO: 156588 - DNA, 700 bp, Homo sapiens
  misc_feature: GYAE6OF01B7OF2.44.33.C11.1.454.CMB.1.raw
tcagacagtatatacacgaccggtgctcgatttagagtgagctcgttgggtttggggagcttcagctgtgggtagagaagacaggactcaggacgatctccagcatggccagcttccctctcctcctcaccctcctcactcactgtgcagggtcctgggcccagtctgtgatgtctcagccaccctcagcgtcgtcgggacccccgggcgagggggtcaccatctcttgttctggaaggagtccaatatcggatcttatcctgtacaactggtagtcggggactcccgaggccacccggccccccgactccttatctatcgactactaactcgacgccgtccctcggacggggtcccctcggcccgtatttcctccgtcggtccctaccgaacgttccgtcgggacctaaccgtacgacgggtccttaacccgttcggaccctacgtttcccgttaggtaacttcccttacccgtaagttccgtagggaggtacgtaggtacgggtcttaagtaacttttaccttaacggttcggtacggtaccaggtaccgtaaggtacggggtactacggaaccgacgggacccgggtacgggtcggttggggttacggtccgggacgggaacggtaccgtaaggttcggacccggttcgtaacgggtaccgacggacccgaaggtccctcccggtccccgttaccgg

SEQ ID NO: 156589 - DNA, 631 bp, Homo sapiens
  misc_feature: GYAE6OF01D189T.44.33.C11.1.454.CMB.1.raw
  modified_base (220)..(220): a, c, t, g, unknown or other
  misc_feature (220)..(220): n is a, c, g, or t
tcagacagtatatacacgaccggtgctcgatttagagtgagctcgttgggtttggggggggaagctcagcttcagctgtgggtagagaagacaggactcaggacgatctccagcatggccggcttccctctcctcctcaccctcctcactcactgtgcagggtcctgggcccagtctgtgctgactcagccatcctcagccgtcgtcggggacccccggnaggacggtcacgatctcgttgttctagggaaggacgtccaatatcggtaatcttatccgtgtcaacgtggtacgtcggggacctcccgaggccgacccggcccccgtacttcctttatcctactgtactaactaatcacggccggccctcggacggggttccctcggtcccgtattccgtcgtcggtcctaccgtaacgtccgtggacctaactacgacggtcctaccgtcggcccacttcgttacgtacttcctactagtcgtaggagtcgtaggagtcttagtaactttactacgtgtacgcgagtctagtggagcgacgacggtaccggtacgtggttcgggtcggttacgggacgggtaacggacggtacgtcgtaccggttactacggtaccgccgtccgtaccgg

SEQ ID NO: 156590 - DNA, 537 bp, Homo sapiens
  misc_feature: GYAE6OF01DNTYC.44.33.C11.1.454.CMB.1.raw
  modified_base (363)..(363): a, c, t, g, unknown or other
  misc_feature (363)..(363): n is a, c, g, or t
  modified_base (436)..(436): a, c, t, g, unknown or other
  misc_feature (436)..(436): n is a, c, g, or t
tcagacagtatatacacgaccggtgctcgatttagagtgagctcgttgggtttggggggggaagctcagcttcagctgtgggtagagaagacaggactcaggacgatctccagcatggccagcttccctctcctcctcaccctcctcactcactgtgcagggtcctgggcccagtctgtgatgtctcagcccaccctcagcgtctcgggaccccccgggcagggggtcaccatctcttgttctggaaggaagtccaatatcggatcttatcctgtcaactggtatcgggactcccaggcaccggccccccgactccttatctatgctactaatcagcgccctcgagggtccctgcccgattcnctgctccaagtctggcaactacacgctactggccatcttgatctcagtctgagatgagctagattacatgtgnagcagtgggatgacaggaccggtaacgggctaggggtgttcgggcggaggggaaccaaaggtttgaacccgttccaaacggtcaacgcccgaaaggtcccg

SEQ ID NO: 156591 - DNA, 783 bp, Homo sapiens
  misc_feature: GYAE6OF01DPWU6.44.33.C11.1.454.CMB.1.raw
  modified_base (244)..(244): a, c, t, g, unknown or other
  misc_feature (244)..(244): n is a, c, g, or t
  modified_base (264)..(264): a, c, t, g, unknown or other
  misc_feature (264)..(264): n is a, c, g, or t
  modified_base (653)..(653): a, c, t, g, unknown or other
  misc_feature (653)..(653): n is a, c, g, or t
tcagacagtatatacacgaccggtgctcgatttagagtgagctcgttggggtttggggggggaagctcagcttcagctgtgggtagagaagacaggactcaggacgatcctccagcatggccagccttccctctcctcctccaccctcctcactcactgtgcgacgggtccgtcgggccctagtctggtgtatcgtcctacacgcccaccctcgacgtccggtcggtaccggggacccccgggnggtacgggggtccaaccgtnttccgttcgttcggttcgtagggaacggtacgtacaagttagtacggtacttcttactccgtgtactacgtggtacgtcgggtacctccggacggccgtaccccggcccccgtacttaccgttactcgtacgtacgtactaacgtaactcgaccggtcccgtcccgtaccggtacgggtcccctacggtcccgtatttcccgcgtccggtacctaccgtacgtccggtaccgtacgtaaccgtacggtaccggtaccgtacccggtaccggtcctaaccgtttccgtacgtaccttcccgttaccgtacgtcggtaacgggacgtcgttacgggacgttacgtaagttaacgttacgttacgtcgtgtacgacgtggtaagtcgggtanaaccggacggaacggtcccgggtacggtgggttacgggttccgggttcgggaacggggtaacgggtaccgttacgggttaccggacccggtttaggtaccggaccgaacccggtccggtaccggtccccg

SEQ ID NO: 156592 - DNA, 728 bp, Homo sapiens
  misc_feature: GYAE6OF01DHNVH.44.33.C11.1.454.CMB.1.raw
tcagacagtatatacacgaccggtgctcgatttagagtgagctcgttggggtttggggggggaagctcagcttcagctgtgggtagagaagacaggactcaggacgatctccagcatggccagcttccctctcctcctccaccctcctcactcactgtgcagggtcctcgggcccagtctgtgatgtctcacgcccacctcacgcgtcgtccgggacccccgggcggacgggggtcaccgtatccttcgttcgttcgtaggaaggaacgtcctaatacgtcggtacttcttacgtcctgtactaacgtggtacgtccgggacctccgaggcccacccggcccccgtacttccttatactcgtactacctaactaacgtcacgccgtacccgtcggacgggttcccctacgtccccgtatttccctacgtccggtcctaccgaacggttctacgaccctaaccgttacgaccgtcccttaaccggcggtacccttaagttccccgttagtacttccccgttaccgtacggttccttaggggaacggtacttcgggaaggttcccttaaggttaatttaacccgtgttacggtcgaaccgtacgacgttaagcgggtaaactacggacgacgggtaccgggaacgggtcggttaggggttcggttacgggcgggtaacggtacttacggttacgaccggtacgtacgaccgtaccgccgtaaggtccccg

SEQ ID NO: 156593 - DNA, 361 bp, Homo sapiens
  misc_feature: GYAE6OF01A9FB0.44.33.C11.1.454.CMB.1.raw
  modified_base (192)..(192): a, c, t, g, unknown or other
  misc_feature (192)..(192): n is a, c, g, or t
  modified_base (257)..(257): a, c, t, g, unknown or other
  misc_feature (257)..(257): n is a, c, g, or t
  modified_base (331)..(332): a, c, t, g, unknown or other
  misc_feature (331)..(332): n is a, c, g, or t
  modified_base (334)..(361): a, c, t, g, unknown or other
  misc_feature (334)..(361): n is a, c, g, or t
tcagacagtatatacacgaccggtgctcgatttagagtgagctcgttggggtttggggggggtcacaagaggcagcgctctcgggacgtctccaccatggcctgggctctgctgctcctcactctcctcactcaggacacagggtcctgggcccagtctgccctgactcagcctgcctccgtgtctggttcnccgtggacagtcgatcaccatcctcctgcactggacgccaggcgtcacgcccaaggcccaacccntcgtcactctcgtcccgcctctctatactactgtctggacggcgggtctacgggacgaaggccgacaagtacgnngnnnnnnnnnnnnnnnnnnnnnnnnnnnn

SEQ ID NO: 156594 - DNA, 777 bp, Homo sapiens
  misc_feature: GYAE6OF01D7NPB.44.33.C11.1.454.CMB.1.raw
tcagacagtatatacacgaccggtgctcgatttagagtgagctcgttgggtttggggagcttcagctgtgggtagagaagacaggactcaggacgatctccagcatggccagccttccctctcctcctcaccctcctcactcactgtgcagggtcctcgggcccagtctgtgatgtctcacgccaccctcacgccggtcgtcggggacccccgggcgacgggggtccaccatctcttggttcgtagggaaggagtccaaatagtcggtattctttatccgtgtactaacgtggtacgtccggggacctacccgaggcccgacccggccccccgtactcctttacgtctactcgaccttaactaatccgacgccggtccctacggaccggggtcccctcgtcccgtacttcctccgtcggtcctaccgtaacgtccgtcggacctaaccgtaaccgaccgggtcctaacccggtcggtaccctaacttcccgtttacgtaccttcccgtacctacggttacctagggtaaggtacgtacgggtacggtacgttacggttaacctttaacgttaccgttggtacggtaccgacggtacgtaacgggtagggacgttacggaaccggtaccgggaacccggggtaacggtcgggttacggggttcggttaccgggggaccggggtaacgggtaacccggtaagggtttcccggacccggttaccgtaaccgggtaccgaccggtaccggaaccggtcccgtcccgtcccccggttaccgg

SEQ ID NO: 156595 - DNA, 566 bp, Homo sapiens
  misc_feature: GYAE6OF01BCDB6.44.33.C11.1.454.CMB.1.raw
  modified_base (218)..(218): a, c, t, g, unknown or other
  misc_feature (218)..(218): n is a, c, g, or t
  modified_base (464)..(464): a, c, t, g, unknown or other
  misc_feature (464)..(464): n is a, c, g, or t
tcagacagtatatacacgaccggtgctcgatttagagtgagctcgttgggtttggggggggaagctcagcttcagctgtgggtagagaagacaggactcaggacgatctccagcatggccagcttccctctcctcctcaccctcctcactcactgtgcagggtcctgggcccagtctgtgatgtctcagccaccctcagcgtctcgggacccccgggnagggggtcaccatcctcttgttctggaaggagtccaatatcggatcttatcctgtcaactggtatcgggactcccgagccaccggcccccgactccttatctatgctactatcagccggccctcgacgggtccctgcccgattcctctcggcctccaagtctggcactacgacggcctaccgtggccctactccgttgactcctaccgagttcgtggaggatcgaggtctagtacttactacgtgngcagctagtgggatcggacgacggccgggaacggtcgtggggtcggtcgggacgggacgggacctaaggtcgacccgttcgaggtcaccgccgacggtcccg

SEQ ID NO: 156596 - DNA, 897 bp, Homo sapiens
  misc_feature: GYAE6OF01CG123.44.33.C11.1.454.CMB.1.raw
  modified_base (237)..(237): a, c, t, g, unknown or other
  misc_feature (237)..(237): n is a, c, g, or t
tcagacagtatatacacgaccggtgctcgatttagagtgagctcgttggggtttggggggggtcacaagaggcagcgctctcgggacgtctccaccatggcctgggctctgctgctcctcactctcctcactcaggacacagggtcctgggcccagtctcgccctgactcagcctgcctccgtgtctggttctccgtggacagtcgatccacatccgtcctgctagttcggaaaccngcaggtgactagtttgggtaggtttataacttattcgtaccttccgtacggttaaccaaacctaaccgaaccccgaacggaaccaaaaacccgtaccccccctaaaaactcctaacgttacggtaacttttaccgaagttacgtaacttcgggttaacctaaacggttaaccgtccccgggttaccccgttacgggttacggggggtttttccttcgggttcccggttccttttaccggtcccggttcgggtaccccgtttacccgtaaacggttacccggtaccggtaaacccgtaaacccggtacccccggttcccccgtttaccccggtaaccgtaacccttacggttcccgtttccgggtccgggtacccctttaccgggacggtacccgttaagggaagtacgggttaggggtaacggttacggtaacttttaccgttacgtaccggtacccgttacgttacccgtacgtaagggtacccgtacgtccgtaacgttcccgtagggttaacgggtttcgggggtttacgggttaccgggttcccggggaaccggggtacggggaaacccttacgggtccggttacccggtacccgggtccgttaccggggtaacccacccggggtaaccccgtaggggtccccttaacccccgggg

SEQ ID NO: 156597 - DNA, 782 bp, Homo sapiens
  misc_feature: GYAE6OF01EDMV8.44.33.C11.1.454.CMB.1.raw
tcagacagtatatacacgaccggtgctcgatttagagtgagctcgttgggtttggggagcttcagctgtgggtagagaagacaggactcaggacgatctccagcatggccagcttccctctcctcctcaccctcctcactcactgtgcagggtcctgggcccagtctgtgatgtctcagccaccctcagcgtctcggggacccccggcgagggggtcaccatctcttgttctggaagagtccaatatcggatcttatcctgtcaactggtatcggggactcccgaggccaccggccccccgactccgttatctatcgactactaatcacgcggccctcgacggggtccctcgccccgtattccgtcgtcggtcctaccgtaacgttccgtacgggacctaaccgtaaccggtaacggtacccgtacccgttcggggtacccctaacgtttccccgtttaggtaaccttccccgttaccgtaacggtttccgtacgggtaacgggtaacgttaggtacggggtacccttaggtaaacgttttaccgttaacggtttggtaccgtaccgtacggtaccgtaggttacgggtaacgttacggaaccggtacgggtaacccggggtaacgggtcgggttacgggggttacgggttcccggggaacgggggtaaccggggtaacccggttaaagggtttaccgggtaaccccggttaccggttaaccgggtaccgaacccgggttcccgaaacccgggttccgtacccggtccccccggttacccgg

SEQ ID NO: 156598 - DNA, 797 bp, Homo sapiens
  misc_feature: GYAE6OF01CU9C8.44.33.C11.1.454.CMB.1.raw
  modified_base (215)..(215): a, c, t, g, unknown or other
  misc_feature (215)..(215): n is a, c, g, or t
tcagacagtatatacacgaccggtgctcgatttagagtgagctcgttgggtttggggagcttcagctgtgggtagagaagacaggactcaggacgatctccagcatggccagcttccctctcctcctcaccctcctcactcactgtgcagggtccgtgggcccagtctgtgatgtctcacgcccaccctcacgcgtcgtccggggacccccgggngacgggggtcaccgtatctcttgtcgtaggaacggaacgtaccaagttacgtacggtacttcttacttccgtgtactaacgtggtacgtccggggtactcccgaggccgacccggccccccgtactccttatctaacgtcgtacctaactaatccgacggacccggtcccgtcggtaccggggtccctccggacccgttacgttcctccgtcggtacctacccgtaacggtttccgtacgggacctaacgtaaccgagggtaccctaaccgtcggtaccctactccccgttagtacctccttacgacgttcgtacgaaggtacgtaggtacggtacgttaagtacgtttaccgtacgtcggttacgaaccggtacgtacgtacgggtagggtaacgtacgggaaaccggaccgggtaacccgggaacgggttcggttaccgggggttacgggtaccggggtaccggggtaaaccgggtacccgttaacgggttacccgggtacccgttccgggttacggggacccaaccgggttaccccggaaccgggttccccgttaccccgggccccgtttaaccccggg

SEQ ID NO: 156599 - DNA, 633 bp, Homo sapiens
  misc_feature: GYAE6OF01D4SHF.44.33.C11.1.454.CMB.1.raw
  modified_base (435)..(435): a, c, t, g, unknown or other
  misc_feature (435)..(435): n is a, c, g, or t
tcagacagtatatacacgaccggtgctcgatttagagtgagctcgttgggtttggggggggaagctcagcttcagctgtgggtagagaagacaggactcaggacgatctccagcatggccagcttccctctcctcctcaccctcctcactcactgtgcaggtcctgggcccagtctgtgatgtctcagccaccctcagcgtctcgggacccccgggcagggggtccaccatctcttgttctggaaggaagtccaatatcggatcttatcctgtcaactggtatcggggactcccaggccacggcccccgatccttatctatcgctactaatcagccgccctcgacggggtccctgcccgtattccgtctggcctaccaagtcctcggacactacgacggcctaccgtggccctatccttgactctcagtctgagntgagtctagatttactacgtgtcgcagctagttgggacttcggacgtacgggacccgggtaacgggtcgttagggggttacggtttccggggaccggggtaacgggggtaaccccttaaaagggtttcccggaacccccgggtttaccgttaacggggttacccgaaccgggtacccccggtaaaggggttccccccg

SEQ ID NO: 156600 - DNA, 131 bp, Homo sapiens
  misc_feature: GYAE6OF01ACSOV.44.33.C11.1.454.CMB.1.raw
  modified_base (130)..(131): a, c, t, g, unknown or other
  misc_feature (130)..(131): n is a, c, g, or t
tcagacagtatatacacgaccggtgctcgatttagagtgagctcgttgggtttgggcacagcggccctgggctgcctggtcaaggactacttcctatatactgtctgagcgggctggcaaggcgcatagnn

SEQ ID NO: 156601 - DNA, 954 bp, Homo sapiens
  misc_feature: GYAE6OF01AQBP1.44.33.C11.1.454.CMB.1.raw
  modified_base (224)..(224): a, c, t, g, unknown or other
  misc_feature (224)..(224): n is a, c, g, or t
tcagacagtatatacacgaccggtgctcgatttagagtgagctcgttgggtttggggggggaagctcagcttcagctgtgggtagagaagacaggactcaggacgatctccagcatggccagcttccctctcctcctcaccctcctcactcactgtgcgagggtcctgggcccagtctgtgatgtctcacgcccaccctcacgcgtcgtccgggacccccgggngacgggggtccacctactccttcttgttccgtagggaacggtaacgtaccaagttagtcggtacttctttaacgtccttgtactaacgttgggtacgtaccggggtacctaccccggacggcccgacccccgggtccccccggtaacttacccttacttacgtactcgtaacttaaccttaacgtaccgaaccgggtcccggtaccccgtccgggtaccggggttccccgtaccggtccccgttacgtttcccgtaccgttccggtacccgttaccgtaacgttccgtaccgggaaccttaaccggtaaccggtaccggttaccccgttacccgggtacggtaaccccttccttacccggtttacgtaacctttccccgtaaccgttacggttacgttaacggggtaaccggtaaggttcggggtaaccggtccgtttaacgttaacccggtttaccttaacgggttgtaaccggtaaccggtaacgggtcgggttaacggttaggggaaccttaccggggaaacccgggttaaccggggtaaccccggggaacgggttttaccgggggttaccgggggggttttaccgggttaaaccccgggggggacgggggtaaacccggggttaacccgtttaaacccggggtttacccggtaacccccgggtttacgggtaacccgggttaaccccgaaccgggttaacccccgggacgggttttcccccccggg

SEQ ID NO: 156602 - DNA, 698 bp, Homo sapiens
  misc_feature: GYAE6OF01A3TLM.44.33.C11.1.454.CMB.1.raw
  modified_base (394)..(394): a, c, t, g, unknown or other
  misc_feature (394)..(394): n is a, c, g, or t
  modified_base (564)..(564): a, c, t, g, unknown or other
  misc_feature (564)..(564): n is a, c, g, or t
  modified_base (581)..(581): a, c, t, g, unknown or other
  misc_feature (581)..(581): n is a, c, g, or t
tcagacagtatatacacgaccggtgctcgatttagagtgagctcgttgggtttggggggggaagctcagcttcagctgtgggtagagaagacaggactcaggacgatctccagcatggccagcttccctctcctcctccaccctcctcactcactgtgcgagggtcctgggcccagtctgtgatgtctcacgcccaccctcgacgcgtccgtcggggacccccgggcgacgggggtccacctacttctcgtttcgttcgtagggtaaacggaacgtaccaaagttagtaccggtattcctttactcctgtacctaacgttcggtacgtacggggacctccgaggcccgaccccgggccccccgtacttccttactactactcgtactaactacncgacggccgtcccgtcgaccggggttcccctcggtaccccggtatttccgtcgtcggtcctaccgtaagttccgtcggactaccgtacgcgtcctacgtcgtcctacgttcctagtccttcgtccgtagttcgtaggagtagtcgacgtcgtacgtacttactagtcgtnacgtagcgtagtcggancggaaccggacggtacccgggagttcgggtggggtacggttcggggacgggtacgggccgaacgtccggtaaccggtacccggttcgggaggtacccggaacggtcccggtaaccgg

SEQ ID NO: 156603 - DNA, 135 bp, Homo sapiens
  misc_feature: GYAE6OF01B1XB3.44.33.C11.1.454.CMB.1.raw
  modified_base (130)..(135): a, c, t, g, unknown or other
  misc_feature (130)..(135): n is a, c, g, or t
tcagacagtatatacacgaccggtgctcgatttagagtgagctcgttgggtttgggcacagcggccctgggctgcctggtcaaggactacttcctatatactgtctgagcgggctggcaaggcgcatagnnnnnn

SEQ ID NO: 156604 - DNA, 779 bp, Homo sapiens
  misc_feature: GYAE6OF01D09R6.44.33.C11.1.454.CMB.1.raw
tcagacagtatatacacgaccggtgctcgatttagagtgagctcgttgggtttggggagcttcagctgtgggtagagaagacaggactcaggacgatctccagcatggccagcttccctctcctcctcaccctcctcactcactgtgcagggtcctgggcccagtctgtgatgtctcacgccaccctcagcgtcgtcgggaccccgggcgaggggtcaccatctcttgttctaggaaggaacgtccaatagtcgtatcttatcctgtacaacgtggtagtcgggacctccgaggccacccggcccccgacttccttatctatcgactactaactcgacgccgccctacgcgggtccctcgcccgtacttctcgtcggtacctacccgaagtccgtcggacctaaccgtaccgacggtccctaacccgtccgggtaccctaacgtttccccgtttgtaacccttccgtacccgttaggttcccgtacgggaaggtacgtagggtaaccgggtcgttaaggttaaccgttttaaccgttacgttcggtaggtaccgtagggtactaacgggttagggggtaacttacgggaaaccggaccgggggtacccgggtaaccggggtcggtttcgggggttaccgggttacccggggggaaccggggtaccggggtaaaccgggttaacgggtttaccggtaaccccgggtttacccgttaacgggtacccggacccggtaaccccggaacgggtcccccgtaccccggtccccccggttaccgg

SEQ ID NO: 156605 - DNA, 724 bp, Homo sapiens
  misc_feature: GYAE6OF01BK83G.44.33.C11.1.454.CMB.1.raw
tcagacagtatatacacgaccggtgctcgatttagagtgagctcgttgggtttggggggggaagctcagcttcagctgtgggtagagaagacaggactcaggacgatctccagcatggccagcttccctctcctcctcaccctcctcactcactgtgcgaggtcctgggcccagtctgtgatgtctcacgcccaccctcagcgtccgtcggggacccccgggcgacgggggtcaccgatctcgtttgttctagggaaggaacgtccaatagtacggatcttactcctgtctaacgtggtagtccgggacctccccgaggccgacccggcccccgtactcccttaactcttatcgtctactaatcacgccgtcccgtccgacggggtccctcggcccgtattccgtccgtcggtcctaccgaacgttccgtacgcctaaccgtaccgacggtaccttaacccgtcggtaccctacgttacccttaggtaccttccctacccgtacggttcgtacgggagggtagttacgggacgtacgtacgtaacgtttaccgtacgttcggtactacggacgtacgtaaggtacgggtacgtacgaaccggtacggaccggggtacggtacgggtcggggttacggttccgggggaaccgggtaacgggtaacccgtaacggttacggtaacccgtaccggtacggtaccgcccggtacccgcgggtaccccg

SEQ ID NO: 156606 - DNA, 552 bp, Homo sapiens
  misc_feature: GYAE6OF01BRXIX.44.33.C11.1.454.CMB.1.raw
  modified_base (194)..(194): a, c, t, g, unknown or other
  misc_feature (194)..(194): n is a, c, g, or t
  modified_base (215)..(215): a, c, t, g, unknown or other
  misc_feature (215)..(215): n is a, c, g, or t
  modified_base (257)..(257): a, c, t, g, unknown or other
  misc_feature (257)..(257): n is a, c, g, or t
  modified_base (303)..(303): a, c, t, g, unknown or other
  misc_feature (303)..(303): n is a, c, g, or t
  modified_base (342)..(342): a, c, t, g, unknown or other
  misc_feature (342)..(342): n is a, c, g, or t
  modified_base (363)..(363): a, c, t, g, unknown or other
  misc_feature (363)..(363): n is a, c, g, or t
  modified_base (514)..(527): a, c, t, g, unknown or other
  misc_feature (514)..(527): n is a, c, g, or t
  modified_base (529)..(552): a, c, t, g, unknown or other
  misc_feature (529)..(552): n is a, c, g, or t
tcagacagtatatacacgaccggtgctcgatttagagtgagctcgttggggtttggggagcttcagctgtgggtagagaagacaggactcgaggacgatctccagcatggccagcttccctctcctcctccaccctcctcactcactgtgcgacgggtccgtcgggcccagtctgtgatgtctcacgccacctnacgtcgtcggcgggccccggngacggggtcacatctcttgtcgtaggaaggactcaaatacgnggtattcgttatcctagtacgtaacgtggtaacgtccggggtaccncgacggccgaccccggtacccccgtacttacccgtttancgttaatcgtacttaactaancgacgcgtacctcggaccgggttccacgcggtactttcgctacggtacctcgaaagttcgacggactaaccgtaagacggtaccgtttaaccgcgtacccaacgtttccgtacgtacgtccttcgggacttcggtaagaacggtaggtatnnnnnnnnnnnnnnannnnnnnnnnnnnnnnnnnnnnnn

SEQ ID NO: 156607 - DNA, 743 bp, Homo sapiens
  misc_feature: GYAE6OF01CZUV5.44.33.C11.1.454.CMB.1.raw
  modified_base (190)..(190): a, c, t, g, unknown or other
  misc_feature (190)..(190): n is a, c, g, or t
  modified_base (641)..(641): a, c, t, g, unknown or other
  misc_feature (641)..(641): n is a, c, g, or t
tcagacagtatatacacgaccggtgctcgatttagagtgagctcgttggggtttggggagcttcagctggtgggtagagaagacaggactcgaggacatctccagcatcggccacgtccttccctcctccctcctccacccctcctccactctactggtgcgacgggtccgtcgggccctagtctgtagntgtctcacgtcccacctcgacggtcgtcggtccggggaccccggcggacgggtacaccgtacttccgttcgttcgttacgtaggaaacggtacgtactatagtacgtcttagttactcgtacgtacgtacggtacggttacggtaccggtaccgtacccgtaccggacccgtaccccgggtaccccgtaccctttaccgttacttaccgtactcgtacctaacctaccgtacgtaccggtccgtcccggtacggtacccggtccctaccgtctaccgttctaccgggtcgtacccgtacgttacgtcgtccggtaaccgtaactaccggtacgtacgaccgttccgacgtcctcttacgtctacctcgtacgtagtgtacgcgtgcgtactgtaatcttaaggctcacgtgtacgaggtgtacggtaggaccgtaccggacgggttaccgngggttcgggtccggacgggaccggtacgtaacggtacggttcccggtaaccgttcgggaccgtcggtaccacccggtacctcccgggtcccgtccgtacccg

SEQ ID NO: 156608 - DNA, 671 bp, Homo sapiens
  misc_feature: GYAE6OF01EJSRH.44.33.C11.1.454.CMB.1.raw
tcagacagtatatacacgaccggtgctcgatttagagtgagctcgttgggtttggggagcttcagctgtgggtagagaagacaggactcaggacgatctccagcatggccagcttccctctcctcctcaccctcctcactcactgtgcagggtcctgggcccagtctgtgatgtctcagccaccctcagcgtcgtcgggacccccgggcgacgggggtcaccgatctcttgttctggaagaagtccaatatcggattcttatcctgtcaacgtggtacgtcggggacctcccgaggccacccggccccccgtacttcctttactcttatcgacttaactaactcgacgccggccctcggaccgggtccctcgtcccgtattccgtcgtcggtcctaccgtaacgtcgtacggtacctaacgtaccgacggtccttaaccgtcggaccttacgccgttacgtactcctaccgtacgtcgttaggacggtagtacggtagtcgttagtactttacgtacgttcgtcgacgtaggacgtaggtacgggagtacggaacggtacggaccgggtacggcggttagggtcggtcgggacgggtacgggaaccgttagggtacgtaccggtacgtacggtccgaccggaccgacggtccgtcccggtccccgtaccgg

SEQ ID NO: 156609 - DNA, 831 bp, Homo sapiens
  misc_feature: GYAE6OF01C722T.44.33.C11.1.454.CMB.1.raw
  modified_base (254)..(254): a, c, t, g, unknown or other
  misc_feature (254)..(254): n is a, c, g, or t
tcagacagtatatacacgaccggtgctcgatttagagtgagctcggttggggtttgggggggggaagctcagcttcagctggtgggtagagaagacaggactcaggacgactctccagcatcggccagtccttccctctcctcctccaccctcctcactcactgtcgcgacgggtcctcggcctagttcgtgtcgtatcgtcctacaccgcccaccctcgcggtccggttccgggtcccggggacccccggggnggaacggggtccacctacttccgtccgtggacgtacggagggacgactacgactaccgaacgtacgtacgggactagtacttcgagtactccgtaccacggttaccggtaacccaaccgtaccgttaaccggaaccgaacctaccccgtaacccctaaaccttcccgtaactttacgttaaccgtttaacggaaaccctaaacggttccgtacccggtcccgtaccggaccgggttaccctcgtaaccgttcgttcgtcggtcgacctacgaccgtcgtaccgacctaccgtcctaccgtccccgtcgtaccgtacctctacgtaccggtccggtaaccgtcggtacggtcgtaaacgtaagtcggtacgggttacgggtacttaacgtttacgtcgtacccgtaccgtaacgttactaacggtacgacgacggtaccgtaccgtccgggttccgggttaaggggtttccggggtttcgggtaaccggggttcggggacccgggttaaaccgggtaccggtaaccgtcgggttaacccggtacccggggttcggtaaacccggcggtaaccccgggg

SEQ ID NO: 156610 - DNA, 829 bp, Homo sapiens
  misc_feature: GYAE6OF01AK81C.44.33.C11.1.454.CMB.1.raw
tcagacagtatatacacgaccggtgctcgatttagagtgagctcgttgggtttggggggggaagctcagcttcagctgtgggtagagaagacaggactcaggacgatctccagcatggccagcttccctctcctcctcaccctcctcactcactgtgcagggtcctgggcccagtctgtgatgtctcacgccaccctcagcgtctcggggacccccggcgaggggtcaccatctcttgtctggaaggacgtcaatacgtcgatcttatcctgtcaactggtagtcgggactcccgaggccgaccggccccccgactccgttatctatcgctactatcgcgtccggtccctcgacgggtcccctcggcccgactttccgtccgtcgggccctacccgtaacggttccgtcgggacctacgtaacccgtacgggtacccttaacccgtcgggaccctacgttccccgtttacggtaaccctttcccgttaccccgtacgttaccggttacggtaacgggtacggtttacgggtaacggtccgttaacggtaacttttaacccgttaccggtttacggttacggaccgttaacgggaccttaaggtacggggtacgttaacgggtaaccggaacccgggtaccgggggaaccggggttcccgggttaggggggttacccggggtttcccggggggaaaccgggggttaacccgggggtaaacccggttaacccggggttttaaccgggtaacccccgggtttacccgggttaaaccgggaccccggtttaaccggggaaccccccgggttaaaccgggttacccccccgggg

SEQ ID NO: 156611 - DNA, 878 bp, Homo sapiens
  misc_feature: GYAE6OF01D6FEE.44.33.C11.1.454.CMB.1.raw
tcagacagtatatacacgaccggtgctcgatttagagtgagctcgttgggtttggggagcttcagctgtgggtagagaagacaggactcgaggacgatctccagcatggccagtcttccctctcctcctccaccctcctcactcactgtgcgagggtcctcgggccagtctgtgtatgtctcacgcccaccctcgacgtccgtcggtccggggacccccgggcggacgggggtccaccgtacgttccttcgtttcgttcgtaagggaacggtacgtaccaagttacgtcggtattccttactcgttcgtaccgtaacggttggtacggtccggggtacctacccggaacgggtccccgtacccccgggtacccccccggtactttcccgtttacgtacttaacgtccgtaccgttaaaccgttaacttccggaaccggtccccgggtacccgttcccgggtaaacccgggggttcccccttcgggtaccccgttaacgttttccgtaccggttaccgggttacccgtaccgtaaaccgggtttcgtaccggtaccgtaacccgtaaccgtaccgggtacccttacccggtccggtacccttaaccggttcccttagtacccgttccctaccggtagttcgtaaacgggtacgtacggttcgacggggtcttacggttactttaacggtacgttggtacgacgcggtaacgtcgtagggactaacggaccgggtacggtaccccggtaggggtccggttacggggtccgggtacggggaaccgggtaaccggggtaaaccgtaggtttaccggaacccggttaccgttagaccgtaaccggacccgaaccgggtaccgtcccggttcccggtacccccg

SEQ ID NO: 156612 - DNA, 853 bp, Homo sapiens
  misc_feature: GYAE6OF01AXPAP.44.33.C11.1.454.CMB.1.raw
  modified_base (201)..(201): a, c, t, g, unknown or other
  misc_feature (201)..(201): n is a, c, g, or t
tcagacagtatatacacgaccggtgctcgatttagagtgagctcgttgggtttgggggggaagctcagcttcagctgtgggtagagaagacaggactcaggacgatctccagcatggccagcttccctctcctcctccaccctcctcactcactgtgcgaggtcctcgggccagtctgtgtatgtctcacgcccaccctanagccgtccgtcggggacccccgggcgtacggggtccaccgtattcctacgttgttcgtaggaaggtaacgtacctaatacgtcggtaacttcttactccgtagtactaacgttggtaacgtaccgggtacctcccgacggcccgaccccggtaccccccgacgttaccttacttacgtacgtacgtaccttaacgtactacggtacggtcccggtccctaccggtaccgggtcccctacgtccccgtacttctaccgtcgtccgtaccgtaacgttcgtacgacctaacgtaccgtaccgtaccgttacggtccgtaaccctaaccgtttaccgttgttaaccctcccgttaaccggttacggtaccggtaaggtaccgggaacgttggtaacggtccgtagtttaaacgtttactacccggtttgaccggtatacccggtaaggttaaccggttcgggtaaacgtcggtaaacccccgggtggggtaaaccccgggttacggggttaccggttacgggggttttacggggaccccggggtaaggggtaaccccggggtttaaaccttaaccggggttacccggtaacccccggtttaggaacccggttaaccggaaccccgggttacccgggtaaccggttaccccccggg

SEQ ID NO: 156613 - DNA, 827 bp, Homo sapiens
  misc_feature: GYAE6OF01CEPYH.44.33.C11.1.454.CMB.1.raw
tcagacagtatatacacgaccggtgctcgatttagagtgagctcgttgggtttggggagcttcagctgtgggtagagaagacaggactcaggacgatctccagcatggccagcttccctctcctcctcaccctcctcactcactgtgcagggtcctgggcccagtctgtgatgtctcagcccaccctcagcgtcgtccggggacccccgggcgacgggggtcaaccgattccttcgtttcgttcgtagggaaacggtaacgttaccgaaattacgtcggtaacttactttaacttccgttgtacctaaacgttgggtacgttaccggggacctacccgacgggcccgaaccccgggtccccccgtacttccttactccttactcgtacctaactaactcgacgtccggcccgtcgtaccgggtccctcgtcccgtactttcgtcgtcggtcctaccgtaacgtccgtacggacctaaccgtacgtacggtaccgtaccgtacgggtacccttacttcccgtttaggaccctttaccgtaccgtacgttcgttaacgggaacggttacgtacggtacgggttaccgtttaacggtttaacctttaacggttaccggtttaggttaccgtaacggtacggttaccggtaaggttacggggtaattaccgggaaccggtacgggtacccgggtaacgggtcggttaccgggggtcgggttaccggggaacggggtaccgggtaaccgttaagggttacccggacccgggtttaaccgtacggtacccgtaacgacccggtaccggtcccgttcccggtccccgttaccgg

SEQ ID NO: 156614 - DNA, 631 bp, Homo sapiens
  misc_feature: GYAE6OF01EGPSD.44.33.C11.1.454.CMB.1.raw
  modified_base (206)..(206): a, c, t, g, unknown or other
  misc_feature (206)..(206): n is a, c, g, or t
  modified_base (363)..(363): a, c, t, g, unknown or other
  misc_feature (363)..(363): n is a, c, g, or t
  modified_base (443)..(443): a, c, t, g, unknown or other
  misc_feature (443)..(443): n is a, c, g, or t
  modified_base (488)..(488): a, c, t, g, unknown or other
  misc_feature (488)..(488): n is a, c, g, or t
tcagacagtatatacacgaccggtgctcgatttagagtgagctcgttgggtttggggagcttcagctgtgggtagagaagacaggactcaggacgatctccagcatggccagcttccctctcctcctcaccctcctcactcactgtgcgaggtcctgggcccagtctgtgatgtctcagccaccctcagcgtcgtcgggccccggngaggggtcacatctcttgttcaggaagatcaatagtcgattcttatcctgtacaacgttggtagtcgggacctccgagccgacccggaccccccgtacttccttactactacgtacgacttaactaatccgagcccgtcctacggtaccgggtcccncgtaccgtcttactcgtcgctacaagtcgtagacactacacggacctaccgcgtacctactcgtatacgtcctactagtntagagtgtggactcgtatactttatatgtcacaggctagttaggntacgacggacgtaccgggtacgtgggttcggtcgggttaccggggacgggtaaacgggtaccgttaagggtaccggttacccgtacggtacgggtaccacggtaccccggtaagggtcccttccccggtacccggttaccggg

SEQ ID NO: 156615 - DNA, 694 bp, Homo sapiens
  misc_feature: GYAE6OF01EB2N4.44.33.C11.1.454.CMB.1.raw
  modified_base (401)..(401): a, c, t, g, unknown or other
  misc_feature (401)..(401): n is a, c, g, or t
  modified_base (434)..(434): a, c, t, g, unknown or other
  misc_feature (434)..(434): n is a, c, g, or t
  modified_base (503)..(503): a, c, t, g, unknown or other
  misc_feature (503)..(503): n is a, c, g, or t
tcagacagtatatacacgaccggtgctcgatttagagtgagctcgttgggttggggggggaagctcagcttcagctgtgggtagagaagacaggactcaggacgatctccagcatggccagcttccctctcctcctcaccctcctcactcactgtgcagggtcctgggcccagtctgtgatgtctcagcccaccctcagcgtccgtcggggaccccgggcgtacgggggtccaccgatcctcttgttctgggaaggaagtccaaatgtcggacttctttacttcctagtctaaccgtggtacgtccgggacctccccgaggtccgaccggtccccccgtactcccgtttactactctagtccttaactactccgtagcccgtaccgtcggacgggttcccncggtccactttcgctcgggacttaccgaggtcncggacaccgtacgacgtcttacccgtaggtcccacttcccttagtcttctacgtacgttcctaggacgntacggaaggtccttagactttacgtatcgaagtcgacgattagggaacggtgtaacgcggtaaccgggccgggtaaacgggtccgggttggggttccgggtttcggggacccgggtagggtaaccccggttaaggttcgaccccgggtttacgtacgtaacccggccgggttacccaaggggttcccccgg

SEQ ID NO: 156616 - DNA, 829 bp, Homo sapiens
  misc_feature: GYAE6OF01D9VEZ.44.33.C11.1.454.CMB.1.raw
  modified_base (625)..(625): a, c, t, g, unknown or other
  misc_feature (625)..(625): n is a, c, g, or t
tcagacagtatatacacgaccggtgctcgatttagagtgagctcgttgggtttggggagcttcagctgtgggtagagaagacaggactcaggacgatctccagcatggccagcttcctctcctcctcaccctctcactcactgtgcaggtcctcgggcccagtctgtgatgtcctcacgccaccctcgacgccgtccgtccggggacccccggggcgacgggggtccacctacttccttcgtttcgttccgtagggaaacggtaacgttaccctaaagttacgtacggtacttaccttttaacgttcccgttaggttacctaaacggttgggttaacggttaccggggtacctccccgacgggccccgaccccggtacccccccgtacttaccctttacttaccttacgttaccggacctttaacctaacgtaccgaaccggtcccgggtaccccgttaccgggtacccggggttcccctaccggaccccgttacgtttccgtccggtcggtccctaccgtaacgtccggtacgacctacgtacgaccggtacctaccgtcgacccttacttccgttcgtaccttccgtacctacggttcgtaggagggtactacggacgggttnttaacgtactttaccgttacgtcggtacgccgaagtccgtaaggttcgggaacgtacggaaccggaccgggtaaccgggtacggttcgggtacggggtcggttaccggggacggtaacgggtaccggtttaacggtaccgtacccggttacgtacggcccgtaaaccgggccgtaacggtccccgtcccggtccccgttaccgg

SEQ ID NO: 156617 - DNA, 901 bp, Homo sapiens
  misc_feature: GYAE6OF01EJI1X.44.33.C11.1.454.CMB.1.raw
tcagacagtatatacacgaccggtgctcgatttagagtgagctcgttgggtttggggagcttcagctgtgggtagagaagacaggactcaggacgatctccagcatggccagcttccctctcctcctcaccctcctcactcactgtgcaggtcctcgggccagtctgtgatgtctcacgccacctcagcgtcgcgggaccccggcgaggggtcacctatcttcgttgtcgtaggaagacgtaccaatagtacggtactcgtttactcgtacgtacgtaacgttggtacgtaccggggaccttcccggaacggtaccccgaccccgggtacccccccgtactttacccgtttaactaccgttaacgttccgtaccgttaaaccgtaaacgtccgtaaccgggtccccggtaccccggttaccggtaaccggggttcccctaccggtaccccgttaacgtttccgtacgtaccgggttacccgtaccgttaaacggtttcggtaaccggacctaacccgttaccggaccggttacccgtacccggttaccggtcccttaacgttttcccggttactaccgttaccgtacccggtaacggttcgtagggtaacggtacgttacggtaacggggtttaccttaagggtaaccttttacgtacgtacggtttacgccgtaagttacgtacggttacgggtaacttaaccgggtaccggaaccgggggttaccggaacggggggttccggtttacggggggttaccggtttaccggggggaaccgggtaaaccggggttaaaccgttacgggtttaccggggaccccgtttagggtaaacccggttccggtaaaccggaccccggttaaagggtccccgttacccccgggtcccggtttaacccggg

SEQ ID NO: 156618 - DNA, 872 bp, Homo sapiens
  misc_feature: GYAE6OF01D539S.44.33.C11.1.454.CMB.1.raw
  modified_base (193)..(193): a, c, t, g, unknown or other
  misc_feature (193)..(193): n is a, c, g, or t
  modified_base (238)..(238): a, c, t, g, unknown or other
  misc_feature (238)..(238): n is a, c, g, or t
  modified_base (865)..(865): a, c, t, g, unknown or other
  misc_feature (865)..(865): n is a, c, g, or t
tcagacagtatatacacgaccggtgctcgatttagagtgagctcggttggggtttggggggggtcacaagaggcagcgctctcgggacgtctccaccatggcctgggctctgctgctcctcactctcctcacccaggacacgagggtcctgggcccagtctgccctgactcagcctgcctcgtgtcgtggtcncctggacagtccggtacacctattctccgtgcctaacgtgggacnccctaggtaccggttaatacttttcgttaacgtttacctttaacttttcgtaccttaccgttggttaactactaaacctacttacctaacgtaacccgaacggttaaaccaacccccctaaaccgttaccaacttacctaacgtttacgtaacgttacggtaccgggtaaccgttaacgtaaacggtacccgggtacccgttaccgggtttaaacggggttttaccgtaaacttccggtacctttaccgtaacccgttcgggtaccccttaacccggtaaaccggtttaccccggggaacccttaaaccccggacccgggttacccccgtaccccgttaaccgtaacccgtaacgtttaaccccggttccggttaccggggtacccgttacccggttaaccggggtaaccggtacggggtaaacccggggttaacgggtaacgggtcgtttaaccggttaagttttaacgttttacgtttacggtttaccggtacgttacgttaacggtacgtttaaccggttcgtaccgtactacgttacgttacttagtcgttacgttacggaacggttcggacgtaacggtcgtaccttcggtagccacggaccaccgacctacccgtatctcncttcccg

SEQ ID NO: 156619 - DNA, 701 bp, Homo sapiens
  misc_feature: GYAE6OF01EQ2TL.44.33.C11.1.454.CMB.1.raw
tcagacagtatatacacgaccggtgctcgatttagagtgagctcgttgggtttggggagcttcagctgtgggtagagaagacaggactcaggacgatctccagcatggccagcttccctctcctcctcaccctcctcactcactgtgcagggtcctgggcccagtctgtgatgtctcacgccaccctcacgcgtccgtccggggacccccgggcgacgggggtccaccacttccttcgtttgttcgtgggaaacggaacgtacctaattagtcggtattacttactcctgtactaacgtggtacgtcgggtacctacccgaggcccgacccggcccccctacttccttactcttacgtcgtaccttaactactccgacgtccggcccgttcggaccgggttccctcgcccgtacttccgtccgtcggtcctaccgaagtcgtcggacctacgtaccgtaggtacctaccgtcgcctacttctagtaccttcgtacctgttcgtacgacggtagtcggtacggtcttagtacctttactacgtaggtcgactagcgtaggtacggagtacgacgaccgggtaccgggtacgggtcgggtgggtcgggttaccggggacgggtacggtaacgttacgggtccggtaccggttaccgtagggacccaccggtaccggaccggtcccaccccggtcccggtaccg

SEQ ID NO: 156620 - DNA, 884 bp, Homo sapiens
  misc_feature: GYAE6OF01BUZ9H.44.33.C11.1.454.CMB.1.raw
  modified_base (728)..(728): a, c, t, g, unknown or other
  misc_feature (728)..(728): n is a, c, g, or t
tcagacagtatatacacgaccggtgctcgatttagagtgagctcggttgggtttggggagcttcagctggtgggtagagaagacaggactcgaggacgatctccagcatggccacgccttccctctcctccctccaccctcctccactcactgtcgcgacggtcccgtcgggcccctagtcgtggtgagtcgtcctaccgaccgtaccccacccgtacgacggtccggtccgggacccggggacccccggggacgggaccgggggttacccaaccgttacttccgttccgttttacggttacgtaaggggaaacggtaaccgttaacgaaacgttacggttacggtactttacctttacgttacctacggtacgtaacgggttacgggtacgggtacccggggtaccgtacccggaccgggaccccgtaccccccgggtacccccgtaccttacctttaacgtcgtttacgtacgtaacccttaaacgttaaccgaccggtaaccggtccccgggtacccgttaccgggtaccggggtacccctaccgggtccctttacgttcccgttacgtacccgggttcctaacccgtaggtccgtaccggtacctaaccggtacgtacggttaccccttaccggtaccggtacccttaacgttcctacgtttacctccgtacgtacgttgtaacggagtacggttggaccctagtttacgaactttcaggttcngaaccgtagtcgacgtaggacgtacccgggaacggtcgggaaccgggtagtcgggttacgggtaccgggtacggggaaccaaccgggttagtaccgacgggttaccacccggtaggcccgaaacgcccgtgggtcccctcccggcccgttacccgg

SEQ ID NO: 156621 - DNA, 769 bp, Homo sapiens
  misc_feature: GYAE6OF01EKFMT.44.33.C11.1.454.CMB.1.raw
  modified_base (607)..(607): a, c, t, g, unknown or other
  misc_feature (607)..(607): n is a, c, g, or t
  modified_base (625)..(625): a, c, t, g, unknown or other
  misc_feature (625)..(625): n is a, c, g, or t
  modified_base (634)..(634): a, c, t, g, unknown or other
  misc_feature (634)..(634): n is a, c, g, or t
tcagacagtatatacacgaccggtgctcgattttagagtgagctcgttgggtttggggagcttcagctgtggtagagaagacaggactcaggacgatctccagcatggccagccttccctctcctcctccaccctctcactcactgtgcgacggtccgtcgggcccagttctgtgtagttcgtctcacgcccacctcgacgtccgttccggtacccggggaccccgggcggtacgggggtaccaccgtacgttccgtttacgtttcggtttcgtaacgggtaaacggtaaccgttaccttaaagttacgtaccggttaatttaccgtttacgttccgtacgttactaacggttacggttacggtccgggtaacctacccgacgggcccgtacccccggaccccccgttaacgtttccgttacgtaccgttaacgtccgtaaccgtaactaacgtccgaccggcccgttacccgtgggtacccggtcccgtcgaccgttcttccgcgtcggccttaacgtacgttcgacggtaccacgtacgtcgtaccgtaccgtcgaccttcttacccgtagtacctcgtacgtacgttcggtagacggtgtacgngtcttaagtcttacgtcnggtcagagngtacgtgacgtaggaccgacggtggtcggacgtcgggtacggttacgggacggtacggttacctaggttacccggtcgtacggttacgccgggaaacgttacccgacggtacccgttcccggtaacccggtcccg

SEQ ID NO: 156622 - DNA, 239 bp, Homo sapiens
  misc_feature: GYAE6OF02HFAJW.44.33.C11.1.454.CMB.1.raw
  modified_base (138)..(139): a, c, t, g, unknown or other
  misc_feature (138)..(139): n is a, c, g, or t
  modified_base (141)..(141): a, c, t, g, unknown or other
  misc_feature (141)..(141): n is a, c, g, or t
  modified_base (143)..(143): a, c, t, g, unknown or other
  misc_feature (143)..(143): n is a, c, g, or t
  modified_base (146)..(146): a, c, t, g, unknown or other
  misc_feature (146)..(146): n is a, c, g, or t
  modified_base (154)..(154): a, c, t, g, unknown or other
  misc_feature (154)..(154): n is a, c, g, or t
  modified_base (163)..(163): a, c, t, g, unknown or other
  misc_feature (163)..(163): n is a, c, g, or t
  modified_base (165)..(165): a, c, t, g, unknown or other
  misc_feature (165)..(165): n is a, c, g, or t
  modified_base (170)..(170): a, c, t, g, unknown or other
  misc_feature (170)..(170): n is a, c, g, or t
  modified_base (189)..(189): a, c, t, g, unknown or other
  misc_feature (189)..(189): n is a, c, g, or t
  modified_base (195)..(195): a, c, t, g, unknown or other
  misc_feature (195)..(195): n is a, c, g, or t
  modified_base (206)..(239): a, c, t, g, unknown or other
  misc_feature (206)..(239): n is a, c, g, or t
tcagacagtatatacacgaccggtgctcgatttagagtgagctcgttgggttggggccacgagcggccctgggctgcctggtcaaggactacttccacgttctactgctgagcggcttggcaaggtcgcgagtacganncncngcngccagctnccctgcacncngtccncctctctgcgagctctcgngcgcgngcgagcgcatnnnnnnnnnnnnnnnnnnnnnnnnnnnnnnnnnn

SEQ ID NO: 156623 - DNA, 130 bp, Homo sapiens; identical to SEQ ID NO: 156542
  misc_feature: GYAE6OF02HC83H.44.33.C11.1.454.CMB.1.raw
  modified_base (130)..(130): a, c, t, g, unknown or other
  misc_feature (130)..(130): n is a, c, g, or t

SEQ ID NO: 156624 - DNA, 133 bp, Homo sapiens
  misc_feature: GYAE6OF02F40CQ.44.33.C11.1.454.CMB.1.raw
  modified_base (130)..(133): a, c, t, g, unknown or other
  misc_feature (130)..(133): n is a, c, g, or t
tcagacagtatatacacgaccggtgctcgatttagagtgagctcgttgggtttgggcacagcggccctgggctgcctggtcaaggactacttcctatatactgtctgagcgggctggcaaggcgcatagnnnn

SEQ ID NO: 156625 - DNA, 512 bp, Homo sapiens
  misc_feature: GYAE6OF02FF90T.44.33.C11.1.454.CMB.1.raw
tcagacagtatatacacgaccggtgctcgatttagagtgagctcgttgggtttgggggtcacaagaggcagcgctctcgggacgtctccaccatggcctgggctctgctgctcctcactctcctcactcaggacacagggtcctgggcccagtctgccctgactcagcctgcctccgtgtctggttctcctggacagtcgatcaccatctcctgcactgggtccagcaatgacattgggagatataaccttgtctcctggtatcaacaacatccagcaaagcccccaaactcatactttttgagtccagtgagcggccgtcaggtgtttctaatcgcttctctggctccaagtctggccacacggcctccctgtcgatctctgggctccggcctgaggcgaggctgactattactgcggctcatttacaactcttgagtacttgggtgttcggcggagggactcacctgaccgtcctaggtcagccccaaggcctgccccctcggtctaccg

SEQ ID NO: 156626 - DNA, 310 bp, Homo sapiens
  misc_feature: GYAE6OF02IQYZQ.44.33.C11.1.454.CMB.1.raw
  modified_base (308)..(310): a, c, t, g, unknown or other
  misc_feature (308)..(310): n is a, c, g, or t
tcagacagtatatacacgaccggtgctcgatttagagtgagctcgttgggtttgggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcggtcagcccaaggctgcccctggtcactctgttcccaccctcctctatatactgtctgagcgggctggcaaggcgcatagnnn

SEQ ID NO: 156627 - DNA, 130 bp, Homo sapiens; identical to SEQ ID NO: 156555
  misc_feature: GYAE6OF02GQRPW.44.33.C11.1.454.CMB.1.raw
  modified_base (130)..(130): a, c, t, g, unknown or other
  misc_feature (130)..(130): n is a, c, g, or t

SEQ ID NO: 156628 - DNA, 512 bp, Homo sapiens
  misc_feature: GYAE6OF02JHEEI.44.33.C11.1.454.CMB.1.raw
  modified_base (416)..(416): a, c, t, g, unknown or other
  misc_feature (416)..(416): n is a, c, g, or t
  modified_base (436)..(436): a, c, t, g, unknown or other
  misc_feature (436)..(436): n is a, c, g, or t
tcagacagtatatacacgaccggtgctcgatttagagtgagctcgttgggtttgggggaagctcagcttcagctgtgggtagagaagacaggattcaggacaatctccagcatggccagcttccctctcctcctcaccctcctcactcactgtgcagggtcctgggcccagtctgtgatgtctcagccaccctcagcgtctgggacccccgggcagggggtcaccatctcttgtctggaaggaagtccaatatcggatcttatcctgtcaactggtatcggggactcccaggcacggcccccgactccttatctatgctactaatcagcggccctcgacggggtccctgcccgattctctggctccaagtctggcactacaggctacctggccatccttgatctccagtctgaggntgagtctgattactactgtncagcagtgggatgacagccggacggctgggtgtcgggcggaggaccaggttgaccgtctaggtcacgccgaggtcc

SEQ ID NO: 156629 - DNA, 588 bp, Homo sapiens
  misc_feature: GYAE6OF02GUGK7.44.33.C11.1.454.CMB.1.raw
  modified_base (417)..(417): a, c, t, g, unknown or other
  misc_feature (417)..(417): n is a, c, g, or t
  modified_base (439)..(439): a, c, t, g, unknown or other
  misc_feature (439)..(439): n is a, c, g, or t
tcagacagtatatacacgaccggtgctcgatttagagtgagctcgttgggtttggggagcttcagctgtgggtagagaagacaggactcaggacgatctccagcatggccagcttccctctcctcctcaccctcctcactcactgtgcagggtcctgggcccagtctgtgatgtctcagccaccctcagcgtctgggacccccgggcgagggggtcaccatctcttgttctggaaggaagtccaatatcggatcttatcctgtcaactggtatcggggactcccgaggccaccggcccccgactcctatctatcgctactaatcagccgccctcgacgggtccctgcccgattctctggctcaagtctggcactacaggcctacctggccatccttgactcctccagtctggacgangagctagtacttactcttgtcncagcagttcgggatcggactacggacccgggaagtcggttggggtcgttccgggacgggtaacgggtaaccgtaaggttccggaacccggttccgtaacgggtccgaccggacccgtaacgggtcccgttcccggaccccccgttcggg

SEQ ID NO: 156630 - DNA, 539 bp, Homo sapiens
  misc_feature: GYAE6OF02IG2YK.44.33.C11.1.454.CMB.1.raw
  modified_base (452)..(452): a, c, t, g, unknown or other
  misc_feature (452)..(452): n is a, c, g, or t
tcagacagtatatacacgaccggtgctcgatttagagtgagctcgttgggtttggggagcttcagctgtgggtagagaagacaggactcaggacgatctccagcatggccagcttccctctcctcctcaccctcctcactcactgtgcagggtcctgggcccagtctgtgatgtctcagccaccctcagcgtctcgggacccccgggcagggggtcaccatctcttgttctggaaggaagtccaatatcggatcttatcctgtcaactggtatcggggactcccaggccacggcccccgactccttatctatgctactaatcagccggccctcacgggtccctgcccgattctctggctccgaagtctggcactacaggctacctcggccatccttgatctccagtctgaggatgaggtctgtattactactgtgcagctagtggatgacgngaccggaacggcgtgggtcgttcgggcggtacgggacctaggttcggaccgttcgtgggtcacggcccgaaggcctccgcccctcgg

SEQ ID NO: 156631 - DNA, 520 bp, Homo sapiens
  misc_feature: GYAE6OF02HAL27.44.33.C11.1.454.CMB.1.raw
tcagacagtatatacacgaccggtgctcgatttagagtgagctcgttgggtttggggggagaagctcagcttcagctgtgggtagagaagacaggactcaggacgatctccagcatggccagcttccctctcctcctcaccctcctcactcactgtgcagggtcctgggcccagtctgtgatgtctcagccaccctcagcgtctgggaccccgggcagggggtcaccatctcttgttctggaaggagtccaatatcggatcttatcctgtcaactggtatcggggactcccgaggcaccggccccccgactccttatctatgctactaatcagcggccctcgacggggtccctcgcccgattcctctcggctccaagtctggcactacagctacctggccatccttgactctccagtctgaggatgaggctgtattactactgtgcagcagtggatgacagccggacggcgtgggtgtcggcgggaggaccaggttcgaccgtcgtaggcacgcctacgg

SEQ ID NO: 156632 - DNA, 593 bp, Homo sapiens
  misc_feature: GYAE6OF02F0Z3K.44.33.C11.1.454.CMB.1.raw
tcagacagtatatacacgaccggtgctcgatttagagtgagctcgttgggtttggggagcttcagctgtgggtagagaagacaggactcaggacgatctccagcatggccagcttccctctcctcctcaccctcctcactcactgtgcagggtcctgggcccagtctgtgatgtctcagccaccctcagcgtctgggacccccgggcagggggtcaccatctcttgttctggaaggagtccaatatcggatcttatcctgtcaactggtatcggggactcccaggcaccggccccccgactccttatctatgctactaatcagcggccctcgacggggtccctgcccgattcctctcggctccaagtctggccactacaggtcctaccgtcggccatccttgactctccagtctgaggatggaggcttgacttactagtgtgcagcagtgggatagacgacggaccggaacgggtcgttggggtcggttcgggacggggaacgggtaacccggtaaggtttccggacccggttccgttaacgggttccgaaccggaccccgaagggtcccttcccggtccccccggttaccgg

SEQ ID NO: 156633 - DNA, 527 bp, Homo sapiens
  misc_feature: GYAE6OF02HK50C.44.33.C11.1.454.CMB.1.raw
tcagacagtatatacacgaccggtgctcgatttagagtgagctcgttgggtttggggagcttcagctgtgggtagagaagacaggactcaggacgatctccagcatggccagcttccctctcctcctcaccctcctcactcactgtgcagggtcctgggcccagtctgtgatgtctcagccaccctcagcgtctgggacccccgggcagggggtcaccatctcttgttctggaaggagtccaatatcggatcttatcctgtcaactggtatcgggactcccaggcaccggcccccgactccttatctatgctactaatcagcgcctcgacggggtccctcgccgattctcgtcggctccaagtctggccactacacggcctacctggccctatccttgactctccagtctgaggatggagtctgattactactgtgcagcgagtggatgacaggccggaagcgtgggtgttcggcggacgggactagtcggaccgtcgtaggtcacgccgaaggcctcgcccctcgg

SEQ ID NO: 156634 - DNA, 690 bp, Homo sapiens
  misc_feature: GYAE6OF02ISA4T.44.33.C11.1.454.CMB.1.raw
  modified_base (220)..(220): a, c, t, g, unknown or other
  misc_feature (220)..(220): n is a, c, g, or t
tcagacagtatatacacgaccggtgctcgatttagagtgagctcgttgggttgggggggaagctcagcttcagctgtgggtagagaagactaggactcaggacgatctccagcaatggccagcttccctctcctcctcaccctcctcactcacttgtgcagggtcctagggcccagtctgtgatgtctcagccaccctctagcgtctcgggaccccgggnacgggggtcaccgatctcgttgttctggaaggagtccaatctcggatcttatcctgtcaactggtatcggggactcccaggcaccggcccccgacttcctactctatcgctactaactcagcgcctcgacgggtccctgcccgtattctcgtggctcgaagtcgtggcctactacgacggtacctaccgtcggaccctatccgttagtacttaccgtacctacggttcctacggacggtaacgttggaacgggtcctacgtaacgtttaacctacgttcgttcgaccaggtactaagttacggggaattacggaaaccgtaacgggacccgggtaacgggtccggttagggggtttacggttcccggggaaccggggtaaccggggtaacccggtaagggtttaccgggtaacccggtttaccggttaacggggtacccgtaaccgggtaccccggaaagggttccccgg

SEQ ID NO: 156635 - DNA, 740 bp, Homo sapiens
  misc_feature: GYAE6OF02ITAWS.44.33.C11.1.454.CMB.1.raw
tcagacagtatatacacgaccggtgctcgatttagagtgagctcgttgggtttggggagcttcagctgtgggtagagaagacaggactcaggacgatctccagcatggccagcttccctctcctcctcaccctcctcactcactgtgcagggtcctgggcccagtctgtgatgtctcagccacctcagcgtctcgggacccccgggcagggggtcaccatctcttgttctggaaggagtccaatatcggatcttatcctgtcaactggtagtcgggactcccgaggccaccggcccccgactccttatctatgctactaatcagccggcctcacggggtccctcggcccgtattcctcgtcggtccttaccgaacggttcgtcgggcctaaccgtaccgtaacgggtacccttaacccgtcgggaccctaacgtttcccctttaggtaacctttccgttaccccgtaaggttccgttacggaacgggtatcgggtaacgggtcttacggtaactttaacgttaaccgttcgttgacctacggtaccgaaggttcgggaacttggaaccgtaacggtcccggggtaaacggtcccgggttgggggttacggttacccggggaccggggtaacggggtaacccgttaaagggtttccggaaaccccgggtttccgttaacgggtacccgtaaccgggaccccgtaaaggggtccccgttcccggtaccccccgttaccgggg

SEQ ID NO: 156636 - DNA, 594 bp, Homo sapiens
  misc_feature: GYAE6OF02F75HC.44.33.C11.1.454.CMB.1.raw
  modified_base (221)..(221): a, c, t, g, unknown or other
  misc_feature (221)..(221): n is a, c, g, or t
  modified_base (257)..(257): a, c, t, g, unknown or other
  misc_feature (257)..(257): n is a, c, g, or t
tcagacagtatatacacgaccggtgctcgatttagagtgagctcgttgggtttggggggggaagctcgtagcttcagctgtgggtagagaagacaggactcaggacgatctccagcatggccaagcttccctctcctcctcaccctcctcactcactgtgcagggtccctgggcccagtctgtgctgactcagccatcctcagcgtctgggacccccgggnagacggtcacgatcttttgtctggaagtagtccaanatcggaataattacgtatactggtatcggcaattcacaggagcggtccccagacccctcatctataggagaatcagcggcctcgagggtccctgaccgattctctgcctcaagtctggccacgtcacgccctccctggccatccaggtcggcctccgggtccgaggatggacggtctagtacttatttctggttcggtccggtgtttcggggattcgggaacctagttccctggtaacggttggtaccgttgtaccttacggtttccggggacgggaacgggtacccaaggtccgtacggaccggttacccgtaagtccgaccggtacccaaccggg

SEQ ID NO: 156637 - DNA, 139 bp, Homo sapiens
  misc_feature: GYAE6OF02HGO62.44.33.C11.1.454.CMB.1.raw
  modified_base (123)..(123): a, c, t, g, unknown or other
  misc_feature (123)..(123): n is a, c, g, or t
  modified_base (129)..(139): a, c, t, g, unknown or other
  misc_feature (129)..(139): n is a, c, g, or t
tcagacagtatatacacgaccggtgctcgatttagagtgagctcgttgggtttgggcacagcggccctgggctgcctggtcaaggactacttcctatatactgtctgagcgggctggcaggcncatagnnnnnnnnnnn

SEQ ID NO: 156638 - DNA, 600 bp, Homo sapiens
  misc_feature: GYAE6OF02HLO0H.44.33.C11.1.454.CMB.1.raw
  modified_base (239)..(239): a, c, t, g, unknown or other
  misc_feature (239)..(239): n is a, c, g, or t
  modified_base (246)..(246): a, c, t, g, unknown or other
  misc_feature (246)..(246): n is a, c, g, or t
  modified_base (313)..(313): a, c, t, g, unknown or other
  misc_feature (313)..(313): n is a, c, g, or t
tcagacagtatatacacgaccggtgctcgatttagagtgagctcgttggggtttggggggggtcacaagaggcagcgctctcgggacgtctccaccatggcctgggctctgctgctcctcactctcctcactcaggacacagggtcctgggcccagtctgccctgactcagcctgcctccgtgtctggttctcctggacagtcgatcaccatctcctgcacgtgggtccagcaatgacngttgganatataacttgtctcctggtatcaacaacatccaggcaaacgccccaaactcatcatctatgagctanagacgcctgagggtttctaatcgtcttcactcgcctacaacgtccgacaaccgaccggtcctcccgtagaaccaacttcctcgtcgggccttacgacggctaggacggacgaggtctgtaatttagttaagttgtttcgacttacgagtacgttggttcgtacgtcacgttcctaactttcttggttacgtttacgggtaacgggtcggaaccgtaagggttcctaacccggttaccgttacgggtacaaccggtacccgtaacgggacccctaacccccgttacgg

SEQ ID NO: 156639 - DNA, 545 bp, Homo sapiens
  misc_feature: GYAE6OF02GPBP0.44.33.C11.1.454.CMB.1.raw
  modified_base (425)..(425): a, c, t, g, unknown or other
  misc_feature (425)..(425): n is a, c, g, or t
tcagacagtatatacacgaccggtgctcgatttagagtgagctcgttgggtttggggggggaagctcagcttcagctgtgggtagagaagacaggactcaggacgatctccagcatggccagcttccctctcctcctcaccctcctcactcactgtgcagggtcctgggcccagtctgtgatgtctcagccaccctcagcgtctcgggacccccgggcagggggtcaccatctcttgttctggaaggaagtccaatatcggatcttatcctgtcaactggtatcggggactcccaggccacggccccccgactccttatctatgctactaatcagcggccctcacgggtccctgcccgattctctggctccaagtctggcactacaggtctaccgtggccactccttgactctccagtctgaggntggagctgacttactactgtgcagctagtgggataggaaacgccggaacggtcgtggggtgttcgggcggaagggaccaaggttcggaccgtcgtaggtcaacgcccgaggccgtcccgg

SEQ ID NO: 156640 - DNA, 689 bp, Homo sapiens
  misc_feature: GYAE6OF02F781E.44.33.C11.1.454.CMB.1.raw
  modified_base (209)..(209): a, c, t, g, unknown or other
  misc_feature (209)..(209): n is a, c, g, or t
  modified_base (251)..(251): a, c, t, g, unknown or other
  misc_feature (251)..(251): n is a, c, g, or t
  modified_base (318)..(318): a, c, t, g, unknown or other
  misc_feature (318)..(318): n is a, c, g, or t
  modified_base (332)..(332): a, c, t, g, unknown or other
  misc_feature (332)..(332): n is a, c, g, or t
tcagacagtatatacacgaccggtgctcgatttagagtgagctcgttgggtttggggagcttcagctgtgggtagagaagacaggactcaggacgatctccagcatggccagcttccctctcctcctcaccctcctcactcactgtgcagggtcctgggcccagtctgtgctgactcagccatcctcagcgtcgtcggggacccccggnagacggtcacgtattccttttgtctggaagtaggtccaaacntcggaataattacgtatacgtggtatcggactaattcaacagggacgccggtaccccagaccccctnatcctagtaggganaatcagccggcctcgaggggtccctgaccgtattctctcgccctacgaagtcctggacctaccgttccacgtccccttacccgtggccctaacttccgaaggtcggggccgttcccgggtacgaaggtacgtcgggacggtccgttagtaacgttttacgttttcgtaggtcggtccgggtcggtttaggggattacggaccgtacgttccggtagtacgggttacggtaacgttgtaccgtttacggttcggggacgggtaacgggaaccctaaaggtcccgttaacggaacccggtttaccgtaacggtaccgaaccggtaccccggtaacgggtcccgtacccggtccccccgg

SEQ ID NO: 156641 - DNA, 320 bp, Homo sapiens
  misc_feature: GYAE6OF02HY7BU.44.33.C11.1.454.CMB.1.raw
  modified_base (225)..(225): a, c, t, g, unknown or other
  misc_feature (225)..(225): n is a, c, g, or t
  modified_base (308)..(308): a, c, t, g, unknown or other
  misc_feature (308)..(308): n is a, c, g, or t
  modified_base (314)..(320): a, c, t, g, unknown or other
  misc_feature (314)..(320): n is a, c, g, or t
tcagacagtatatacacgaccggtgctcgatttagagtgagctcgttgggtttggggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactgganccagcggtcagcccaaggcccaaacccatgtccactctgttccccacctcctctatatactgtctgagcgggctggcaaggcncatagnnnnnnn

SEQ ID NO: 156642 - DNA, 564 bp, Homo sapiens
  misc_feature: GYAE6OF02GJMEG.44.33.C11.1.454.CMB.1.raw
  modified_base (386)..(386): a, c, t, g, unknown or other
  misc_feature (386)..(386): n is a, c, g, or t
tcagacagtatatacacgaccggtgctcgatttagagtgagctcgttgggtttggggagcttcagctgtgggtagagaagacaggactcaggacgatctccagcatggccagcttccctctcctcctcaccctcctcactcactgtgcagggtcctgggcccagtctgtgatgtctcagccaccctcagcgtctcgggacccccgggcagggggtcaccatctcttgttctggaaggaagtccaatatcggatcttatcctgtcaactggtatcggggactcccaggcaccggcccccgactccttatctatcgctactaatcagccggccctcgacggggtcccctgcccgattctctggctccaagtctggcactacagctacncgccatcctgactctccagtctgaggtatgaggtctagtattacttactgtgcagcagtgggatggacgacggccggaacgggcgtgggttcggttcgggcgggacggggaccgtaaggttcggacccggttacgtagggacgtacggacccgagggcctaccggtcccccgtaccgg

SEQ ID NO: 156643 - DNA, 648 bp, Homo sapiens
  misc_feature: GYAE6OF02H0S9O.44.33.C11.1.454.CMB.1.raw
  modified_base (130)..(130): a, c, t, g, unknown or other
  misc_feature (130)..(130): n is a, c, g, or t
  modified_base (382)..(382): a, c, t, g, unknown or other
  misc_feature (382)..(382): n is a, c, g, or t
tcagacagtatatacacgaccggtgctcgatttagagtgagctcgttgggtttggggggggaagctcagcttcagctgtgggtagagaagacaggactcaggacgatctccagcatggccagcttccctntcctcctcaccctcctcactcactgtgcagggtcctgggcccagtctgtgatgtctcagcccaccctcagcgtctcggggacccccgggcagggggtcaccatctcttgttctggaaggagtccaatatcggatcttatcctgtcaactgtatcgggactccaggccacggccccccgactcctatctatgactactaatcacgcggcctcgacgggtccctgcccgtatttcctctcggctccaagttccnggcactacacgggtcctaccgtggaccctattcccttagacttctaccgagtctggaggattgggaggtcttagttaacttaccgtaacgttgtagacctagccgtagtaggggacttacggaaccgtacgggacccgggaacggtccggttaggggggttcggttaccggggaccggggtaacggggtaaccccgttaacgggttaccgggaccccggttaccggttacgggtaacccgaccggtaccccggaagggttcccccg

SEQ ID NO: 156644 - DNA, 737 bp, Homo sapiens
  misc_feature: GYAE6OF02IMOXA.44.33.C11.1.454.CMB.1.raw
tcagacagtatatacacgaccggtgctcgatttagagtgagctcgttgggtttgggggagcttcagctgtgggtagagaagacaggactcaggacgatctccagcatggccagcttccctctcctcctcaccctcctcactcactgtgcagggtcctgggcccagtctgtgatgtctcagccaccctcagcgtctcgggacccccgggcagggggtcaccatctcttgttctggaaggagtccaatatcggatcttatcctgtcaactggtatcggggactcccgaggccaccggcccccgactcccttatctatcgctactaactcagccggccctcgacggggtccctgcccgattcctcgtcggcctccgaacgttctggcctactacgacggtcctaccgtcgggaccctacttccctttacggaacttccctaccctacggttccgtagggacggtaagttggaacgggtcttagtaaacttttaccgtaccgttgtacgccgtagtaccgtagggttgggtaactcggtaacgaccggggtacccgggaaacccgggtcggttacggggggtttccggttaccgggggaccgggtaaaccgggggtaacccgttaaacggggtttcccgggtaacccccgggttacccggttaacggggttacccggtaaccgggtacccccggtaaacggggtccccgttaccccgggttccccccccggttaacccggg

SEQ ID NO: 156645 - DNA, 696 bp, Homo sapiens
  misc_feature: GYAE6OF02JJK0Y.44.33.C11.1.454.CMB.1.raw
tcagacagtatatacacgaccggtgctcgatttagagtgagctcgttgggtttggggggggaagctcagcttcagctgtgggtagagaagacaggactcaggacgatctccagcatggccagcttccctctcctcctcaccctcctcactcactgtgcagggtcctgggcccagtctgtgatgtctcagccaccctcagcgtctcgggacccccgggcgagggggtccaccgatctcttgttctggaagagtccaatatcggatcttatcctgtcaactggtatcggggacctcccgaggccaccggccccccgactccttatctactgtctaactaatcagccggcccctcgacgggtccctcgcccgtactttcgtcgtcggcctaccgtaacgtctaggtcccaaccgttaccgaacggtccttaacccgtcggacccctagtcccttggacttccttaccgacggttcaggacggtactacggacggtccgttagtaacttttaaccgtcgtacggttcgaccgtagaccgtaagtggggtacttacgggaaccgtaaccgggacccgggtaaaccgggtcggtttacgggggtcggtttacgggggaaccgggtaacggggtaacccgttacggtttaccggacccggttaccggtaaccggtacccgaccggtacccgaacgggtccccg

SEQ ID NO: 156646 - DNA, 631 bp, Homo sapiens
  misc_feature: GYAE6OF02G2JX8.44.33.C11.1.454.CMB.1.raw
tcagacagtatatacacgaccggtgctcgatttagagtgagctcgttgggtttggggagcttcagctgtgggtagagaagacaggactcaggacgatctccagcatggccagcttccctctcctcctcaccctcctcactcactgtgcagggtcctgggcccagtctgtgatgtctcagccaccctcagcgtcgtcggggacccccgggcgacgggggtcaccatctcttgttctggaaggaagtccaatatcggatcttatcctgtcaactggtatcggggactcccgaggcacccggcccccgactccttatctatcgctactaatcacgccggccctcgacggggtccctcgcccgtattcctcgtcggtctaccgaagttccgtggcctaactacgacggaccttacccggtcggaccctacgttcccttagtacttcctccgtacgttcgtaggaggtacgtggacggtcgttagtaactttactacgtcggtcgcgacgtacgtagtgggtactgaacgacggaccgggaacggtcggtggggtcggttacggggcggacgggtaccgaggttcgaccggttaccgtaggtaccgacggacccgacggtccgtccgccccgtcgg

SEQ ID NO: 156647 - DNA, 771 bp, Homo sapiens
  misc_feature: GYAE6OF02G0SA7.44.33.C11.1.454.CMB.1.raw
tcagacagtatatacacgaccggtgctcgatttagagtgagctcgttgggtttggggggggaagctcagcttcagctgtgggtagagaagacaggactcaggacgatctccagcatggccagcttccctctcctcctcaccctcctcactcactgtgcaggtcctgggcccagtctgtgatgtctcacgcccaccctcagcgtcgtcgggacccccgggcgacgggggtccaccgatctcttgttcgtggaaggagtaccaatagtcgattcttatcctgtactaacgttggtacgtccggggacctcccgacgggcccgtaccccggacccccccgtacttcccgtttaactccgttatcgtaccttaactaacgtaccacggtcccggccccgtaccggtaccggggttcccctcggtaccccgtatttccgtcgtcggtcctaccgtaacgtcgtacggtacctacctacgacgtacccttaccggtcggtaccctacgtttcccgttctaaccgtcctaccgtacgtcgtaacgggtagacggttacggacggtacttacgttaacttaccgttacggtgttaccgacgtacgacgtagttaagggacgtacggtaaccgaacggggtacccgggtaacgggttcgggttacggggtacggggttaaccggggaccggggtaaaccgggtaacccggttaaggttcccgggttaacccggttaccggttacgggaccccgtaacccggtaccggacggttcccccgg

SEQ ID NO: 156648 - DNA, 733 bp, Homo sapiens
  misc_feature: GYAE6OF02J2WRM.44.33.C11.1.454.CMB.1.raw
  modified_base (598)..(598): a, c, t, g, unknown or other
  misc_feature (598)..(598): n is a, c, g, or t
  modified_base (604)..(604): a, c, t, g, unknown or other
  misc_feature (604)..(604): n is a, c, g, or t
tcagacagtatatacacgaccggtgctcgatttagagtgagctcgttgggtttggggagcttcagctgtgggtagagaagacaggactcaggacgatctccagcatggccagcttccctctcctcctcaccctcctcactcactgtgcacgggtcctgggcccagtctgtgatgtctcacgccaccctcgacgtcgtccgtcggggaccccccgggcgtacgggggtccaccgtagttccttccgtttggttccgtagggaaacggtaacgttacctaagttacgtcggtaacttcttaacttccgtcgttacgaacgttggttacgtaccggggtaccttaccccggaggtcccgacccggtcccccgtacgttcccttagtcctacgtcgacttactaactccgtaacggccgttcccgtacggtaccgggttccctacgaccgttactccgtcgtcggtacctaccgtaacgtcgtcggtacctaccgtcgtaccgtcccttccgtcgacctacgtccgacggtccggtactcgaacggtctagacggtagtcggtaggtcttacttacgtcgtcgtacgtctacgtagtacgancgtacncgtccgtagtacggtttggtacggttccggtacgggccgtaacggtaccgacggttcgtccggtaaccggttcggtaccggccgtaaccggcccggtaacggtcccgttacccggtcccggttaacccg

SEQ ID NO: 156649 - DNA, 689 bp, Homo sapiens
  misc_feature: GYAE6OF02GZTRQ.44.33.C11.1.454.CMB.1.raw
  modified_base (246)..(246): a, c, t, g, unknown or other
  misc_feature (246)..(246): n is a, c, g, or t
tcagacagtatatacacgaccggtgctcgatttagagtgagctcgttgggtttggggggggtcacaagaggcagcgctctcgggacgtctccaccatggcctgggctctgctgctcctcactctcctcactcaggacacagggtcctgggcccagtctgccctgactcagcctgcctccgtgtctggttctcctggacagtcgatcaccatcctcctgcactgggtccagcaatgactgttggganatataacttgtctcctgtatcaacaacataccaggacaaaccgaccccctaaactcctattacttttgacgtccagtgacgcggccgtgtaggttgttactaacgtcgtcttctcgtcggtctaccgtaacgtctcggcccacgtaccggtccctccgtgtacgtactcgtcggtcggtccgtaccggtcgtacggacgggtaccggacggtccttacgtaacgtttacgttaccgtcggtaccggtccttacttaacgtttaacctaaccgtttcgttaggtacggttaccggtttcggggttacggttaccggggaccggggtaacggtacccgttaccgtacccgttacgggtacccggttaccggtacggtaccgtaaccgtaccccggtaacggttccccgttacccggtccccccggtttacggtaccgtaccccgg

SEQ ID NO: 156650 - DNA, 637 bp, Homo sapiens
  misc_feature: GYAE6OF02F17BC.44.33.C11.1.454.CMB.1.raw
  modified_base (251)..(251): a, c, t, g, unknown or other
  misc_feature (251)..(251): n is a, c, g, or t
tcagacagtatatacacgaccggtgctcgatttagagtgagctcgttgggtttggggagcttcagctgtgggtagagaagacaggactcaggacgatctccagcatggccagcttccctctcctcctcaccctcctcactcactgtgcagggtcctgggcccagtctgtgatgtctcacgccaccctcagcgtcgtcgggacccccgggcgacgggggtcaccgatctcttgttctggaagagtccaatancgatcttatctgtcaactgtagtcggactccagcacgcccccgactcctatctatcgctaactaactcacgccggccctcgacgggtccctacgcccgtattccgtcgtcggtcctaccgtaagtccgtaggaccacgtaacgacggtcctaaccgtcggacctacttcccttagacttactaccgtacgtcgtagaaggtagtcggacgtcgtagtacttaacgtacgtagtcgacgagacgagtcgggatacggacgacgggacggaacggtcggttagggtcggttcgggacgggtaacgggtaccgtaaaggttcggtaacccggtacgttacggtaccgacggtacccgtaacggcccgttacccggtcccccgttaccgg

SEQ ID NO: 156651 - DNA, 885 bp, Homo sapiens
  misc_feature: GYAE6OF02I61JX.44.33.C11.1.454.CMB.1.raw
tcagacagtatatacacgaccggtgctcgatttagagtgagctcgttgggtttggggggggtcacaagaggcagcgctctcgggacgtctccaccatggcctgggctctgctgctcctcactctcctcactcaggacacgagggtcctgggcccagtctgccctgactcagcctgcctccgtgtctggttctcctggacagtcgatccacctatcctcctgctacgtcggggtccaggactaagtcgacagtttaggggaagattaacttaaccgtttcggtccttacccgttagggttaacttaccaaaacctaaacctaacgttaccccgaaggaacccaaaacccggtaaccccccctaaaaccttaccgttaaacgtttaaccgtttttttacggaacggttaccctaagggttacggacgggtccgggtaccccggttacggtacgggttttcgtttaccgttaaacgttccgtaccttttccgtccggttcggtcccgttaccgtaacggttccgttacgggaccccaaccggtaccccggtcccctttccccggttaccggttaccgtaaccgtttcccgttccgggttacggggtcccggttccccgggtccgtaacggggtacgggtaccggtaacggtccgttacgtaaccgtttaacgtttaccggtcggtccggtcctttacgtaaaccgttttaacctaaccgttttccgttacgggttaacgtttaccggggttttaggggtttccgggtttaccgggtacggggtaaccgggttcctaccggtaccgttacggtacccgttaccggtaccgtacgtacccggacccgaaccgggtccttccccgggtcccccgtacggtcccttaccccg

SEQ ID NO: 156652 - DNA, 780 bp, Homo sapiens
  misc_feature: GYAE6OF02HJ8CH.44.33.C11.1.454.CMB.1.raw
tcagacagtatatacacgaccggtgctcgatttagagtgagctcgttgggtttggggggggaagctcagcttcagctgtgggtagagaagacaggactcaggacgatctccagcatggccagcttccctctcctcctcaccctcctcactcactgtgcagggtcctgggcccagtctgtgatgtctcagcccaccctcagcgtcgtcggggacccccgggcgacgggggtcaccatctcttgttctagggaagaagtccaatatcggattcttatcctgtacaacgttggtagtccggggacctcccgaaggccacccggccccccgtacttccttactctactcgactactaatcgagccggccctcggacggggtccctcggcccgtatttcctcgtcggcccttaccgaacgttctacggacctaacgtaacgacggtcccttaacccgtcggtacccctacgtttccccgttacggtaaccttcccgtaacccgtaggttaccggttagggaacggtaagttcgggtaacgggtcctttaagtaacttttaccgtaaccgttggtaccggaccgtaaggtcgtaaggttacggggtaactacggtaaaccggaccgggtaacccggggtaacgggtcgggtttacggggggtttaccggtttcccggggggaaccggggtaaacgggggtaaacccgttaaggggtttacccgggtaacccggtttacccgggtaacggggtacccgaacccgggtaccccggtaacgggtccccg

SEQ ID NO: 156653 - DNA, 711 bp, Homo sapiens
  misc_feature: GYAE6OF02IFEW5.44.33.C11.1.454.CMB.1.raw
tcagacagtatatacacgaccggtgctcgatttagagtgagctcgttgggtttggggagcttcagctgtgggtagagaagacaggactcaggacgatctccagcatggccagcttccctctcctcctcaccctcctcactcactgtgcagggtcctgggcccagtctgtgatgtctcagccaccctcagcgtcgtcgggacccccgggcgagggggtccaccatctcttgttctggaaggagtccaatatcggatcttatcctgtcaacgtggtaagtcggggacctcccgagccaccggccccccactcccttatctatcgctactatcacgccgtccctcgcgggtcccctcgcccgtattctccgtagtcctcctaagtcgtcggctaccgtacgacggtcctaccgtcggtaccctactttccgttcgaccttccgtaccctcggttaccttgggaacggtacgtcgggaacggttcgtacgttaagtttaccgttacttaccgggttgaacccgacgcggtaagttacggggtacgtaacggtaccgacgggtaacccgggaacggggttcgttacgggggtacggttcggggaacgggtaccggggaaccgttaaccgggtttaccgaacccgggttccgttaacggggttacccacgggtaccccgtaacggggcccccttacccggtccccccggttaaccgg

SEQ ID NO: 156654 - DNA, 646 bp, Homo sapiens
  misc_feature: GYAE6OF02HSZE7.44.33.C11.1.454.CMB.1.raw
  modified_base (228)..(228): a, c, t, g, unknown or other
  misc_feature (228)..(228): n is a, c, g, or t
  modified_base (240)..(240): a, c, t, g, unknown or other
  misc_feature (240)..(240): n is a, c, g, or t
  modified_base (397)..(397): a, c, t, g, unknown or other
  misc_feature (397)..(397): n is a, c, g, or t
  modified_base (437)..(437): a, c, t, g, unknown or other
  misc_feature (437)..(437): n is a, c, g, or t
tcagacagtatatacacgaccggtgctcgatttagagtgagctcgttgggtttgggggggggtcacaagaggcagcgctctcgggacgtctccaccatggcctgggctctgctgctcctcactctcctcaccaggacacagggtcctgggcccagtctgccctgactcagcctgcctccgtgtctgggtcgcctggacaggtcggtcaccatctcctgcacgtgggancagactccaaanagtcgggacagtattctagatgtccacgtcggtaccaactaccttaccgaaggaacaccgaccccaaacctcctctacttcgttacgtaacaactacgtccgccctcgacgggtcctcgaccgtactctcgtggctacaacgtctcggcacctcacnccctccgtcgccatcacgtcgggcctccgagcgtagaagngaggtagggtatagttagttactacgccgtacgtcctaagtacgacgacgacgtacgtaccgtcgtaggtttcgggttgggttcgggttccggggaccggggtacgggaaccggtaacggtccggtaccggtaccggttacccggttacgggtacccgtaccggtcccggtaaaccggtccgtaccccggtcccccggtcggttacccg

SEQ ID NO: 156655 - DNA, 865 bp, Homo sapiens
  misc_feature: GYAE6OF02G6IAL.44.33.C11.1.454.CMB.1.raw
tcagacagtatatacacgaccggtgctcgatttagagtgagctcgttgggtttggggaggcttcagctgtgggtagagaagacaggactcaggacgatctccagcattggccagcttcctctcctcctcaccctcctcactcactgtgcagggtcctgggccagtctgtgatgtctcacgtccaccctcgagcgtcgtcgggaacccccgggcgacgggggtccaccgattccgttcgttgttcctagggaacgtaagtaccaatacgtcggtatactttactccttgtacaacgtggtacgtcggggacctcccgagggcccaccgggtccccccgtaacttcccgttaatactagtcgtacctactaacgtccgacgtcccggccctacggaccgggttccctcgaccgtacttccgtcgtcggcttaccgtagttccggtcggacctaaccgttccgaccgttccctacccgtcggtacccacttccggaccggttcgggtccccgttaccggacggtccgttaaagggtaaacggtacggttacgggggtaaggggttaactttaaacgttttaccgtttaaccggtcggtaacccgttaaacggtttccgttaaggtaccgtaaacggtccgtacccggttaacgtcccgtttaaacggttggggtttccggggttttaacgggggtcccgggtttaacggggggacccgggtaaccggggttaacccgtaaacggggttcccggttaaccggggtaccccggggtttacccggtttcgggggaaccccggttaacccggggtaccccggtaaccggggtttccccggttaccccccggtttaccccccgggttcccggg

SEQ ID NO: 156656 - DNA, 611 bp, Homo sapiens
  misc_feature: GYAE6OF02GURNS.44.33.C11.1.454.CMB.1.raw
  modified_base (329)..(329): a, c, t, g, unknown or other
  misc_feature (329)..(329): n is a, c, g, or t
  modified_base (378)..(378): a, c, t, g, unknown or other
  misc_feature (378)..(378): n is a, c, g, or t
tcagacagtatatacacgaccggtgctcgatttagagtgagctcgttgggtttgggggggggaagctctgcttcagctgtgagcgcagaaggcaggactcgggacaatcttcatcatgacctgctcccctctcctcctcacccttctcattcactgcgcagggtcctgggcccagtctgcattgacgcagccgccctcagtgtctgcggccccaggacagagcgtcgccatcctcctgctctaggaaacaactccaacattggtacgtaatcatgttacataggtaaccaaaagtcgactggcctcggacccctaaagtcctcatttangagaatcttacgaccggcccaccgtggactctctcgaccgtattctctntcctactaagtcgtacgtaactttcacgtcctacgtttcggcctactccgaacccgacctccgagaccgtggacgacggacggccgtaattacgtagtttggttgggtcgttacgggcctccgtacgtcgtttggggtgggtttcggggtttcggacgggtacggggtacccgtacgtccggtacccgttaccgtaacgtcgaccgtacccgtaaggtcccgtccgtcccccg

SEQ ID NO: 156657 - DNA, 720 bp, Homo sapiens
  misc_feature: GYAE6OF02GZ3J6.44.33.C11.1.454.CMB.1.raw
  modified_base (218)..(218): a, c, t, g, unknown or other
  misc_feature (218)..(218): n is a, c, g, or t
  modified_base (255)..(255): a, c, t, g, unknown or other
  misc_feature (255)..(255): n is a, c, g, or t
tcagacagtatatacacgaccggtgctcgatttagagtgagctcgttgggtttggggggggaagctcagcttcagctgtgggtagagaagacaggactcaggacaatctccagcatggccggcttccctctcctcctcaccctcctcactcactgtgcagggtcctgggcccagtctgtgctgactcagccatcctcagcgtcgtcgggacccccggnagacggtcacgatcttttgtctggaagtcggtccaanatacggtaataattacgtatacgtaggtactcggactaattcacgaggacgccggtaccccacgacccctcacttctaagtagggagtaatcgacggccggccctcggtacggggtccctaggacccgtattcctctcgtccctactagtctacggctaccgtcgaccgtcccgtcccgtcggcctacgtcgtacgggttcgggcccgttccgggtaccggagggtacgtcgggacggtcttaggttaattttacgtttcgttcggtcgggtgggttacccggttggggtactacggtaaccgtacgttaccgtgggttacggtcggtacgttgttaccgttacgggtttccggggggaaccgggtaacggggaaacccggtacggtacggttaacccggtaccccgggtttaaccggtaaacggtaccccggtaacccgggtacccggtaaccgggtcccccgg

SEQ ID NO: 156658 - DNA, 767 bp, Homo sapiens
  misc_feature: GYAE6OF02GN2XT.44.33.C11.1.454.CMB.1.raw
tcagacagtatatacacgaccggtgctcgatttagagtgagctcgttgggtttggggagcttcagctgtgggtagagaagacaggactcaggacgatctccagcatggccagcttccctctcctcctcaccctcctcactcactgtgcagggtcctcgggccagtctgtgatgtctcagccacctcagcgtctcgggacccccgggcgagggggtcaccgactctcttgttcgtggaaggagtccaatagtcggatcttaactcctgtcaacgtggtattcggggacctcccgaggccacccggcccccgtactccttatctactcgccttaactaactcgacgccggccctacggacggggtccctgcccgtagttccgtcgtcgggtacctaccgtaacggttcgtacgggacctacgtaacgacggtacccttacccggtcgggacccctaacgttcccgttaggacctttccgtccctaaggttcctaacgggaacgtaacggtcgggtaaccgggtcttaaggtaaactttaaccgttacgtcggtacgtcggtaagccgttaaggttacgggacgttacggaaccgtaaaccgggccgggtaaacgggtcggttcgggggttacgggttccggggaacgggtaacggggtaacccggttaagggtttcccggtaaaccccgggttccgggtaacgggttacccgaaaccgggtaccccggtaaacggggtccccggttacccggtccccccgttaaccggg

SEQ ID NO: 156659 - DNA, 141 bp, Homo sapiens
  misc_feature: GYAE6OF02JPSAQ.44.33.C11.1.454.CMB.1.raw
  modified_base (108)..(108): a, c, t, g, unknown or other
  misc_feature (108)..(108): n is a, c, g, or t
  modified_base (123)..(123): a, c, t, g, unknown or other
  misc_feature (123)..(123): n is a, c, g, or t
  modified_base (129)..(130): a, c, t, g, unknown or other
  misc_feature (129)..(130): n is a, c, g, or t
  modified_base (133)..(141): a, c, t, g, unknown or other
  misc_feature (133)..(141): n is a, c, g, or t
tcagacagtatatacacgaccggtgctcgatttagagtgagctcgttgggtttgggctacagcggcctgggctgcctggtcaaggactactcctatatactgtctgancgggctggcaaggcncatagnnatnnnnnnnnn

SEQ ID NO: 156660 - DNA, 713 bp, Homo sapiens
  misc_feature: GYAE6OF02G728G.44.33.C11.1.454.CMB.1.raw
  modified_base (306)..(306): a, c, t, g, unknown or other
  misc_feature (306)..(306): n is a, c, g, or t
tcagacagtatatacacgaccggtgctcgatttagagtgagctcgttgggtttggggagcttcagctgtgggtagagaagacaggactcaggacgatctccagcatggccagcttccctctcctcctcaccctcctcactcactgtgcagggtcctgggcccagtctgtgatgtctcagccaccctcagcgtctcgggacccccgggcagggggtcaccatctcttgttctggaaggagtccaatatcggatcttatcctgtcaactggtatcggggctcccaggcaccggcccccgactccttanctatgctactaatcagccgccctcgacgggtccctgcccgtattcctctcggtctaccaagtcctggtcctaacgtacgacggtcctacccgtcgggaccctacttcccgttcgtaacttcctacccgtagttccgtggaagggtacttcgggaacggtcgttaggtaactttaacgttaaccgttgttacgcgtaacgacctaggtggggtaagtcggaacgtaccgggaacccggggaaccggtacgggttagggggttaccgggttttaccgggggaccggggtaacgggggaacccggttaaacgggtttaccgggtaaccccggttaccggttaaccgggtaccgtaacccgggaccccggtaaaggggtcccgttacccgggtcccccccggttacccggg

SEQ ID NO: 156661 - DNA, 721 bp, Homo sapiens
  misc_feature: GYAE6OF02GUWD9.44.33.C11.1.454.CMB.1.raw
  modified_base (366)..(366): a, c, t, g, unknown or other
  misc_feature (366)..(366): n is a, c, g, or t
  modified_base (517)..(517): a, c, t, g, unknown or other
  misc_feature (517)..(517): n is a, c, g, or t
  modified_base (533)..(533): a, c, t, g, unknown or other
  misc_feature (533)..(533): n is a, c, g, or t
tcagacagtatatacacgaccggtgctcgatttagagtgagctcgttgggtttggggagcttcagctgtgggtagagaagacaggactcaggacgatctccagcatggccagcttccctctcctcctcacccctcctcactcactgtgcgagggtcctgggcccagtctgtgatcgtctcacgcccaccctcacgccgtccgtccggggacccccgggcggacgggggtccaccgtacttccgttcgtttcgttacgtagggaaaggaacgtaccaagtacgtcggtattcttacttccgtcgtactaagttggtacgtccggggacctcccgacggcccgaccccggcccccgtacgttaccctntactacgtacgtacctaactaactcgacgtccgcccgtacggtacgggtcccctaccggacccgtattcctcgtcgtacctacgtaacgttcgtcggacctactacgtcggtacctaccgtcgtacctacttcgtactactcgtctacgtntaggagtgtagacgtnttacgtatttaccgtagttcgtacgacgtacgtactagggtcggtaacgacggaccggacgggtaccggacggttcggtcggggttacggtacggggacggtaaccggtaacgggtaacggttccggtaccggttacggtaccggtacgccggaccgtaccggtcccgttcccggtacccgttaccgg

SEQ ID NO: 156662 - DNA, 723 bp, Homo sapiens
  misc_feature: GYAE6OF02G64LC.44.33.C11.1.454.CMB.1.raw
tcagacagtatatacacgaccggtgctcgatttagagtgagctcgttgggtttggggggggaagctcagcttcagctgtgggtagagaagacaggactcaggacgatctccagcatggccagcttccctctcctcctcaccctcctcactcactgtgcagggtcctgggcccagtctgtgatgtctcagccaccctcagcgtctcgggacccccgggcagggggtcaccatctcttgttctggaaggagtccaatatcggatcttatcctgtcaactggtatcggggactcccgaggcaccggcccccgactccttatctatcgctactaactcacgcggccctcgacgggtccctcggcccgattctcgtcggctccgtaagtctggccactcgacgtcctaccgtcggcctacgttcccttggacttccgtacctacggttccgtggtaacggtatttcgggagggttaccttcggtaaacttttaacgtacgttacgtcggtaccaggtacctaggttagggaacgtttacgggaaccgtaacggggtaacccgggtaaccggggtccgggtttcgggggtttaaccgggttacccggggggaccggggttaaacccggggggtaacccggttaaacggggtttttaccggaaccccgggttttccggtaaaccggggttacccggtaacccggtaccccggtaaacggttccccccggg

SEQ ID NO: 156663 - DNA, 760 bp, Homo sapiens
  misc_feature: GYAE6OF02GI1EE.44.33.C11.1.454.CMB.1.raw
  modified_base (215)..(215): a, c, t, g, unknown or other
  misc_feature (215)..(215): n is a, c, g, or t
  modified_base (236)..(236): a, c, t, g, unknown or other
  misc_feature (236)..(236): n is a, c, g, or t
  modified_base (431)..(431): a, c, t, g, unknown or other
  misc_feature (431)..(431): n is a, c, g, or t
tcagacagtatatacacgaccggtgctcgatttagagtgagctcgttggggtttggggagcttcagctgtgggtagagaagacaggactcaggacgatctccagcatggccagcttccctctcctcctcaccctcctcactcactgtgcagggtcctcgggcccagtctgtgatgtctcagcccaccctcaggccgtcgtcggggacccccgggngacgggggtcacctatccttnttacgttcgtaggaaggtaacgtccaaatacgcggtaattcttactccgtagtacctaacgtggtacgttcggggacctccgaggtccacccggacccctactcttactctagtcgtactaactaatcgacgtccggtccctacggtacgggtcccctgccccgtatttccacgtcggtacctccgaaggttccncggacctacgtacgacgggtactacggtcgtacctacgtccttacgtctcctacgtaacgttcgaggaaggtacgtaggtacgttacgttacgtaacctttaacggttacgttacggtacgaaccgtaacggtagttaacggtacgggtacgttacgaaccgggacgggtaacccgggtaaacggtcgggttacgggggttccgggttacggggaccgggggtaacgggtaacccgggttaaccggttaccggttaacccggttaacggttaccggtacgtaacccggtccggtaaccggtcccggtacccgtaccccccgggtaccgg

SEQ ID NO: 156664 - DNA, 865 bp, Homo sapiens
  misc_feature: GYAE6OF02IB4GI.44.33.C11.1.454.CMB.1.raw
tcagacagtatatacacgaccggtgctcgatttagagtgagctcgttgggtttggggagcttcagctgtgggtagagaagacaggactcaggacgatctccagcatggccagcttccctctcctcctcaccctcctcactcactgtgcagggtcctcggcccagtctgtgatcgtctcgacgccaccctcacgtccgtcgtcggggacccccgggcggacgggggtccaccgtatccttctttcgttacgtaggaaggaacgtaccaagtacgtacggattacgttactccgttagtaaccgtaagtaggtacggtccggggacctacccgacggccgaaccccggtacccccgtataccctttaacgtacgttaactcggtaaccttaaacgtaactacgtacggacccggtcccgtacggtaaccggggtcccttaccggacccgttatttacccgtcgttcggtaaccctacggtaacgtccgtacggtacctacgttaacgcgttacctacccggtacgtacccgtactttaccgtacgttaccgtacccgttacgtacgttacgtacggaacgggttaaacggtgggtaaccggttacgttaacgttaaacttttaaccggtacgttacgggtacgtaaaccgtacggttaccgtaacgggttagggaactaaccggtaaccgggaaccgggtaacccgggtaacgggttaccgggttggggtttaccggggttaccgggggaaacgggtaaccgggtaccgtaaaccgggtttcggaaccccgggtttaaccgtagggtaaccccgtacgggtaacccggtaacggtcccgttaacccccgggtccccggttaacccgg

SEQ ID NO: 156665 - DNA, 720 bp, Homo sapiens
  misc_feature: GYAE6OF02HLR6Y.44.33.C11.1.454.CMB.1.raw
  modified_base (212)..(212): a, c, t, g, unknown or other
  misc_feature (212)..(212): n is a, c, g, or t
tcagacagtatatacacgaccggtgctcgatttagagtgagctcgttgggtttggggagcttcagctgtgggtagagaagacaggactcaggacgatctccagcatggccagcttccctctcctcctcaccctcctcactcactgtgcagggtcctgggcccagtctgtgatggtctcacgccaccctcagcgtccgtcgggacccccgggnggacgggggtccaccgagtccttcgttgttccgtaggaaaggaacgtccaagttacgtcggaattcttaactcctgttaccaacgttggtaacgtccggggaccttacccgaggccgtacccgggccccccgtactaccctttacgacttatcgtaccttaactaactcgacgccggtaccctggtaccgggtccctacggtccgtattccgtaccgtcggtcctaccgtaaggttcgtacggtcctaacctacggtacggacccttaccggacggtcctagttacccttcgtactccttacgtacgttcgacgtaggtactaggcgtcgttaggatttaccgttacgtgacgtcaacgtacgtaagtggtagtaccgaacgacggaccggaacggttggttacgggtcgtccggggaggtaccgggtaacgaaccgggttcgtaacccgttacggtaaccgtacgacccggtaacgaacgggtccctaccgggtcccccttaacggg

SEQ ID NO: 156666 - DNA, 549 bp, Homo sapiens
  misc_feature: GYAE6OF02G9YAJ.44.33.C11.1.454.CMB.1.raw
  modified_base (405)..(405): a, c, t, g, unknown or other
  misc_feature (405)..(405): n is a, c, g, or t
  modified_base (432)..(432): a, c, t, g, unknown or other
  misc_feature (432)..(432): n is a, c, g, or t
  modified_base (434)..(434): a, c, t, g, unknown or other
  misc_feature (434)..(434): n is a, c, g, or t
tcagacagtatatacacgaccggtgctcgatttagagtgagctcgttgggtttggggagcttcagctgtgggtagagaagacaggactcaggacgatctccagcatggccagcttccctctcctcctcaccctcctcactcactgtgcagggtcctgggcccagtctgtgatgtctcagccaccctcagcgtcgtcgggacccccgggcgagggggtcaccatctcttgttctggaaggagtccaatatcggatcttatcctgtcaactggtatcggggactcccaggcacggccccccgactccttatctatgctactaatcagcggccctcgacggggtccctgcccgattcctcgtgctccaagtctggcactacaggctacctggccatccttgactctcngtctgagatgagctgtattactatgtncngcagtagggatagacgacggaccgggacggcgtgggtggttcgggcgggacgggtaccaaggttacggacccgtcgtaggtacgacggacccgagggcctccggtcccctccggg

SEQ ID NO: 156667 - DNA, 232 bp, Homo sapiens
  misc_feature: GYAE6OF02JTLCU.44.33.C11.1.454.CMB.1.raw
  modified_base (216)..(216): a, c, t, g, unknown or other
  misc_feature (216)..(216): n is a, c, g, or t
  modified_base (222)..(232): a, c, t, g, unknown or other
  misc_feature (222)..(232): n is a, c, g, or t
tcagacagtatatacacgaccggtgctcgatttagagtgagctcgttgggtttggggaagtagtccttgacacggtcgccgtctcctcagcctccaccaaggcccatcggtcttcccctggcaccctcctccaagagcacctctggggcacagcggccctgggctgcctggtcaaggactacttcctatatactgtctgagcgggctggcaaggcncatagnnnnnnnnnnn

SEQ ID NO: 156668 - DNA, 768 bp, Homo sapiens
  misc_feature: GYAE6OF02H872J.44.33.C11.1.454.CMB.1.raw
  modified_base (223)..(223): a, c, t, g, unknown or other
  misc_feature (223)..(223): n is a, c, g, or t
  modified_base (591)..(591): a, c, t, g, unknown or other
  misc_feature (591)..(591): n is a, c, g, or t
tcagacagtatatacacgaccggtgctcgatttagagtgagctcgttgggtttggggggggaagctcagcttcagctgtgggtagagaagacaggactcaggacgatctccagcatggccagcttccctctcctcctcaccctcctcactcactgtgcagggtcctggcccagtctgtgatgtctacacgccctaccctcagccgtcgtcgggacccccgggngacgggggtccaccatcttacgttcgttcgtggaaggtaacgtacctaattagtcggtattctttacgtcctgtactaacgtggttacgaccggggtaccttccgaacggtaccaccccgggtaccccctacgttccctttatccttagtacgtaccttaacttaacgtaccgacggtccggtaccctcgggtacgggtcccctcggaccccgttatttcccgtcgttccgggtaccttaccgtaacggttcgtacgtaccctacggtaccgtacggttccctaccggttcggaccttaccgtttcccgtttagaccgtttaccctacgttacccgttaggtaccggaagttcggtacgtacgggttntaacgttacttacgttaccgtcgtacgtaccgtagacgtagtcgggtaacacgggagaccgggtaccgggaacggttcgggttaaggttccggggtacggaccgggtaacgggtaacgtaacggtttaccgacccggttacggtaccggttaacgcggtaccccggagttcccccgg

SEQ ID NO: 156669 - DNA, 641 bp, Homo sapiens
  misc_feature: GYAE6OF02F4XRN.44.33.C11.1.454.CMB.1.raw
  modified_base (437)..(437): a, c, t, g, unknown or other
  misc_feature (437)..(437): n is a, c, g, or t
tcagacagtatatacacgaccggtgctcgatttagagtgagctcgttgggtttggggagcttcagctgtgggtagagaagacaggactcaggacgatctccagcatggccagcttccctctcctcctcaccctcctcactcactgtgcagggtcctgggcccagtctgtgatgtctcagccaccctcagcgtctcggggaccccccgggcgacgggggtccacccgatccttcttgttctgggaaggaacgtccaatatcggattcttatcctgtcaactggtacgtcggggacctcccgaggccaccggccccccgtactccttactctagtcgctactatcacgccgccctcgacgggtccctgaccgtattctctgcctccaagtcgtggccacctcgacgtccctcccgtcggccatccacgtcgggctccgnggtctagaagtagtaggagggtagtagtttacttacgtcgcctacgtcctagtcgacacgacgacgtcctcgtagggttggttgggtacgggttcgggacgggtaacgggaaccgtacggtaccgttaccggtacccggtttcgtaccggggtacgtaccgggaaccccgtacggggtccccgtcccggcccccggttacccgg

SEQ ID NO: 156670 - DNA, 683 bp, Homo sapiens
  misc_feature: GYAE6OF02HAMUF.44.33.C11.1.454.CMB.1.raw
tcagacagtatatacacgaccggtgctcgatttagagtgagctcgttgggtttggggagcttcagctgtgggtagagaagacaggactcaggacgatctccagcatggccagcttccctctcctcctcaccctcctcactcactgtgcagggtcctgggcccagtctgtgatgtctcagccaccctcagcgtcgtcgggacccccgggcgacgggggtcaccatctcttgttctgggaagacgtccaatatcggatcttatcctgtacaacgttggtactcggggacctcccgaggtccgacccggccccccgtacttcccgttaactcctagtcgacctactaactcgtacgccggtccctccggtacggggttcccctacggcccgtactttccgtctcggtctaccgtaagtctcggactacacgacgcttaccgtcggacctactccttgacttccgtacctagtccgtgggacgtagtaggcggttcgtagtttacttacgttacgtgtacgacctaggacgtaggttaggtaacgtggaaccgttacgggaccgggtaacggtcgggttagggtcgggttaccggacgggggttaacggaaccgtaacggttccggtacccggttcgtaacggtccgtaacccggccggtaacgccgttacccggtcccctaccggg

SEQ ID NO: 156671 - DNA, 637 bp, Homo sapiens
  misc_feature: GYAE6OF02GFQ06.44.33.C11.1.454.CMB.1.raw
tcagacagtatatacacgaccggtgctcgatttagagtgagctcgttgggtttggggagcttcagctgtgggtagagaagacaggactcaggacgatctccagcatggccagcttccctctcctcctcaccctcctcactcactgtgcagggtcctgggcccagtctgtgatgtctcagccaccctcagcgtctcgggacccccggcagggggtcaccgatctcttgttctggaaggaagtccaatatcggattcttatcctgtcaacgtggtagtcgggactcccgaggccaccggccccccgactccttagtctatcgctactaatcagccgccctcgacgggtcccctcgcccgtacttctcgtcggtctaccgaagtcctggcctactaacgacggcctacccgtcggacctacgttcccgttagtactctccctagttccgtaggagggtatcggacggtacttagtactttacgtacttgtcgtacgtagacgtagtggtacgtagacgacggaccggacggtcggtcgggttaggtccgggcgggtaacgggtaccgtaaggttccggtacccggttacgtacggtaccgacggacccgtaacggtcccgtaccggtcccccttaccggg

SEQ ID NO: 156672 - DNA, 819 bp, Homo sapiens
  misc_feature: GYAE6OF02HKZUH.44.33.C11.1.454.CMB.1.raw
  modified_base (157)..(157): a, c, t, g, unknown or other
  misc_feature (157)..(157): n is a, c, g, or t
  modified_base (228)..(228): a, c, t, g, unknown or other
  misc_feature (228)..(228): n is a, c, g, or t
tcagacagtatatacacgaccggtgctcgatttagagtgagctcgttgggtttggggggggaagctcagcttcagctgtgggtagagaagacaggactcaggacgatctccagcatggccagcttccctctcctcctcaccctcctcactcactgtncagggtcctgggcccagtctgtgatgtctcacgcccaccctcacgcgttccgtaccggggaccccccgggnggacggggggtaccaaccgtacgttccttcgtttcggttacgtacggggaaaacgggtaacgttacctaaagttaacgttaccgggtaacttttactttaaccttcccgttacggttaacccgtaaacgtttggggttacggtacccgggggtaaccttcccccggtaacgggacccgaaccccccggggtaccccccccggttaaccttcccgtttaacttcccgttaagtcgtacccttaaccgtaaacttccgaacggtccccggtccccgtaaccgggttccggggtcccgtccggtcccgtacctttccgtccgtcggtacctaccgtaagtcgtccgactacgtacgacgtcctacgtcggtaccctacttccgttagaaccttcccgtcgtacgttcgacggtaggtcgacggtacggtcgttagtacttaccgttaccgtacgtagacctagactacggtggtaacgcgaacgacgggtaccggtaacgggcggttggggtaccggtcgggtaaccgggtaccgaacgtttaccgggtcgtacccggttacgacggttaccgaccgtcccggtaagtccccgg

SEQ ID NO: 156673 - DNA, 912 bp, Homo sapiens
  misc_feature: GYAE6OF02JHGH1.44.33.C11.1.454.CMB.1.raw
tcagacagtatatacacgaccggtgctcgatttagagtgagctcggttgggtttggggggggtcacaagaggcagcgctctcgggacgtctccaccatcggcctgggctctgctgctcctcactctcctcactcaggacacgagggtcctggcccaggttctggccctgtactcgagcctgcctcgtgtctggttcctacgtggactaggtcgactcaccgtattcctcctcgactagttacgggaaacccagtcgaacggttcggaaccttagttttgggttacggtttaacttaacttacgttacggtcttaccggttaccggtaaaccgtaaaccgaacccgtaaccccgaacggtaaccgaaacccggtaacccccgaaaacgttccgtaaccgtaggtacttaccgtaacgtacgttaaacgttacgggtaacctaaaggttaacccgttacccgggtaccccgtttaacgggttaccggggttttccgtaccgggtttccgtacccgttttcgttaacccggtttcgggtttacccgttaaccgttaacggttccggttaccggaacccgtaaaaccccggttcccgggtacccttaccccggttacgtaacccgtaccgtttccgtacccgggttccggtaacccgttacccgtcgggtaacgttcgggaaaccggtacggtaccgggttccgtaacggttaaacccgtttagtcccgttaacggactaacgttccgttacgtaaaacgttaacgtaaaacggtaccaagtaaccgttaacgttaacggtttacgttacggacggggttaccgggaaccggtacaacggttcggaacccggttaccggaccggttaggacccggtaccggaaccgttcgggtacccgtcccggttaacccccggg

SEQ ID NO: 156674 - DNA, 804 bp, Homo sapiens
  misc_feature: GYAE6OF02HA3L8.44.33.C11.1.454.CMB.1.raw
tcagacagtatatacacgaccggtgctcgatttagagtgagctcgttggggtttgggggggggtcacaagaggcagcgctctcgggacgtctccaccatggcctgggctctgctgctcctcactctcctcactcaggacacgagggtcctgggcccagtctgccctgactcagcctgcctccgtgtctggttctccgtggaccagtcgatccacatcctctaggctacgtcgggtccagactaagtgacgtagttagggagtaacttaacttaaccgttcggttccttaccgttaggtaacttaccaaactaacgaactaccgacggaacctaaaacccgaacccccctaaacttacctaacgtttaaccgttttttacggaaccgttaccgttaggtacggacggtaccgggtaccggttacggttagggtttacgtttacgttaaacgttccggttacctttcgttaccggtacggttacccgttacctaaacggttccgtacggtaccccgtaaccggtcccggtccctttaccgtccgtacgtacgtcggtccggttacgggtcccgtaccggtaccggtaggtaacgggtacggtacgtaccggttacgtacggttaactacgtcgggtaccggtacttacggttaactttaaccgtaactttgtaacggtcggttaacggttgggttccggtcgggtaccgggtcggaccgtccgtaaccgtcggtaacccgttggtaaccggtacgaccggttacccgcggttacccgcccggtacccgttaccggtaccttcccgg

SEQ ID NO: 156675 - DNA, 762 bp, Homo sapiens
  misc_feature: GYAE6OF02FUMW7.44.33.C11.1.454.CMB.1.raw
tcagacagtatatacacgaccggtgctcgatttagagtgagctcgttgggtttggggagcttcagctgtgggtagagaagacaggactcaggacgatctccagcatggccagcttccctctcctcctcaccctcctcactcactgtgacgaggtcctcgggcccagtcgtgtgatcgtctcacgcccaccctcgacgcgtcgtccgggaccccggcggacggggtcaccgtactcgttcgttgttcgaggaaggtaacgtacaatacgtacggactcttactccgtgtactacgtagtacggtcgggtacctccgacgccgacccggtcccccgtacttccttacttcgtagtcgtactaactacacgtacgccgtccctacggtccggtcccgtcgacccgtattccgcgtcgtactaccggtacgtcgtacgtccgtaacgtaacgtacgtaccgttacccgtaccgtccgtaaccgtttccgttactacgttacccgttaccggtacgttcggttaacggaagttcgtacggacggttacgttacgtacgttttaccgacgttacgggttcgaaccgtggtaacgtcgggtaacggtaccgtaacgggaacgtaaccgggaccggtaaacggttcgggttacggggttccgtacggggtacggaaccgggtacggttaacccggttaggtacccgttaacgggttaccgaccggtacctaaccggtacggttacccgtacccgggttccccgtaaccgg

SEQ ID NO: 156676 - DNA, 763 bp, Homo sapiens
  misc_feature: GYAE6OF02HDXFT.44.33.C11.1.454.CMB.1.raw
tcagacagtatatacacgaccggtgctcgatttagagtgagctcgttgggtttggggggggaagctcagcttcagctgtgggtagagaagacaggactcaggacgatctccagcatggccagcttccctctccctcctcaccctcctcactcactgtgcgagggtcctcgggcccagtctgtgatcgtctcacgcccacctcgacgccgtccgtccggggacccccgggcggacgggggtccaccgtacgttccttcgtttcgttacggtagggaaggaacgtacctaagttaacgtcggtaacttcgtttaacgttccttacgtacgtaacgttacgggttacggtaccgggtacctacccggacggcccgaccccggaccccccgtaccttacctttacgtacttacgtcgtaccttaacttaacgtcgtaccggtcccggtcccgtaccggtaccggggtcccgtccgtacccgttacttcgtaccggtcgtccgtaccgtaacgttccgtcggacctacgtaccgacggtcccttaccggacgtaccctacgttccgtcgtactccgtcgtacgtacgtggaagtgtacgtcggtactacgttattacctaggtcgtacgcgacgtagtacggtggacgttaacgagacccgggtacggtaccgggtgttacggggtcggtccgggggtaaccggaccggtacggtaacggttaccgtaaccgtcggtaacgtccgaacccgggttccgacgtccccgg

SEQ ID NO: 156677 - DNA, 698 bp, Homo sapiens
  misc_feature: GYAE6OF02G096L.44.33.C11.1.454.CMB.1.raw
tcagacagtatatacacgaccggtgctcgatttagagtgagctcgttgggtttggggggggaagctcagcttcagctgtgggtagagaagacaggactcaggacgatctccagcatggccagcttccctctcctcctcaccctcctcactcactgtgcagggtcctgggcccagtctgtgatgtctcagcccaccctcacgcgtccgtcggggacccccgggcgagggggtcaccgatctcttgttctagggaaggagtccaatatcggtatctatcctgtacaactggtacgtcggggacctcccgaggtaccgacccggacccccccggacttcccttaacttaccgtactcgtaccttaacttaactccaaccggccgggcccctaccggaccggggttcccctcggtcccgtatttaccgtcgtacggtccgtaccgtaacggtcctacggacctaacgtacccgtacgggtacctacccgtcggaccctaacttccgttagacccttcctacggtcgttacgacggacggtgacggtggtactacgttacttacgtaagttcgagtacgcgacgtggttacggatacggacggaccggaccgggtaggtcggttacggggtcggtacgggacgggacggttaacgtagttacccgacgttacggtacgtaccgaccggtactcggtaccccgg

SEQ ID NO: 156678 - DNA, 867 bp, Homo sapiens
  misc_feature: GYAE6OF02H70AV.44.33.C11.1.454.CMB.1.raw
  modified_base (219)..(219): a, c, t, g, unknown or other
  misc_feature (219)..(219): n is a, c, g, or t
  modified_base (772)..(772): a, c, t, g, unknown or other
  misc_feature (772)..(772): n is a, c, g, or t
tcagacagtatatacacgaccggtgctcgatttagagtgagctcgttgggtttggggggggaagctcagcttcagctgtgggtagagaagacaggactcaggacgatctcagcatggccagcttccctctcctcctccaccctcctcactcactgtgcagggtcctggcccagtctgtcgatgtctcagccaccctcagcgtcgtcgggacccccgggngacgggggtccaaccgtacgttcctcgtttacggttacgtagggaaaacgggtaacgtacccgtaaattacggtacgggtactttacctttacgtaccgttcgtaaccgtaacgttacgggttacgtacgggggtaccttaccccggtaacggacccgaacccccgggtaccccccccgtaagtttacccccgtttaatcccggtttaactacggttaccctaaacctttaaacgttccgaaccgggtaccccggttcccgttaacccgggaaccgggggtttccccctaccgggacccccgttaagtttccgttaccgtcgggtaacccttacccgaaggtttccgtacggaccgtaccgtaacggtcggtacccttaaccggtccggtaccttacgttaccgtttcggaaaccttcccgtaacgtccggttaccgtagggtaaaccgttaggtacgtaacggtccgttaagtaaccgtttacttacggacgttcgaaacgttgaaccgtaggttacggacgttaacggaccgtaacggaccggggtaacgngttacggggttacggtccgggaggaaccgggttaacctaacgggtttcgtacccgtacggtacgttcccggaacgaccccgggttagtacccccg

SEQ ID NO: 156679 - DNA, 695 bp, Homo sapiens
  misc_feature: GYAE6OF02FKQ0U.44.33.C11.1.454.CMB.1.raw
tcagacagtatatacacgaccggtgctcgatttagagtgagctcgttgggtttggggagcttcagctgtgggtagagaagacaggactcaggacgatctccagcatggccagcttccctctcctcctcacccctcctcactcactgtgcagggtcctgggcccagtctgtgatgtctcagccaccctcagcgtcgtcgggaccccccgggcgagggggtccaccgtatcctctttgttctagggaaggaacgtccaatatcggatcttatcctagtcaacgtggtactcggggactcccgaggccaccggtccccccgacttccgttactctatcgactactatcagccgcctcgacgggtccctagccgtatcctgtcgctccgtaagtcgtcgctacgtacgcgtacctaccgtcgacctagtccttagactccgtacctaggttctggaacggtagtgggacggtcttaggtaactttaccgtacgttcggttacacgtacgtcgtaacgggttgggaactacggaaccgaacgggtacccgggtaaaccgggtgggtttcgggggtaccggtttacggggacggggtaacggggtaaccccgttaaagggtttccggaaccccgggtttacgtaaccgggtacgtaaccggtcccggtaacggtcccggtccccggtcccccgttaccggg

SEQ ID NO: 156680 - DNA, 827 bp, Homo sapiens
  misc_feature: GYAE6OF02I0SMB.44.33.C11.1.454.CMB.1.raw
tcagacagtatatacacgaccggtgctcgatttagagtgagctcgttgggtttggggagcttcagctgtgggtagagaagacaggactcaggacgatctccagcatggccagcttccctctcctcctcaccctctcactcactgtgcaggtcctgggcccagtctgtgatgtctcacgccacctcagcgtcgtcgggccccgggcgacgggggtccaccgtactcttcgttgttctagggaaaggaacgtccaagtactacggtattcttactccgttgtacctaacgttaggttacgtcggggacctcccgaacggccgaccggcccccgtactccttacgtctatcgtactacgtatcacggtccgccctacggacggggtccctcggccgtacttccgttacgtcggtccctaccgtaacggttcctcgggtaccctaacgttaccgtaacggtacccgttaaacccgtccgggtaccttacgtttcccggttagtaccgtttacccgttaccgtaacggtttccgtaaacgggtacgggttaagtaccgggtacggtaacctttacggttaactttaaccgttaaccgttgggtacgtacgaacgtcggtttaacggcgggttaccgttaacggaaccggtccggggtaaccgggtaacccgggtcgggttttaacgggggttccggggtaccggggtaacgggggtacccggggtaaacccgttaacggggtttacccgtacccggggtttaccgtaaccgggttcccggtaacggaacccccgttaaggggtcccccgtcccgggttacccccggttccgg

SEQ ID NO: 156681 - DNA, 773 bp, Homo sapiens
  misc_feature: GYAE6OF02HIVX1.44.33.C11.1.454.CMB.1.raw
  modified_base (229)..(229): a, c, t, g, unknown or other
  misc_feature (229)..(229): n is a, c, g, or t
  modified_base (550)..(550): a, c, t, g, unknown or other
  misc_feature (550)..(550): n is a, c, g, or t
  modified_base (604)..(604): a, c, t, g, unknown or other
  misc_feature (604)..(604): n is a, c, g, or t
tcagacagtatatacacgaccggtgctcgatttagagtgagctcgttgggtttggggggggaagctcagcttcagctgtgggtagagaagacaggactcaggacgatctccagcatggccagcttccctctcctcctcaccctcctcactcactgtgcgagggtcctgggcccagtctgtgatgtctcacgcccaccctcacgtccgtccgtaccggggacccccgggnggacgggggtccaccgtacttccttcgttcgttacgtagggaacggtaacgtacctaaagttacgtaccggtacttcgtttaacttccgttacgtaacctaacgttcggtaacggtaccggggtaccttcccggaacggccgaccccgggcccccctacgttcccttacgtccttacgtcgtacctaacttaacgtcgtacggcccggtcccgtaccggtaccgggtccctccggacccgtactttccgtcgtcgactaccgtaacgtcgtacgtacctactacgacggtaccttaccgtcggaacccttcgttccgttanccgttacctcgtaagtcgtagagtcgtacggtgtcttagtacttacgacgttanccggtacgacgcgttagggttacgacgttacggaaccggtaacggggtacccgagggttccggttaacggggttccggaaacccggggtaggtaaccggtaccgttacgggtccggtaacccggtcggttaacggtaacccgggaccggttacccgaggttacccccgg

SEQ ID NO: 156682 - DNA, 796 bp, Homo sapiens
  misc_feature: GYAE6OF02HTE9O.44.33.C11.1.454.CMB.1.raw
  modified_base (344)..(344): a, c, t, g, unknown or other
  misc_feature (344)..(344): n is a, c, g, or t
tcagacagtatatacacgaccggtgctcgatttagagtgagctcgttgggtttggggagcttcagctgtgggtagagaagacaggactcaggacgatctccagcatggccagcttccctctcctcctcaccctcctcactcactgtgcagggtcctgggcccagtctgtgatgtctcagccacctcagcgtcgtcgggacccccggcgaggggtcacatctcttgttcgtaggaagaacgtccaatatcggatcttatcctgtcaactggtatcgggactccgagcgaccgcccccgtactcctatctatgactactaatcgaagccgcctacgacgggtcccncgccctattctccgtcggacctaccgtaagtctacggactaacctacgacggtaccttaaccgtcggacctaacgtttccgttacgtaacttaccgttcctaacggttccggtaagggaacggtaggttacgggaacggttccgttaaacgttaactttaaccgttaaccggtagttacgaaccgaacgggtaccgtaaggttacggggtaactaacggtaacccggtaaaccgggtaaccccggggaaaccgggttcgggtttcgggggttaacggggtttacccggggaaccgggggtaaaccggggtaaaccccgggttaaacgttacccggggttaaccccggtttaaccggggtttaaccggttacccggaaacccgggttaaacccccggtaaaacgggttacccccggttaccccccgggttaaccccccggtttaacccccggg

SEQ ID NO: 156683 - DNA, 737 bp, Homo sapiens
  misc_feature: GYAE6OF02HL8XJ.44.33.C11.1.454.CMB.1.raw
  modified_base (220)..(220): a, c, t, g, unknown or other
  misc_feature (220)..(220): n is a, c, g, or t
tcagacagtatatacacgaccggtgctcgatttagagtgagctcgttgggtttggggggggaagctcagcttcagctgtgggtagagaagacaggactcaggacgatctccagcatggccagcttccctctcctcctcaccctcctcactcactgtgcagggtcctgggcccagtctgtgatgtctcacgcccaccctcagcgtccgtcgggaccccggngaggggtccaccatctcttgtcgtaggaacgacgtcaagtagtcgtattcttatcctgtactaacgtggttacgtacgggtacctccgacggccgaccccggccccccgtacttccgttactactactcgtactaacgtaactcgacgtccgcctcggaccgggtccctcgtacccgtatttccgtaccgtcgtccctaccgtaagttccgtaacggacctaacgtaccgtacgggtcccttaaccggtcggtaccctaacgtttcccgttacgtacccttacccgttaccgtacgttaccgtaaccggggttaaggacgggttacggtccggtacgttacgtaacgtttaaccgttcgttcggtacgaccgagtaccgttaggtacggtacgtaacgggaccggtaacgggaccggtacgggtcggttcgggtcgggttcggggaccgggtacggtaaccggtacggtacccgtacggttaccgtacgggtaccaccggtccggtaccgtacccgg

SEQ ID NO: 156684 - DNA, 839 bp, Homo sapiens
  misc_feature: GYAE6OF02FJ4SM.44.33.C11.1.454.CMB.1.raw
tcagacagtatatacacgaccggtgctcgatttagagtgagctcgttgggtttggggagcttcagctgtgggtagagaagacaggactcaggacgatctccagcatggccagccttccctctcctcctcaccctcctcactcactgtgcgagggtcctcgggcccagtctgtgatgtctcacgccacctcacgcgtcgtcgggaccccggcgacgggggtccaccactcttcgttgttcgtaggaacggaacgtaccaagtacgtcggacttacgtttactccgtagtacctaacgttacggtaacggtaccggggtacctacccgacgggtacccgaccccgggtacccccccgtaacgtttaccctttaacgttccgttacgttacgtaccttaaacttaaactccgaacggcccggtaccccgtacggtacccggggttccctcggtccccgttactttccgtccgttcggtacctaccgtaaacggttccgtacggtacctaacgtaaccggtacggttaccctaacccggttccggaacccgttacgttacccgtttacgtaccgttcccgttaccgtacgttacggtcggtaacggtagttcgggtacgtagttaccggtaactttaaccgttaccgtagtaccgacgtagaccgtaggtacggtaactacggaccgacgggtaacccgggtacggttacgggtcggggttccgggttaccgggacggggtaaccggtaaacccggtacggttcccggaacccggtttaacggtacggtacccggtacggtaacccggtaccggtccggttaccccggtaccccggttaccgg

SEQ ID NO: 156685 - DNA, 818 bp, Homo sapiens
  misc_feature: GYAE6OF02IRBWR.44.33.C11.1.454.CMB.1.raw
tcagacagtatatacacgaccggtgctcgatttagagtgagctcgttgggtttggggggggaagctcagcttcagctgtgggtagagaagacaggactcaggacgatctccagcagtggccagccttcctctcctctcaccctcctcactcactgtcgcgacgggtcctcgggccctagttctgtagagtcgtcctcgacgccctacctgacgtcgtaccggtccggggacccccggtcggtacgggggtaccaccctagttccgttcgtttcgttacggtagggaaacggtaacgtacccgtaagttacgtacggtacttcgttaaccttccgttagtacctaacgttcggtaccggttacggacccgttacccgacggacccgaacccccgggttcccccgtactttaccgtactacgttactcgtaacctaacttaaacgccgtacggcccgttaccgtccggtacgggtacccgcgtacccgtcgtttccgtcgtcgacctacgtaacggttcgtcgacctacggtaccgtacgggtccttaccggactccgtaacttccgttacgtaacttccgcgttaacgtcgttagggtacgtcgtgggtacgtacgttagttaccttacgtgcgttacgacgtacgtcgtagtaacgggtcgaacgggacgaacccggacgggttcggttacgggggtcggtttaccgggtacggggaacccgaaggggttaacccgttaaggggttaacccccgtaccccgggttaccggttaaccgggttaccggaaccggtacccccggggttagtaccccccggg

SEQ ID NO: 156686 - DNA, 818 bp, Homo sapiens
  misc_feature: GYAE6OF02IER4Q.44.33.C11.1.454.CMB.1.raw
  modified_base (182)..(182): a, c, t, g, unknown or other
  misc_feature (182)..(182): n is a, c, g, or t
tcagacagtatatacacgaccggtgctcgatttagagtgagctcgttgggtttggggagcttcagctgtgggtagagaagacaggactcaggacgatctccagcatggccagcttccctctcctcctcaccctcctcactcactgtgcaggtccgtcgggcccagtctagtgatgtctcacncctaccctcagcgtcgtccggggacccccgggcgtacgggggtccacctacgttccttcgtttcggttcgtagggaaacggaacgtaccgtaaattagtccgggtacttacctttactccgttagtacctaaacgttcgggttacgtaccggggtaaccctccccgacggtcccgaccccgggaccccccgtacttaccccgtttatccttagtacggtacttaacgtaaactccgtacggtccccggtcccttcgggtaaccggggttcccctccggtacccgttacttccgttcgtcgtacctacgtaacgtcgtcggactacgtacgaacggtcctaccgccggtcctacgttctgtactcctcgtagtcgtagaggtacgtaggacgttcgtacgtaacgtttactcgtacgttgaacgtagtcgtaaggtttagggaacgttacggaaccgtacccgggggaaccggtaccgggttacgggtccgggggtttacggtacccggggggtacgggttaacccgggtaacggttaaccgggttcccgggttaacccggtaaccggtttacgtaccccgggaccggtaaccggtaacccggtccccgggttacccccggtccccgttaacccggg

SEQ ID NO: 156687 - DNA, 516 bp, Homo sapiens
  misc_feature: GYAE6OF02FG47B.44.33.C11.1.454.CMB.1.raw
  modified_base (341)..(341): a, c, t, g, unknown or other
  misc_feature (341)..(341): n is a, c, g, or t
  modified_base (351)..(351): a, c, t, g, unknown or other
  misc_feature (351)..(351): n is a, c, g, or t
  modified_base (362)..(362): a, c, t, g, unknown or other
  misc_feature (362)..(362): n is a, c, g, or t
  modified_base (423)..(423): a, c, t, g, unknown or other
  misc_feature (423)..(423): n is a, c, g, or t
  modified_base (431)..(431): a, c, t, g, unknown or other
  misc_feature (431)..(431): n is a, c, g, or t
  modified_base (456)..(456): a, c, t, g, unknown or other
  misc_feature (456)..(456): n is a, c, g, or t
  modified_base (460)..(460): a, c, t, g, unknown or other
  misc_feature (460)..(460): n is a, c, g, or t
  modified_base (464)..(464): a, c, t, g, unknown or other
  misc_feature (464)..(464): n is a, c, g, or t
  modified_base (473)..(473): a, c, t, g, unknown or other
  misc_feature (473)..(473): n is a, c, g, or t
tcagacagtatatacacgaccggtgctcgatttagagtgagctcgttgggtttgggggggaagctcagcttcagctgtgggtagagaagacaggactcaggacgatctccagcatggccagcttccctctcctcctcaccctcctcactcactgtgcagggtcctgggcccagtctgtgatgtctcagccaccctcagcgtctgggacccccgggcagggggtcaccgatctcttgttctggaaggagtccaatatcggatcttatcctgtcaactggtatcggggacttcccaggcacggccccccgatccttatcctatgctactaatcagcggccctnacgggtcccngcccgtattcnctggctccaagtctggccaccctcacgccctccctggcccatcactgggctcaggctgagntgagggtnattgttactgcctagtcctatgacngcancctnggtgttggngttcggcggaggaccagcctgccgtcgtgggcacggcccagcc

SEQ ID NO: 156688 - DNA, 883 bp, Homo sapiens
  misc_feature: GYAE6OF02HN7CR.44.33.C11.1.454.CMB.1.raw
  modified_base (187)..(187): a, c, t, g, unknown or other
  misc_feature (187)..(187): n is a, c, g, or t
tcagacagtatatacacgaccggtgctcgatttagagtgagctcgttgggtttggggggggtcacaagaggcagcgctctcgggacgtctccaccatggcctgggctctgctgctcctcactctcctcactcaggacacgacgggtcctgggcccagtcctacgccctgactcagtcctgcctcgtntctggttctccgtggacagtcgactccacctatcctctagctacggtgggtaccaggcctaatcgactaggtaggactaagtaacttaaccgttgtacctccgtaggtactacaaactactacgtaccgaacggaacctaaacccggacccccctaaattccgttaacgttttaacccgtttttagggtaaccgttacccggtaagggttccgggaacgggtcccggggtaccccggttacggtaacggggttttcttttaacctaaaccggtcccggttcctttccgtaccggtttcggtaccccttaaccggtaacgttcccggttcggtaaccccgtaaccggccccggttacccctttaccgttcggtacccgttaacgttcccgttccgggttcccgggttcccggtaccccgggttacgtacgggtaaccgggtacgggtaccgggtctacggttaacgttaaccggttcggtaccgggtccgtaccgttacgtttaaccttaaccgttaccgttacgttacggttacggttcgggtttacggggttcgggtaccggggtaccgggtaccggtaccgttacccggtaccggtcccggtaccggttccgttaacccgggtaccgtacccggtacccggtaacccgggttccggtaccccgggtccccggttacccggtccgttaaccccgg

SEQ ID NO: 156689 - DNA, 839 bp, Homo sapiens
  misc_feature: GYAE6OF02HFMFN.44.33.C11.1.454.CMB.1.raw
  modified_base (487)..(487): a, c, t, g, unknown or other
  misc_feature (487)..(487): n is a, c, g, or t
tcagacagtatatacacgaccggtgctcgatttagagtgagctcgttgggtttggggggggaagctcagcttcagctgtgggtagagaagacaggactcaggacgatctccagcatcggcagcttccctactcctcctcaccctcgtcactcacgttgtcgcgtagggtcctcgggcccagttcgtggtagtagttcgtcttacgacgtaccctaacccgtcgtaacggtccggtttaccggcccgggggtaacccccgggtcggtaacggggggtacccaccgtaactttccgttacttttcggttacggtaacgggtaaaacggtaccgttaaccgtaaagtaacggttaccggtaactttaccttacttaccgttaggttaccgtaacggttacggttaccggtaccgggggtacctaccccggtacggtacccgtaaccccgggtccccccgtaactttaccgttacgttactacggttaccnccttaaacgttaacgtcccgtaacgggtccccggttaccgtacggtaaccgggtcccgcggttaacccgtacgttttccgtcgtaccggtacgttacccgtagttccgacgtacctacggtacgtacggtcccttacgtccgtactacgttctacgttacctaccgtacggtactacggtacggtagtacggttacgcggtactagttacgtacttacgtcgtacgtaacgtgtacgacgtagtacgtcgtacggacggtaccgggacgttcggttgggtaccggtaagggaccggtaacggtacggttacgtcggtacggttaccgacgtccgacgtaccggtacgtcccg

SEQ ID NO: 156690 - DNA, 960 bp, Homo sapiens
  misc_feature: GYAE6OF02GG5A8.44.33.C11.1.454.CMB.1.raw
tcagacagtatatacacgaccggtgctcgatttagagtgagctcgttgggtttggggggggaaggctcagcttcagctgtgggtagagaagacaggactcaggacgatctccagcatggccagcttccctctcctcctcaccctcctcactcactgtgcagggtccgtgggcccagtctgtgatgtctcacgcccacctcagcgtcgtcgggaccccgggcgaggggtcaccatctcgttgttcgtacgggaaaggtaacgtacctaaagtacgtacggtattaccgtttacttcccgttaggtacctaaacgttcgggttaacggttaccggggggtaacccttaccccggaacgggccccgtaaaccccggggtcccccccccgttaaaccgttccttttaacgtaccgtttaacgttccgtaacctttaaccgttaaaccgtaccgtaaccggggtccccgggtacccccgtttaccggggaaccgggggtttccccctccggtaaccccgggttacttttccccggtacgttacgggtaccctaacccgttaaacgggttccgtaacgggtaccctaacccttaaaccgggtacgggttaacccttaacccggtacggtacccgttaaccgttttacccgttaggtaaccctttcccgtaccgttaacggttccggttaagggtaaccgtaaggttaacggtacgggtaccttaggttaactttaacccgtttaacgtacgggttacaaccggttaacgtacgttaaacgggttcgggtaaacgtacgggtaaaccggtaacgggggtaaacccgggcgggttaacccgggttcgggttaccgggggttaccgggtaacgggggtaaccggtaaccggtttaaccggggtaccgtaacccgggtttacggtaaccggggttacccgaccgggttaaccccgagggttaacccccgg

SEQ ID NO: 156691 - DNA, 791 bp, Homo sapiens
  misc_feature: GYAE6OF02FF981.44.33.C11.1.454.CMB.1.raw
  modified_base (211)..(211): a, c, t, g, unknown or other
  misc_feature (211)..(211): n is a, c, g, or t
tcagacagtatatacacgaccggtgctcgatttagagtgagctcgttgggtttggggagcttcagctgtggtagagaagacaggactcaggacgatctccagcatggccagcttccctctcctcctcaccctcctcactcactgtgcagggtcctggcccagtctgtgatgtctcacgcccaccctcgacgcgtcgtccgggacccccggngtacgggggtcaccgagttcctcgttcgttcgtaggaacgtaacgtaccaatacgtacggtacttcgttaactccgtacgtacgtacgttagggtacgtaccgggggacctacccggaacggtcccgtacccccggtccccctaaccttaccgttactctactcgtacctaactaactcgaccgtccggtacctcggtaccgggtccctcgacccgttacgttccgtacgtcgtactaccgtaagtcgtacgtacctaactacgtacgtacctaccgcgaccctaacgttccttacggaccttccgtaccgtaggttccaaggtacggtagtacgacggttacttaggtaaccttcggttaacgtcgtactaccggagtacggtacggtacgggtaacttaccgggaacggttacccgggtacggtacggttacggggttcggggtacggttacccggggaacgggttaccggtaaccggttaccggttacccggttacccgttacgggtaccggttacccgaacccggtttacccggaacccggttccccggttaccccggttccccggtttaacccgg

SEQ ID NO: 156692 - DNA, 751 bp, Homo sapiens
  misc_feature: GYAE6OF02ILRMP.44.33.C11.1.454.CMB.1.raw
  modified_base (222)..(222): a, c, t, g, unknown or other
  misc_feature (222)..(222): n is a, c, g, or t
tcagacagtatatacacgaccggtgctcgatttagagtgagctcgttgggtttgggagcttcagctgtgggtagagaagacaggactcaggacgatctccagcatggccagccttccctctcctccctacaccctcctcactccactgtgcgacggtccgtcgggcccagtctgtagatcgtctcacgcccaccctcgacgcgtcgtccggggacccccggnggacggggtccacgtactccttcgttcgttcgagggaacggtaacgtaccaaatagtcgtacttcgttactcctagtactaacgttggtacgtcgggtaccgtcccgacggccgacccggtaccccgtacctccgttactctagtcccccccccgtataacctactaccgtaccggtcccgtaccgttaccggtaccggtaccccgtccgtacccgtacgtttccgtaccgttccgtcctaaccgtacggtacgtacgaccgtaccgtacgtacgtacccgtaccgtccgtaccgtaccgtaccgttacgtactccgtacgtacgtacgtacggtacgtacgtacggacgttcgtacgttactacgttacgttcgtacgagtacgagtacgtacggtacgtacggtacgacgaccggtacgtaccgggttcggtacgggtccgggacggtacggaacggttacggtaccggtccggttacggtcggaccgtaccggtacccgaacgtcccgacccgtcccggtacccgg

SEQ ID NO: 156693 - DNA, 762 bp, Homo sapiens
  misc_feature: GYAE6OF02I3CYZ.44.33.C11.1.454.CMB.1.raw
  modified_base (189)..(189): a, c, t, g, unknown or other
  misc_feature (189)..(189): n is a, c, g, or t
tcagacagtatatacacgaccggtgctcgatttagagtgagctcgttgggtttggggagcttcagctgtgggtagagaagacaggactcaggacgatctccagcatggccagcttccctctcctcctcaccctcctcactcactgtgcgagggtcctcgggcccagtctgtgatgtctcagccaccctnacgcgtcgtccgggacccccgggcgacgggggtcaccatcttcgttgttcgtagggaacggtaagtaccaaatagtcgacttcttatcctagtacaacgtggtacgtcgggacctcccgacggccgacccggcccccgtacttcccttatcgtactcgaccttaacctaactcgacggtccgcccgtcgaccggggtccctcggcccgtatttccgtcgtcggtcctaccgtaagtcgtacggaccaactaacgacggaccttaccgtcggccctacgttcccgttacgtactccgttaccgtacgttacgtaggtaacggtacgtacggtacggtccgttaagttaaccgtttaaccgttacgttcgttacgacgtaacgtaccgtaaggttacgggaagtaccgggaacgtaaccggggtaacccggggtaaccggttgggttacgggggttaccggttcgggggaaccgggtaacggtaaccggttaaacgggttcccggtaacccgttacgggttacggaaccgtaccggaacccggtacggtccccggtacccggtcccccgttacgg

SEQ ID NO: 156694 - DNA, 776 bp, Homo sapiens
  misc_feature: GYAE6OF02HVRUS.44.33.C11.1.454.CMB.1.raw
  modified_base (219)..(219): a, c, t, g, unknown or other
  misc_feature (219)..(219): n is a, c, g, or t
  modified_base (392)..(392): a, c, t, g, unknown or other
  misc_feature (392)..(392): n is a, c, g, or t
tcagacagtatatacacgaccggtgctcgatttagagtgagctcgttgggtttggggggggtcacaagaggcagcgctctcgggacgtctccaccatggcctgggctctgctgctcctcactctcctcactcaggacacgagggtcctgggcccagtctcgccctggctcacgccctccctcgtgtccggtctccgtggacagtcagtcaccatctccngcacgtcgaaccacgagtcgacgttcggttcgttttgaccgttgtccttccgtacggtaccagccaccgacccaagaaaccaccgacccccaaatctaatttattacgcgtcggtactaagttcgttcctcccgttcggtctccgtgacgtctcttcgtcgtggtaccagtcncggacacgccgtacctccgtacgacctcgtcctcggtcggtacctaccggacggtccgtacggacgggtaacgcggtacgttagtaactttaacgttacgtcggtacctacggtaccttaacgtaacgttaacgtaaacggtaacgggttaacgggtaaaaccctttaacggtttttaaccgtaaccgggtttcccgggacccgtacgggaacggggttaaaccaaccggtttaccgtaacccgggtacccgttacccggttaacggtaacccgtaacccgggtaacccgtaaccgggttcccctacccccgggttcccccggttaccggttaaccccgtaccccggttttaccctttacccccggttaccccccttaaccccc

SEQ ID NO: 156695 - DNA, 799 bp, Homo sapiens
  misc_feature: GYAE6OF02FUZ6Y.44.33.C11.1.454.CMB.1.raw
  modified_base (301)..(301): a, c, t, g, unknown or other
  misc_feature (301)..(301): n is a, c, g, or t
  modified_base (333)..(333): a, c, t, g, unknown or other
  misc_feature (333)..(333): n is a, c, g, or t
tcagacagtatatacacgaccggtgctcgatttagagtgagctcgttgggtttggggagcttcagctgtgggtagagaagacaggactcaggacgatctccagcatggccagcttccctctcctcctcaccctcctcactcactgtgcagggtcctgggcccagtctgtgatgtctcagcccaccctcagcgtcgtcgggacccccgggcgagggggtccaccgatctcgtttgttctagggaaggaacgtccgaatagtcggtatcttactcctgtacacttggtatcggggtactccgnggccaccggcccccgacctcttactctagtcnctaactatcacgtccgccgtcgtaccgggtcccgcgcccgtattctcgtcgggcctaccgaacgtcgtcggactaccgtacgtacggtacctaccgtccgggacctacgtttcccgttacgtacgtaaccttccgacggtttccgttacgggtaggttaacggtcggtaacggttccgttaagttaacccgttttaacgttacgttaacgttcgggtaccgtaacggtccgacggggtttccggtaagggttccgaaccgggtaccggggtaacccggggtaacgggtaaccgggtttcgggggtttacccggttagggggggtaacccgggacgggttaaacccggggttaacggttaaccccggggttaccgggttaacccggttaccgggaacccggttaacccgggaccccgggttaaaccggtccccggttaccccggggtccccccggtttaaccccggg

SEQ ID NO: 156696 - DNA, 815 bp, Homo sapiens
  misc_feature: GYAE6OF02IXMX1.44.33.C11.1.454.CMB.1.raw
tcagacagtatatacacgaccggtgctcgatttagagtgagctcgttgggtttgggggagcttcagctgtgggtagagaagacaggactcaggacgatctccagcatggccagcttccctctcctcctcacccctcctcactcactgtgcagggtcctcgggcccagtctgtgatgtctcagcccaccctcacgcgtccgtccggggacccccggcggacgggggtccacctactcttcttgttcgtagggaaacggtaacgtacctaaagttacgtacggtacttacttactccttacgtacctacggttacggtacggtaccgggtacctacccggacggaccccggtaccccgggtaccccccgttaccgtttacccttacttaccgttacgtaccgtaaccttaaaccgttaacgtaccggtaccggtccccggtacccgtaccgggtacccgggtacccgtccggtacccgttaccgttccgttccggtaccgtacctaccgtaacggtccgtacgtacctacgtaccgtacggtaccgtacccggtcgtacctacttccgtactaccgtccgtccgtagtcgtaggtacggtagtacggtacggtacgttaacttaaccgttaccgttacggtacgtacgacgtacgtacgttaggtacggtacgtacggaaccgggtaccgggtaccggggtaccgggttcgggttacggggttcggtacggggtacgggtaccggtaacggtaccggtaccggtacccgtacggttacgccggtaccgaccgtaccggtccgtcccgtcccgttcgg

SEQ ID NO: 156697 - DNA, 157 bp, Homo sapiens
  misc_feature: GYAE6OF01BE028.35.15.B04.1.454.CMB.1.raw
  modified_base (156)..(157): a, c, t, g, unknown or other
  misc_feature (156)..(157): n is a, c, g, or t
tcagtacagatcgtcacgaccggtgctcgatttagacagtatatatccgcggggaggtgtgtcacaagatttgggctctgggcacagcggccctgggctgcctggtcaaggactacttccacgatctgtactgagcgggctggcaaggcgcatagnn

SEQ ID NO: 156698 - DNA, 157 bp, Homo sapiens; identical to SEQ ID NO: 156697
  misc_feature: GYAE6OF01DFG80.35.15.B04.1.454.CMB.1.raw
  modified_base (156)..(157): a, c, t, g, unknown or other
  misc_feature (156)..(157): n is a, c, g, or t

SEQ ID NO: 156699 - DNA, 158 bp, Homo sapiens
  misc_feature: GYAE6OF01BNGK1.35.15.B04.1.454.CMB.1.raw
  modified_base (156)..(158): a, c, t, g, unknown or other
  misc_feature (156)..(158): n is a, c, g, or t
tcagtacagatcgtcacgaccggtgctcgatttagacagtatatatccgcggggaggtgtgtcacaagatttgggctctgggcacagcggccctgggctgcctggtcaaggactacttccacgatctgtactgagcgggctggcaaggcgcatagnnn

SEQ ID NO: 156700 - DNA, 494 bp, Homo sapiens
  misc_feature: GYAE6OF01CN5A1.35.15.B04.1.454.CMB.1.raw
tcagtacagatcgtcacgaccggtgctcgatttagacagtatatatccgcggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaaagcaatatacttattggtaccagcagaagtcaggccaggcccctgtattgatgatgtataaaagacactgagaggccctcagggatccctgagcgattctctggctccagctcagggacaaacagtcacgttgaccatcagtgagtccaggcagaagacgaggctgattatactgtcaatcagcagacaaccaacaatagtcccgtgtttggcggagggaccaagctgaccgtcctaggtcacgcccaaggcctgccccctcgg

SEQ ID NO: 156701 - DNA, 180 bp, Homo sapiens
  misc_feature: GYAE6OF01A1PM0.35.15.B04.1.454.CMB.1.raw
  modified_base (158)..(180): a, c, t, g, unknown or other
  misc_feature (158)..(180): n is a, c, g, or t
tcagtacagatcgtcacgaccggtgctcgatttagacagtatatatccgcgggggaggtgtgtcacaagatttgggctctgggcacagcggccctgggcctgcctggtcaaggactacttccacgatctgtactgagcgggctggcaaggcgcatagnnnnnnnnnnnnnnnnnnnnnnn

SEQ ID NO: 156702 - DNA, 156 bp, Homo sapiens
  misc_feature: GYAE6OF01DU4A3.35.15.B04.1.454.CMB.1.raw
  modified_base (156)..(156): a, c, t, g, unknown or other
  misc_feature (156)..(156): n is a, c, g, or t
tcagtacagatcgtcacgaccggtgctcgatttagacagtatatatccgcggggaggtgtgtcacaagatttgggctctgggcacagcggccctgggctgcctggtcaaggactacttccacgatctgtactgagcgggctggcaaggcgcatagn

SEQ ID NO: 156703 - DNA, 212 bp, Homo sapiens
  misc_feature: GYAE6OF01DD8SB.35.15.B04.1.454.CMB.1.raw
  modified_base (210)..(212): a, c, t, g, unknown or other
  misc_feature (210)..(212): n is a, c, g, or t
tcagtacagatcgtcacgaccggtgctcgatttagacagtatatatccgcggggaccaaggtcaccgtctcctcagcttccaccaagggcccatcggtcttcccctggcgccctgctccaggagcacctctgggggcacagcggccctgggctgcctggtcaaggactacttccacgatctgtactgagcgggctggcaaggcgcatagnnn

SEQ ID NO: 156704 - DNA, 157 bp, Homo sapiens; identical to SEQ ID NO: 156697
  misc_feature: GYAE6OF01C52ZH.35.15.B04.1.454.CMB.1.raw
  modified_base (156)..(157): a, c, t, g, unknown or other
  misc_feature (156)..(157): n is a, c, g, or t

SEQ ID NO: 156705 - DNA, 488 bp, Homo sapiens
  misc_feature: GYAE6OF01BBT8C.35.15.B04.1.454.CMB.1.raw
tcagtacagatcgtcacgaccggtgctcgatttagacagtatatatccgcgggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaagcaatatacttattggtaccagcagaagtcaggccaggcccctgtattgatgatgtataaaggcactgagaggccctcagggatccctgagcgattctctggctccagctcagggacaacagtcacgttgaccatcagtggagtccaggcagaagacgaggctgattattactgtcaatcagcagacaccaacaatagtcccgtgtttggcggagggaccaagctgccgtctaggtcagcccaaggctgcccctcgg

SEQ ID NO: 156706 - DNA, 158 bp, Homo sapiens; identical to SEQ ID NO: 156699
  misc_feature: GYAE6OF01C56SY.35.15.B04.1.454.CMB.1.raw
  modified_base (156)..(158): a, c, t, g, unknown or other
  misc_feature (156)..(158): n is a, c, g, or t

SEQ ID NO: 156707 - DNA, 544 bp, Homo sapiens
  misc_feature: GYAE6OF01CP57S.35.15.B04.1.454.CMB.1.raw
tcagtacagatcgtcacgaccggtgctcgatttagacagtatatatccgtgtcaggtgcagctggtggagtctgggggaggcttggtcaagcctggagggtccctgagactgtcttgtgcagcctctggattcaccttcagagactatttcatgacctggatccgccagactccagggaagggactggagtgggtctcacacatcagcagtactggcaatcccatgtactacgcagactctgtgaaggccgattcacctatttttaggacaacgccaagggttcgctgtatctgcaaatgaacagcctgagagtcgaggacacggccatctaattactgtgacaagagtctgtagtggtgcagttgtggctacggtactacggacggtagtggacgtcgtggggccgaagggaccaaggtcaacccggtctctcacgtcttaccaccgaacgggcccacgtccggtcctccccgtggccgccctcgcctcccgacggacgccaccgtcgtcggggcaccgacggccggcccgtgggcctccggg

SEQ ID NO: 156708 - DNA, 162 bp, Homo sapiens
  misc_feature: GYAE6OF01EBSQ8.35.15.B04.1.454.CMB.1.raw
  modified_base (158)..(162): a, c, t, g, unknown or other
  misc_feature (158)..(162): n is a, c, g, or t
tcagtacagatcgtcacgaccggtgctcgatttagacagtatatatccggcgggggaggtgtgtcacaagatttgggctctgggcacagcggccctgggctgcctggtcaaggactacttccacgatctgtactgagcgggctggcaaggcgcatagnnnnn

SEQ ID NO: 156709 - DNA, 615 bp, Homo sapiens
  misc_feature: GYAE6OF01CB7XG.35.15.B04.1.454.CMB.1.raw
  modified_base (506)..(506): a, c, t, g, unknown or other
  misc_feature (506)..(506): n is a, c, g, or t
tcagtacagatcgtcacgaccggtgctcgatttagacagtatatatccgtgtcaggtgcagctggtggagtctgggggaggcttggtcaagcctggagggtccctgagactgtcttgtgcagcctctggattcaccttcagagactatttcatgacctggatccgccagactccagggaaggactggagtgggtctcacacatcagcagtactggcaatcccatgtactacgcagactctgtgaaggcgattcaccatttttaggactaacgccaaggttcgctgtatctgcaaatgaacagcctgagagtcgaggacacggccagtctattactgtgcaagagtcgtgtagtggtggtcgtaagtttgttggtcgttacggttaacgtacggtaacggttagtgggaacgtcgtggggaccgaagggaccgaaggtccgacgtcctcctacgacgtccttacccgaccgaacgggcccctaacgtccggttacccttccccccgngggtcccgtcccgtccggcccttcccgaacggtacgccctaacccgttccggtccggggggacctacccgaacggtccccgggtaccccgtgggggtcccttcccgggg

SEQ ID NO: 156710 - DNA, 211 bp, Homo sapiens
  misc_feature: GYAE6OF01DC9ME.35.15.B04.1.454.CMB.1.raw
  modified_base (209)..(211): a, c, t, g, unknown or other
  misc_feature (209)..(211): n is a, c, g, or t
tcagtacagatcgtcacgaccggtgctcgatttagacagtatatatccgcggggaccaaggtcaccgtctcctcagcttccaccaagggcccatcggtcttcccctggcgccctgctccaggagcacctctgggggcacagcggccctgggctgcctggtcaaggactacttccacgatctgtactgagcggctggcaaggcgcatagnnn

SEQ ID NO: 156711 - DNA, 497 bp, Homo sapiens
  misc_feature: GYAE6OF01DKFF7.35.15.B04.1.454.CMB.1.raw
tcagtacagatcgtcacgaccggtgctcgatttagacagtatatatccgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaagcaatatacttattggtaccagcagaagtcaggccaggcccctgtattgatgatgtataaagacactgagaggccctacgagggatccctgagcgattctctggctccagctcagggacaacgagtcacgttgaccatcagtggagtccaggcaagaagacgaggctagattattactgtacaatcagcagacaccaacaatacgtccgtgttggcggaggaccaagctgaccgtctaggtcagacccaggcctcgccccgtcgg

SEQ ID NO: 156712 - DNA, 533 bp, Homo sapiens
  misc_feature: GYAE6OF01EWBK3.35.15.B04.1.454.CMB.1.raw
  modified_base (493)..(493): a, c, t, g, unknown or other
  misc_feature (493)..(493): n is a, c, g, or t
tcagtacagatcgtcacgaccggtgctcgatttagacagtatatatccgtgtcaggtgcagctggtggagtctgggggaggcttggtcaagcctggagggtccctgagactgtcttgtgcagcctctggattcaccttcagagactatttcatgacctggatccgccagactccagggaagggactggagtgggtctcacacatcagcagtactggcaatcccatgtactacgcagactctgtgaagggccgattcaccatttttagggacaacgccaagggttcgctgtatctgcaaatgaacagcctgagagtcgaggacacggccatctattactgtgcaagagtctgtagtggtgcagttgttggctacggtactacgacggtatggacgtcgtgggccaagggaccaaggtcaccgtctcctcacgccttaccaccgacgggcccagtccggtccttcccccgtggccgtccctcgcctccgaggacnccacccgtcgtggggccacgacgccggccctgggctccgg

SEQ ID NO: 156713 - DNA, 498 bp, Homo sapiens
  misc_feature: GYAE6OF01BEI1L.35.15.B04.1.454.CMB.1.raw
  modified_base (354)..(354): a, c, t, g, unknown or other
  misc_feature (354)..(354): n is a, c, g, or t
  modified_base (485)..(485): a, c, t, g, unknown or other
  misc_feature (485)..(485): n is a, c, g, or t
tcagtacagatcgtcacgaccggtgctcgatttagacagtatatatccgcgggggggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaagcaatatacttattggtaccagcagaagtcagccaggcccctgtattgatgatgtataaagacactgagaggccctgagggactccctgagcgtattctctggctccagctcgagggacaacgngtacacgttgaccatcagtggagtccaggcaagaagacgagctagattattactgtacaatcagacagacacaacaatacgtccgtgttggcggaggaccagctagaccgtcacggcacgcccaagcctcnccccgtggtaccc

SEQ ID NO: 156714 - DNA, 533 bp, Homo sapiens
  misc_feature: GYAE6OF01D6AGD.35.15.B04.1.454.CMB.1.raw
tcagtacagatcgtcacgaccggtgctcgatttagacagtatatatccgtgtcaggtgcagctggtggagtctgggggaggcttggtcaagcctggagggtccctgagactgtcttgtgcagcctctggattcaccttcagagactatttcatgacctggatccgccagactccagggaagggactggagtgggtctcacacatcagcagtactggcaatcccatgtactacgcagactctgtgaagggccgattcaccatttttagggacaacgccaagggttcgctgtatctgcaaatgaacagcctgagagtcgaggacacggccatctattactgtgcaagagtctgtagtggtggcagttgttggctacggtactacgacggtatggacgtctggggccaagggaccaaggtcaccgtctcctcagcttccaccaagggcccatccggtcttcccccgtggccgccctcgcctcccgacggagccaccgtcgtgggggaccacgacgccggcccctggggcctccggg

SEQ ID NO: 156715 - DNA, 528 bp, Homo sapiens
  misc_feature: GYAE6OF01C1IH6.35.15.B04.1.454.CMB.1.raw
  modified_base (411)..(411): a, c, t, g, unknown or other
  misc_feature (411)..(411): n is a, c, g, or t
  modified_base (430)..(430): a, c, t, g, unknown or other
  misc_feature (430)..(430): n is a, c, g, or t
tcagtacagatcgtcacgaccggtgctcgatttagacagtatatatccgcgggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaagcaatatacttattggtaccagcagaagtcaggccaggcccctgtattgatgatgtataaagacactgagagccctgagggatccctgagcgtattctcgtggctccgagctcgagggacaacgagtacacgttgaccatcgagtgacgtcaggcaagaagacgagctgattatactgtnaatcagacacgacaccaanaacgtacgtccgtgtttcgggacggacgggaccaaggtcctaggacccgttccgtaacggtcaccggacccaaggtccctccggtcccccgttaccgg

SEQ ID NO: 156716 - DNA, 491 bp, Homo sapiens
  misc_feature: GYAE6OF01DB4HI.35.15.B04.1.454.CMB.1.raw
  modified_base (328)..(328): a, c, t, g, unknown or other
  misc_feature (328)..(328): n is a, c, g, or t
  modified_base (423)..(423): a, c, t, g, unknown or other
  misc_feature (423)..(423): n is a, c, g, or t
  modified_base (443)..(443): a, c, t, g, unknown or other
  misc_feature (443)..(443): n is a, c, g, or t
tcagtacagatcgtcacgaccggtgctcgatttagacagtatatatccgcggggctggggagcctagctgtgctgtgggtccaggaggcagaactctgggtgtctcaccatggcctggatccctctacttctccccctccctcactctctgcacaggctctgaggcctcctatgagctgacacacgccaccctcggtgtcagtgtccccaggacagacggccaggatcacctgctctggagatgcattgccaaagcaatatacttattggtacagcagaagtcaggccagccctgtatgatgatgtataaagacactgagaggccctnaggatccctgagcgattctctgctccagctcagggacaacagtcacgttgaccatcagtggatccaggcagaagacgagctagattatactagtnaatcagcaagaacaccaaanaactgtcccgtaggtttcggacggtaagggaacccagcgtggtacccg

SEQ ID NO: 156717 - DNA, 158 bp, Homo sapiens
  misc_feature: GYAE6OF01AH446.35.15.B04.1.454.CMB.1.raw
  modified_base (157)..(158): a, c, t, g, unknown or other
  misc_feature (157)..(158): n is a, c, g, or t
tcagtacagatcgtcacgaccggtgctcgatttagacagtatatatccgcgggggaggtgtgtcacaagatttgggctctgggcacagcggccctgggctgcctggtcaaggactacttccacgatctgtactgagcgggctggcaaggcgcatagnn

SEQ ID NO: 156718 - DNA, 527 bp, Homo sapiens
  misc_feature: GYAE6OF01AKU3Y.35.15.B04.1.454.CMB.1.raw
  modified_base (432)..(432): a, c, t, g, unknown or other
  misc_feature (432)..(432): n is a, c, g, or t
  modified_base (511)..(511): a, c, t, g, unknown or other
  misc_feature (511)..(511): n is a, c, g, or t
tcagtacagatcgtcacgaccggtgctcgatttagacagtatatacccgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggattacctgctctggagatgcattgtcagaaagtattttggtttttggaccagaagaagtcaggccaggccctgtattgatgatgtaataaagacactgagacggccctgagggactccctgacgcgattctctggctccagctcgagggacaacagtcacgttgaccatcagtggacgtcgaggcagaagacgaggctgtattattactgtcaatcagcagacaacaanatagtccgtgttcggaggacggaccaagctacggaccgtcgtacggtcacgcccgaaggcctccgccccgtcggtaccnccttcctccgttcccc

SEQ ID NO: 156719 - DNA, 502 bp, Homo sapiens
  misc_feature: GYAE6OF01A8MQR.35.15.B04.1.454.CMB.1.raw
  modified_base (307)..(307): a, c, t, g, unknown or other
  misc_feature (307)..(307): n is a, c, g, or t
  modified_base (413)..(413): a, c, t, g, unknown or other
  misc_feature (413)..(413): n is a, c, g, or t
tcagtacagatcgtcacgaccggtgctcgatttagacagtatatatccgcgggggggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaagcaatatacttattggtaccagcagaagtcaggccaggcccctgtattgatgatgtataaagacactgagagccctnagggatcctgagcgattctctggctccgagctcgagggacaacgagtcacgttgaccatcgagtggagtccaggcaagaacgacgaggctagatttattactgtanaatcagacagacaaccaaacaatacgtccgttagttggcggaggaccagctagaccgtcaggtcacgccaggctcgccccgtcgtaccg

SEQ ID NO: 156720 - DNA, 527 bp, Homo sapiens
  misc_feature: GYAE6OF01CAC9I.35.15.B04.1.454.CMB.1.raw
  modified_base (405)..(405): a, c, t, g, unknown or other
  misc_feature (405)..(405): n is a, c, g, or t
tcagtacagatcgtcacgaccggtgctcgatttagacagtatatatccgcgggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaagcaatatacttattggtaccagcagaagtcaggccaggcccctgtattgatgatgtataaagacactgagaggccctcaggatccctgagcgattctctggctcagctcagggacaacgagtcacgttcgaccatcagtggagtccgaggcaagaagacgaggctgattatacngtacaatcagcagacaacaactaatacgtcccgtggttcggacgggtaggaccgtaagcgtacggacccgtccgtacggtacctacggacccgaaaggtcctccggtcccccgttacccggg

SEQ ID NO: 156721 - DNA, 214 bp, Homo sapiens
  misc_feature: GYAE6OF01EAT9U.35.15.B04.1.454.CMB.1.raw
  modified_base (211)..(214): a, c, t, g, unknown or other
  misc_feature (211)..(214): n is a, c, g, or t
tcagtacagatcgtcacgaccggtgctcgatttagacagtatatatccgcggggaccaaggtcaccgtctcctcagcttccaccaagggcccatcggtcttccccctggcgccctgctccaggagcacctctggggacacagcggccctgggctgcctggtcaaggactacttccacgatctgtactgagcgggctggcaaggcgcatagnnnn

SEQ ID NO: 156722 - DNA, 548 bp, Homo sapiens
  misc_feature: GYAE6OF01BA9I7.35.15.B04.1.454.CMB.1.raw
  modified_base (227)..(227): a, c, t, g, unknown or other
  misc_feature (227)..(227): n is a, c, g, or t
  modified_base (257)..(257): a, c, t, g, unknown or other
  misc_feature (257)..(257): n is a, c, g, or t
  modified_base (539)..(539): a, c, t, g, unknown or other
  misc_feature (539)..(539): n is a, c, g, or t
  modified_base (543)..(543): a, c, t, g, unknown or other
  misc_feature (543)..(543): n is a, c, g, or t
tcagtacagatcgtcacgaccggtgctcgatttagacagtatatatccgtgtcaggtgcagctgctggagtcgggggaggcttggtacggcctgggggtccctaagactctcctgtgcagcctctggattcaccttttacaactttgccatgaactgggtccgccagactccagggaagggtctggagtgggtctcgcgtattcgtggcagtggcagtggtcccganacatattacgcagacgccgtgcaggggccncttcatcgtctccagagacaactcgaagaacaccctctatttgaggatgaccgacctgagtgccgacgacacggccctttatactgtgtgaaggagtggaattttggtcggggacttagtccctgggcgcgtgggtcaggtcggggccgggtaaccttcgtcaccgtctcctcacgcctccaccaagggcccatccggtcctccccgtgccgccctgcctccaggcgccaccgtcgagacgcacagcgcccgtggcctgcctggtccaaggactactccagntcgngtacg

SEQ ID NO: 156723 - DNA, 492 bp, Homo sapiens
  misc_feature: GYAE6OF01B5QNR.35.15.B04.1.454.CMB.1.raw
  modified_base (308)..(308): a, c, t, g, unknown or other
  misc_feature (308)..(308): n is a, c, g, or t
  modified_base (437)..(437): a, c, t, g, unknown or other
  misc_feature (437)..(437): n is a, c, g, or t
  modified_base (477)..(477): a, c, t, g, unknown or other
  misc_feature (477)..(477): n is a, c, g, or t
tcagtacagatcgtcacgaccggtgctcgatttagacagtatatatccgcgggggggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaagcaatatacttattggtaccagcagaagtcaggccaggcccctgtattgatgatgtataaagacactgagaggccctnagggatccctgagcgattctctggctcagctcagggacaacagtcacgttgaccatcagtggagtcaggcagaagacgagctagattatactgtacaatcagcagacacaacatacgtccgtgttcggngaggaccaagctgaccgtctaggtcacgtcccaaggtccncgccccgtggtaccc

SEQ ID NO: 156724 - DNA, 485 bp, Homo sapiens
  misc_feature: GYAE6OF01EZBUJ.35.15.B04.1.454.CMB.1.raw
  modified_base (423)..(423): a, c, t, g, unknown or other
  misc_feature (423)..(423): n is a, c, g, or t
  modified_base (450)..(450): a, c, t, g, unknown or other
  misc_feature (450)..(450): n is a, c, g, or t
tcagtacagatcgtcacgaccggtgctcgatttagacagtatatatccgcgggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaagcaatatacttattggtaccagcagaagtcaggccaggcccctgtattgatgatgtataaagacactgagaggccctcgaggatccctgagcgattctctggctccagctcagggacaacagtcacgttgaccatcagtggagtcaggcagaagacgaggctgattattactgtcaatcaagcagacacaanatacgtcctgttgcggaggaccgagcngaccgtcctaggtcagaccaaggctcgcccctcgg

SEQ ID NO: 156725 - DNA, 929 bp, Homo sapiens
  misc_feature: GYAE6OF01CG2P0.35.15.B04.1.454.CMB.1.raw
tcagtacagatcgtcacgaccggtgctcgatttagacagtatatatccggcggggccgtggggagcctacgcctggttcgcgtgtgggtccaggtaggcagaactctgggtgtctcaccatgggacctggactccctctacgttcttcccccgtcctcactcttcgttcgctacaggtctttacgtgacggccttcctagtggagcctggacctacgaggccctaccccgtggggtgtcctaggttccgtacccccgagggtaccggacgaccgggcccgaaggtaccttcccgtaccgttggcccttacggtcgggtaacgtagttcgtcctaacgttttcggaacccgtaaaaggttacctaaagttaactttaacctttaagtttacgggttaaccccgtagggtacccgaacggtaaacggttacccgtaccggggtaacccggaacggggtaccccccgttagggttaacgttttagggtaacgttacggttaacttaagggtttaaaacgtttaaaaagggtaaaccgttaaacgtttacgggaaacgggtaaaccgggtaacccccgttaacggtaaaggggtttaaccgtttaccccgttacggaaaccggtaacccggttacgttttaccgttacggttacgggtacccttacccggtaaccgtaccgttacccggaacggggtaaccctaaacccgtaacggttaccgtaaccgtttaacgaacccgtaactaccgtacggtacggtacgttacccgaaggtacgaaggaacggaccggaggtaccgtagtagttactttacgacgtactaacgtacgtagtaccaacgtaccgtaaccgaagtaaacgttacggtacccggttaaggtttcgggtaccggtaacgggtaccggtaacggtcggtacggtaaccccggg

SEQ ID NO: 156726 - DNA, 214 bp, Homo sapiens
  misc_feature: GYAE6OF01CNSH4.35.15.B04.1.454.CMB.1.raw
  modified_base (211)..(214): a, c, t, g, unknown or other
  misc_feature (211)..(214): n is a, c, g, or t
tcagtacagatcgtcacgaccggtgctcgatttagacagtatatatccgcggggaccaaggtcaccgtctcctcagcttccaccaagggcccatcggtcttccccctggcgccctgctccaggagcacctctgggggcacagcggccctgggctgcctggtcaaggactacttccacgatctgtactgagcgggctggcaaggcgcatagnnnn

SEQ ID NO: 156727 - DNA, 577 bp, Homo sapiens
  misc_feature: GYAE6OF01EABM2.35.15.B04.1.454.CMB.1.raw
tcagtacagatcgtcacgaccggtgctcgatttagacagtatatatccgcgggggtgggtccaggaggcagaactctgggtgtctcaccatggcctggatccctctacttctcccctcctcactctctgcacaggctctgaggcctcctatgagctgacacagccaccctcggtgtcagtcgtccccaggacagacggccaggatcacctgctctggagatgcattgaccaaagcaatatacttattggtaccagcagaagtcaggccacggcccctgtattgatgatagtaataaagacacgtgagacggccctacgagggactcccgtgacgcgtattcgtctggctccagtcctcgaagggacaacagtcctaacgttcgactagtcgagtggacgtaccgaggaccgaagaacggacgaggtctagtatttacgttactgtacaatcaagacaacgacaaccaaactagtaccggttcccgtaggttcgggacggtaacggaccgacgtcgtacggtacccggtacgtacggaccgtaaccggacccgaaggccctcccgcccccgttaccgg

SEQ ID NO: 156728 - DNA, 525 bp, Homo sapiens
  misc_feature: GYAE6OF01A8YHH.35.15.B04.1.454.CMB.1.raw
tcagtacagatcgtcacgaccggtgctcgatttagacagtatatatccgtgtcaggtgcagctggtggagtctgggggaggcttggtcaagcctggagggtccctgagactgtcttgtgcagcctctggattcaccttcagagactatttcatgacctggatccgccagactccagggaagggactggagtgggtctcacacatcagcagtactggcaatcccatgtactacgcagactctgtgaagggccgattcaccattttttagggacaacgccaagggttcgctgtatctgcaaatgaacagcctgagagtcgaggacacggccatctattactgtgcaagagtctgtagtggtggcagttgttggctacggtactacgacggtatggacgtctggggccaagggaccaaggtcaccgtctcctcagcttccaccaagggcccatcggtctcccctggccgccctgcctccaggagcaccctcgtgggggccacgacggccggcccctggggcctccggg

SEQ ID NO: 156729 - DNA, 495 bp, Homo sapiens
  misc_feature: GYAE6OF01CL0DC.35.15.B04.1.454.CMB.1.raw
tcagtacagatcgtcacgaccggtgctcgatttagacagtatatatccgcgggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaagcaatatacttattggtaccagcagaagtcaggccaggcccctgtattgatgatgtataaagacactgagaggccctcagggatccctgagcgattctctggctccagctcagggacaacagtcacgttgaccatcagtggagtcccaggcagaagacgaggctgattattactgtacaatcagcaagacaccaacaatagtcccgtgttggcggagggaccaagctggacccgtcgtaggtcagacccaggctcgccccgtcg

SEQ ID NO: 156730 - DNA, 218 bp, Homo sapiens
  misc_feature: GYAE6OF01BFPJT.35.15.B04.1.454.CMB.1.raw
  modified_base (211)..(218): a, c, t, g, unknown or other
  misc_feature (211)..(218): n is a, c, g, or t
tcagtacagatcgtcacgaccggtgctcgatttagacagtatatatccgcggggaccaaggtcaccgtctcctcagcttccaccaagggcccatcggtcttccccctggcgccctgctccaggagcacctctgggggcacagcggccctgggctgcctggtcaaggactacttccacgatctgtactgagcgggctggcaaggcgcatagnnnnnnnn

SEQ ID NO: 156731 - DNA, 159 bp, Homo sapiens
  misc_feature: GYAE6OF01CQF3R.35.15.B04.1.454.CMB.1.raw
  modified_base (157)..(159): a, c, t, g, unknown or other
  misc_feature (157)..(159): n is a, c, g, or t
tcagtacagatcgtcacgaccggtgctcgatttagacagtatatatccgcgggggaggtgtgtcacaagatttgggctctgggcacagcggccctgggctgcctggtcaaggactacttccacgatctgtactgagcgggctggcaaggcgcatagnnn

SEQ ID NO: 156732 - DNA, 492 bp, Homo sapiens
  misc_feature: GYAE6OF01C1RCS.35.15.B04.1.454.CMB.1.raw
  modified_base (411)..(411): a, c, t, g, unknown or other
  misc_feature (411)..(411): n is a, c, g, or t
  modified_base (425)..(425): a, c, t, g, unknown or other
  misc_feature (425)..(425): n is a, c, g, or t
tcagtacagatcgtcacgaccggtgctcgatttagacagtatatatccgcgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacgccaggatcacctgctctggagatgcattgccaaagcaatatacttattggtacagcagaagtcagccaggccctgtatgatgatgtaataaagacactgagagccctgaggactccctgagcgattctctggctcacgctcgagggacaacagtacacgttgaccatcagtgagtcaggcagaagacgaggctagattatactgtacaatcancaagtacaaccaanaactagtccgtggttcggacggaggacgagctcgaccgtcagtcagacccgaagcctcgcccgtcgg

SEQ ID NO: 156733 - DNA, 550 bp, Homo sapiens
  misc_feature: GYAE6OF01CKHMG.35.15.B04.1.454.CMB.1.raw
tcagtacagatcgtcacgaccggtgctcgatttagacagtatatatccgcgggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgaccaaagcaatatacttattggtaccagcagaagtcaggccaggcccctgtattgatgatgtaataaagacactgagaggccctcgagggactcccgtgagcgtattctcgtggctccagtctcgacgggacaacgacgtactacgttcgaccatcgagtcggacgtcgaggacgaagaacgacgaggtctagtattattactgtactaatcagacaacgacaacaactaagtacgtacccgttggttacgggcggagggaccgaaggtcgtacggtacccgtaccgtaggtcgacgacccgaaggcctccggcccccgtacgg

SEQ ID NO: 156734 - DNA, 884 bp, Homo sapiens
  misc_feature: GYAE6OF01DMCRO.35.15.B04.1.454.CMB.1.raw
  modified_base (296)..(296): a, c, t, g, unknown or other
  misc_feature (296)..(296): n is a, c, g, or t
tcagtacagatcgtcacgaccggtgctcgatttagacagtatatatccgcggggggtccaggaggcagaactctgggtgtctcaccatggcctggatccctctacttctccccctcctcactctctgcacaggctctgaggccccctatgagcgtcgacgacacgaccgaccctaccggttggtcacgtcgttccccgaccggacgaacgacggacccgacggaagtccacctcgtcgtctggaggatgcacttagaccgaaacgaacaataattactttattagttaccgacganacgaagtacgacggaccgacgacccgtccttagttagtagtagtagtagttaagttaaaagaaaccaccgtaggaggaacggtcccgtacctagggaacgtcccttacggagacgtacttcttcgtcggtcgtacccacgtctaccgaacgggaacgaacctaacgtcgtaaccgttacgtaacccgactacgtaacggtagggtaacggttacccgaacggggacgaacggaaaacgggaaaccggacggggtacgttacggttaaacgttttaacttttaaaccggtttgttaccgtaaacgtaccgttaacggaaccgtaacggaaaacccgaaaccctaaaacccgttaaaacgtttaacccgggtttccccggggttttaccgggttttaacgggggtaacccggggaaaccggggggtaaaacccctaaaccgggtaaccggttttacccgggtaaacccccgggtttacccccggtttaaacggggttacccgtaacccggaaaaccccccgggtaaccgggttaaccccgtcccccgggtttacccccccccggttaccccggggtttacttaacccccg

SEQ ID NO: 156735 - DNA, 157 bp, Homo sapiens
  misc_feature: GYAE6OF01CVLFC.35.15.B04.1.454.CMB.1.raw
  modified_base (157)..(157): a, c, t, g, unknown or other
  misc_feature (157)..(157): n is a, c, g, or t
tcagtacagatcgtcacgaccggtgctcgatttagacagtatatatccgcgggggaggtgtgtcacaagatttgggctctgggcacagcggccctgggctgcctggtcaaggactacttccacgatctgtactgagcgggctggcaaggcgcatagn

SEQ ID NO: 156736 - DNA, 523 bp, Homo sapiens
  misc_feature: GYAE6OF01C07TG.35.15.B04.1.454.CMB.1.raw
  modified_base (505)..(505): a, c, t, g, unknown or other
  misc_feature (505)..(505): n is a, c, g, or t
tcagtacagatcgtcacgaccggtgctcgatttagacagtatatatccgcgggggggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaagcaatatacttattggtaccagcagaagtcaggccaggcccctgtattgatgatgtataaagacactgagaggccctgagggatcccgtgagcgattctctggcctccagctcgaacgggacaacagtctacgtcgaccatcagtgggagtccgaggcaaggaagacggagactgtattattactgtacaatcagcacgacaacaacaatacggttccgtggttggcggacgggaccaaggctagacccgtcgtaggtcacgtacccaaggccnccggccccgtcggtaccc

SEQ ID NO: 156737 - DNA, 615 bp, Homo sapiens
  misc_feature: GYAE6OF01CGYNF.35.15.B04.1.454.CMB.1.raw
  modified_base (215)..(215): a, c, t, g, unknown or other
  misc_feature (215)..(215): n is a, c, g, or t
  modified_base (324)..(324): a, c, t, g, unknown or other
  misc_feature (324)..(324): n is a, c, g, or t
  modified_base (417)..(417): a, c, t, g, unknown or other
  misc_feature (417)..(417): n is a, c, g, or t
tcagtacagatcgtcacgaccggtgctcgatttagacagtatatatccgcgggggtgggtccaggaggcagaactctgggtgtctcaccatggcctggatccctctacttcctcccctcctcactctctgcacaggctctgaggcctcctatgagctgacacagccaccctggtgtcagtcgccccaggacagacggccaggatcacctgctcgnggagatgcattgaccaaagcaatatacttatggtacagcagaagtcaggccaggccctgtattgatgatagtaataaagacacgtagacgacgccctgaggactcccgnggacgcgtattctcgcgtcctcgacgtcgtcgaagggacaacgacgtacacgttcgaccaagtcgaggtggacgcgaggcaagaggacgtagntagtattagttactgtacaacgtgaacggacaacgaaccaaaccaaactaacgttaccggttacccgttagggttaccgggaccggggtaacggaacccggtaaacggtccgtacggtaaccccggttaccgtaacgggttacccgaaccgggtaccccgaaccgggcccttaccccggtcccccggtttaacccggg

SEQ ID NO: 156738 - DNA, 537 bp, Homo sapiens
  misc_feature: GYAE6OF01AHTSH.35.15.B04.1.454.CMB.1.raw
tcagtacagatcgtcacgaccggtgctcgatttagacagtatatatccgtgtcaggtgcagctggtggagtctgggggaggcttggtcaagcctggagggtccctgagactgtcttgtgcagcctctggattcaccttcagagactatttcatgacctggatccgccagactccagggaagggactggagtgggtctcacacatcagcagtactggcaatcccatgtactacgcagactctgtgaagggccgattcaccattttttagggacaacgccaagggttcgctgtatctgcaaatgaacagcctgagagtcgaggacacggccatctattactgtgcaagagtctgtagtggtggcagttgttggctacggtactacgacggtatggacgtcgtggggccaagggaccaaggtcaccgtctcctcagcttccaccgaagggccccagtccggtccttcccccgtggcccgcccctgcctcccgaggacgccaccctccgtgggggccacgacgccggccctgggcctccgg

SEQ ID NO: 156739 - DNA, 540 bp, Homo sapiens
  misc_feature: GYAE6OF01ETX89.35.15.B04.1.454.CMB.1.raw
  modified_base (415)..(415): a, c, t, g, unknown or other
  misc_feature (415)..(415): n is a, c, g, or t
tcagtacagatcgtcacgaccggtgctcgatttagacagtatatatccgcgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaagcaatatacttattggtaccagcagaatcaggccaggcccctgtattgatgatgtaataaagacactgagaggccctacgagggatccctgagcgattctcgtggcctccagctcgaggacaacagtcacgttcgaacctatcaaggtcggatcgaggcaagaagacgagctagattatntagctaatcagcacgacacaacatacggtcccgttggttacggacgggacgggaacctaacggtccgtacggtaccccggtcgttaacgggtacacccggacccgaaaggtccgttacccccggg

SEQ ID NO: 156740 - DNA, 671 bp, Homo sapiens
  misc_feature: GYAE6OF01CP3U9.35.15.B04.1.454.CMB.1.raw
tcagtacagatcgtcacgaccggtgctcgatttagacagtatatatccgcgggggcctggggagcctagctgtgctgtgggtccaggaggcagaactctgggtgtctcaccatggcctggatccctctacttcctcccctcctcactctctggggcacaggctctgaggcctcctatgagctgacacacgcccaccctcggtgtcagtcgtccccaggacagacggccaggatcacctgctctggagatgcaattgaccaaagcaatatacttattggtaccagcagaatcagccaggccctgtatgatgatgtaataaagacactgagtacggccctcgagggactcccgtgacgcgaatttcctcgtcggccttccgaagtcctcgaacggggtaacaaaccgtacgttaccaaggtttaccggaaccctaagttacccgaaggttacgggaacgttacccgaagggaccaaaggaaacgggaacggaagggtaccgttaagggtaacttttaaacgtttaaccgttaggttaccaaacgttccgaaacgacgaaacgaacccgaaacccaaaacgtaaacgttaacggttacccccggtttagggttttaacgggacccggggtaaacgggtaacccgaaacggtcccggttacggtaaacccccggg

SEQ ID NO: 156741 - DNA, 540 bp, Homo sapiens
  misc_feature: GYAE6OF01E10EF.35.15.B04.1.454.CMB.1.raw
  modified_base (328)..(328): a, c, t, g, unknown or other
  misc_feature (328)..(328): n is a, c, g, or t
  modified_base (399)..(399): a, c, t, g, unknown or other
  misc_feature (399)..(399): n is a, c, g, or t
  modified_base (421)..(421): a, c, t, g, unknown or other
  misc_feature (421)..(421): n is a, c, g, or t
tcagtacagatcgtcacgaccggtgctcgatttagacagtatatatccgcgggggggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaagcaatatacttattggtaccagcagaatcaggccaggcccctgtattgatgatgtaataaagacactgagaggccctcagggatccctgagcgattcnctggctccagctcagggacaacagtcacgttgaccatcagtgagtcaggcagagacgagctgattattacngtacaatcagcagacaaccaanaactacgtcccggtagtttcgggcgggtaacgggaccgaaacggcttacggaaccccggttccttaacgggtccaacggaccccgaacgggacctccggccccccgttcgggtaccccg

SEQ ID NO: 156742 - DNA, 702 bp, Homo sapiens
  misc_feature: GYAE6OF01CF4QG.35.15.B04.1.454.CMB.1.raw
tcagtacagatcgtcacgaccggtgctcgatttagacagtatatatccgcggggggtgggtaccaggaggcagtaaacgtcctgggtggtacctcaccgaatccggcctggatcctctacttctcccctcctcactctctgcaccaggctctcgaggcctaccttatgtagctgacacagccaccctccggtgtctagtcgtccccagggacagaccgccaggactcacctggctcgtggagatgacagttcgacctaaagccaagtactacttataggtaaccagccagaacgtccaggccacggcccctagttacttgagtgattagtaactaaacgacgactagagacgccctcgagggactcccgtgacggtcgtacttcgtcggtggccgtaccgagtccttcgagggtaccaactacgtactacggttacgacctactaccgtaggtacggacgttaccgaaggtacttaacggaaagtaacggttaaggtacttaggtaatttaacgttacgtacgtaacctaaacttacgaacggtacctaacggtaaccgaaaccgtaaaccgtaacgttaaccgggttaccccggttagggtttacgggaacgggtaacgggaaacccgtaacggtcgtacggtaccggtaccgtacggtaccgtacgtacccgaaacggtccttcccgccccgttacccgg

SEQ ID NO: 156743 - DNA, 664 bp, Homo sapiens
  misc_feature: GYAE6OF01AWY3E.35.15.B04.1.454.CMB.1.raw
  modified_base (342)..(342): a, c, t, g, unknown or other
  misc_feature (342)..(342): n is a, c, g, or t
tcagtacagatcgtcacgaccggtgctcgatttagacagtatatagtaccggcgggggtgggtccaggaggcagaacctcctgggtgtctcaccatggcctggatccctctacttctccccctcctcactctctgcacaggctctgaggcctcctatgagctgacacagcccaccctcggtgtcagtcgtccccaggacaggacggccaggactcacctgctcgtggagatgcattcgaccaaagcaaatatacttattggtaccagcagaagtcaggccacggcccctgtattgatgatagtaataaagacacgtgacgacggccctagagggactcccgngacgcgtattctcgtggcctaccgacgctacgacgggaacaacgacgtaccgtacgttacgaacctagtaccgaggtcggacgtacgacggacaaggaaacggacgtacggtactagtaatttaacgtttactacgtaactaactacgaacgaccgaacgaccaaaccaacgtaacgttaccggttcccgttagggtttacgggaccgggttaaccgggaaccgtaacggtaccggttaccggtacccgttacccggttaacggtaccgtaacccggtacccggaaaccgggtccccgttcccggtccccccgttacccggg

SEQ ID NO: 156744 - DNA, 511 bp, Homo sapiens
  misc_feature: GYAE6OF01EQGFL.35.15.B04.1.454.CMB.1.raw
tcagtacagatcgtcacgaccggtgctcgatttagacagtatatatccgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaagcaatatacttattgtaccagcagaagtcaggccaggcccctgtattgatgatgtataaagacactgagacggccctgagggatccctgagcgattctctggctccgagctcgagggacaacgagtctacgttgaccatcgaggtcggtacgtacccgaggtacgaaggaacgacggaggcttagtaatttacgttactgtacaatcgagacagacaccaacatacgtccgtgttcggcggaggacagctgaccgtcaggcagaccagctcgcccgtcg

SEQ ID NO: 156745 - DNA, 557 bp, Homo sapiens
  misc_feature: GYAE6OF01EVJ1Q.35.15.B04.1.454.CMB.1.raw
tcagtacagatcgtcacgaccggtgctcgatttagacagtatatatccgcgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaagcaatatacttattggtaccagcagaagtcaggccaggcccctgtattgatgatgtataaagacactgagacggccctcgagggactcccgtgacgcgtattctctggctccagtctcgaggacaacgagtcacgttgaccatcagtggacgtcaggcagaagacgaggctagtatttatactgtacaatcgagacaacgacaaccaacaacgtacgttaccccggttaggtttacgggaccgggtaacgggaaccaacggccgtacggtacccgtaccggtaacggtccgaacggtaccccggaagggtcccgtaccccgg

SEQ ID NO: 156746 - DNA, 484 bp, Homo sapiens
  misc_feature: GYAE6OF01BQ0B5.35.15.B04.1.454.CMB.1.raw
  modified_base (474)..(474): a, c, t, g, unknown or other
  misc_feature (474)..(474): n is a, c, g, or t
tcagtacagatcgtcacgaccggtgctcgatttagacagtatatatccgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaagcaatatacttattggtaccagcagaagtcaggccaggcccctgtattgatgatgtataaagacactgagaggccctcagggatccctgagcgattctctggctccagctcgagggacaacagtcacgttgaccatcagtggagtccaggcagaagacgaggctgattatactgtcatcagcagacacaacaagtactccgtgttggcggaggaccgagctgccgtctagtcacgccaagcncgcccctcgg

SEQ ID NO: 156747 - DNA, 536 bp, Homo sapiens
  misc_feature: GYAE6OF01AZQBI.35.15.B04.1.454.CMB.1.raw
tcagtacagatcgtcacgaccggtgctcgatttagacagtatatatccgtgtcaggtgcagctggtggagtctgggggaggcttggtcaagcctggagggtccctgagactgtcttgtgcagcctctggattcaccttcagagactatttcatgacctggatccgccagactccagggaagggactggagtgggtctcacacatcagcagtactggcaatcccatgtactacgcagactctgtgaagggccgattcaccattttttaggggacaacgccaagggttcgctgtatctgcaaatgaacagcctgagagtcgaggacacggccatctattactgtgcaagagtctgtagtggtggctagttgttggctacggtactacgacggtatgggacgtcgtggggccaagggaccaaaggtcaccgtctcctcagcttccaccgaacgggcccatccggtcttcccccgtggccgccctcgcctcccgaagacgcaccgtcgtcggggcacgaggccggcccctgggcctccgg

SEQ ID NO: 156748 - DNA, 670 bp, Homo sapiens
  misc_feature: GYAE6OF01CY4JF.35.15.B04.1.454.CMB.1.raw
tcagtacagatcgtcacgaccggtgctcgatttagacagtatatatccgcgggggtgggtccaggaggcagaactctgggtgtctcaccatggcctggatccctctacttcctcccctcctcactctctgcacaggctctgaggcctcctatgagctgacacagccaccctcggtgtcagtcgtccccaggacagacggccaggatcacctgctcgtggagatgcagttgaccaaagcaatatacttatgtacagcagaagtcaggccaggcccctgtattgatgatgtaataaagacacgtgagacgccctacgaggtactcccgtagacgcgtattcgtcgtcggctaccgagtcgtacgacgggaacaaacgacgtactacggtttacgaccaatcgaaggttcggacgttaccgaagggaccaaagggaaaggaaccggagggtactacgtaatttaacgttaacgttagtaacaaacttcgaacggaccaaacgaaccaaacccgaaacgttaaacgtaccgggttacccggttaggtttaccggggaaaccggggtaaccgggtaaccgtaaaccgggtcgttaaccggtacccgggttacccgttaaccggtaccgtaaccggacccgaaagggtccctacccggtccccccgttaccccggg

SEQ ID NO: 156749 - DNA, 589 bp, Homo sapiens
  misc_feature: GYAE6OF01BU356.35.15.B04.1.454.CMB.1.raw
tcagtacagatcgtcacgaccggtgctcgatttagacagtatatatccgcgggggtgggtccaggaggcagaactctgggtgtctcaccatggcctggatccctctacttctcccctcctcactctctgcacaggctctgaggcctcctatgagctgacacagccaccctcggtgtcagtgtccccaggacagacgccaggatcacctgctctggagatgcattgaccaaagcaatatacttattggtaccagcagatcagcaggccctgtatgatgattagtaataaagacacgtgacgagccctacgaaggctacccgtgacgcgtacttctcgtcgctccgagtctacgagggaaccaacgagtaccgacgttacgacctagtacgaaggtggacgtccgaaggacgaaaggaacggacggtaggcgtaaggtactttaacgttacgttagtacaaacttcgaagaccgaacgaactaaccgaaactaagtacgttcccgtaggtttcggacgggtaacggacctaggctacggacccgttacgtacggcctaacggacccgaaggtccgtcccgccccgttacgg

SEQ ID NO: 156750 - DNA, 545 bp, Homo sapiens
  misc_feature: GYAE6OF01BCX7N.35.15.B04.1.454.CMB.1.raw
  modified_base (321)..(321): a, c, t, g, unknown or other
  misc_feature (321)..(321): n is a, c, g, or t
tcagtacagatcgtcacgaccggtgctcgatttagacagtatatatccgcgggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgaccaaagcaatatacttattggtaccagcagaagtcaggccaggcccctgtacttgatgatgtataaagacactgagaggccctgagggactccngagcgattctcgtggctccgagctacgagggacaacgagtcacgttcgactatacagtggaacgtccgtaggcaagaacgacgaggctgtattagttactgtacaatcgaatacgaagacaaccaaactaatacgtaccgttggttcggcggaacgggaccgaaggctcggaccgtccgtaggtaccgacgacccgtaaggcccgtccggcccccgttaccggg

SEQ ID NO: 156751 - DNA, 574 bp, Homo sapiens
  misc_feature: GYAE6OF01A4YWB.35.15.B04.1.454.CMB.1.raw
tcagtacagatcgtcacgaccggtgctcgatttagacagtatatatccgtgtcaggtgcagctggtggagtctgggggaggcttggtcaagcctggagggtccctgagactgtcttgtgcagcctctggattcaccttcagagactatttcatgacctggatccgccagactccagggaagggactggagtgggtctcacacatcagcagtactggcaatcccatgtactacgcagactctgtgaaggccgatcacctatttttagggacaacgccaagggttcgctgtatctgcaaatgaacagcctgagagtcgaggacacggccatctattactgtgcaagagtctgtagtggtggctagttgttggtctacggtactacggtacggttagtgggtacgtcgtggggaccgaaggggaccgtaaggtccgaccgtcctcctaccgagtccttacccgaaccgaacgggcccctacgttccggtccttcccccgtcggcccgcccgtcgccgtaccgacggacgccgcccgtcggtcggggcaccggacggcccggcccgtcgggcgtccgg

SEQ ID NO: 156752 - DNA, 605 bp, Homo sapiens
  misc_feature: GYAE6OF01BOR7W.35.15.B04.1.454.CMB.1.raw
tcagtacagatcgtcacgaccggtgctcgatttagacagtatatatccgtgtcaggtgcagctggtggagtctgggggaggcttggtcaagcctggagggtccctgagactgtcttgtgcagcctctggattcaccttcagagactatttcatgacctggatccgccagactccagggaaggactggagtgggtctcacacatcagcagtactggcaatcccatgtactacgcagactctgtgaaggccgatcacctattttagggacaacgccgaaggttcgctgtatctgacaatgaacagcctgagagtcgagacacggccatctattactgtagcaagagtctgtacgtggtggtcgagtttgttaggccttaacggtacgtacggtacggtagtggacggtacgtggggacccgtaaagggacccgtaaaggtccgtaccgtctaccgtacgacgtccttacccgaaccgaacgggtcccctaacgttccggtaccccgtttcccccgtcgggcccgaccccgttgacccgtccgacggaccgcctacccgtcggtacggggccctaccggaccggccggaccccgtggggcctcccggg

SEQ ID NO: 156753 - DNA, 579 bp, Homo sapiens
  misc_feature: GYAE6OF01CF7QQ.35.15.B04.1.454.CMB.1.raw
tcagtacagatcgtcacgaccggtgctcgatttagacagtatatatccgtgtcaggtgcagctggtggagtctgggggaggcttggtcaagcctggagggtccctgagactgtcttgtgcagcctctggattcaccttcagagactatttcatgacctggatccgccagactccagggaaggactggagtgggtctcacacatcagcagtactggcaatcccatgtactacgcagactctgtgaagggccgattcaccatttttagggacaacgccaaggttcgctgtatctgcaaatgaacagcctgagagtcgaggacacggccatctattactgtagcaagagtctgtagtggtggctagttgtggctacggtactacgacggtatggacgtcgtggggtccaaggggaccaaaggtccaaccgttctccctcgacgccttaccgacccaacggggtccccaagttccggtccttcccccgtcggcccgtcccgttcggccttcccgacgggtacgccgtaacccgtccgtacggggggcctaccgtacggcccggccccgtggggccgtcccggg

SEQ ID NO: 156754 - DNA, 489 bp, Homo sapiens
  misc_feature: GYAE6OF01B5CQZ.35.15.B04.1.454.CMB.1.raw
  modified_base (426)..(426): a, c, t, g, unknown or other
  misc_feature (426)..(426): n is a, c, g, or t
tcagtacagatcgtcacgaccggtgctcgatttagacagtatatatccgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaagcaatatacttattggtaccagcagaagtcaggccaggcccctgtattgatgatgtataaagacactgagaggccctgagggatccctgagcgattctctggctccagctcgagggacaacgagtcacgttgaccatcagtggagtccaggcagaagacgaggctgattattactgtcaatcagcagacacaanaatacgtcctgttggcggaggaccaagctcgccgtctaggtcacgccaaggctcgccccgtcg

SEQ ID NO: 156755 - DNA, 516 bp, Homo sapiens
  misc_feature: GYAE6OF01BH9LU.35.15.B04.1.454.CMB.1.raw
  modified_base (465)..(465): a, c, t, g, unknown or other
  misc_feature (465)..(465): n is a, c, g, or t
  modified_base (479)..(479): a, c, t, g, unknown or other
  misc_feature (479)..(479): n is a, c, g, or t
  modified_base (484)..(484): a, c, t, g, unknown or other
  misc_feature (484)..(484): n is a, c, g, or t
  modified_base (486)..(486): a, c, t, g, unknown or other
  misc_feature (486)..(486): n is a, c, g, or t
  modified_base (492)..(492): a, c, t, g, unknown or other
  misc_feature (492)..(492): n is a, c, g, or t
tcagtacagatcgtcacgaccggtgctcgatttagacagtatatatccgtgtcaggtgcagctggtggagtctgggggaggcttggtcaagcctggagggtccctgagactgtcttgtgcagcctctggattcaccttcagagactatttcatgacctggatccgccagactccagggaagggactggagtgggtctcacacatcagcagtactggcaatcccatgtactacgcagactctgtgaagggccgattcaccattttttaggggacaacgccaagggttcgcctgtatctgcaaatgaacagcctgagagtcgaggacacggccatctattactgtgcaagagtctgtagtggtggcagttgttggctacggtactacgacggtatggacgtctggggccaaggggaccaaggtcaccgtctcctcagcttaccaccagggcccagtcgtcttccccngcgccctgctccgnggacncnccgtcnggggcacgagcgccctgggctcgg

SEQ ID NO: 156756 - DNA, 501 bp, Homo sapiens
  misc_feature: GYAE6OF01AK7WG.35.15.B04.1.454.CMB.1.raw
  modified_base (432)..(432): a, c, t, g, unknown or other
  misc_feature (432)..(432): n is a, c, g, or t
tcagtacagatcgtcacgaccggtgctcgatttagacagtatatatccgcgggggggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaagcaatatacttattggtaccagcagaagtcaggccaggcccctgtattgatgatagtataaagacactgagacggccctgagggactcccgtgagcgattctctggctccagctcgagggacaacagtcacgttgaccatcaggtggagtccgaggcaagaagacgaggctgattattactgtcaatcagcagacaaccaanatacgtcccgtgttcggcggaggaccagctagaccgtctacggcacgccaggcctcggcccctggtccc

SEQ ID NO: 156757 - DNA, 560 bp, Homo sapiens
  misc_feature: GYAE6OF01C1PBM.35.15.B04.1.454.CMB.1.raw
  modified_base (362)..(362): a, c, t, g, unknown or other
  misc_feature (362)..(362): n is a, c, g, or t
  modified_base (450)..(450): a, c, t, g, unknown or other
  misc_feature (450)..(450): n is a, c, g, or t
tcagtacagatcgtcacgaccggtgctcgatttagacagtatatatccgcgggggggtccaggaggcagaactctgggtgtctcaccatggcctggatccctctacttctcccctcctcactctctgcacaggctctgaggcctcctatgagctgacacagccaccctcggtgtcagtcgtccccaggacagacggccaggatcacctgctctggagatgcattgaccaaagcaatatacttattggtaccagcagaagtcaggccaggcccctgtattgatgatgtaataaagacactgagaggccctagagggtactcccgtagagcgtattctctggcctcaagtctcgagggacaacngtactacgttcgaccatcaggtggactccaggacaagaacgacgaggctagtatattactagtacaatcaagacaacgaacaaccaanaactacgtccgttagttaggaccggtacggaccaacgtcgtacgaaccggttcccgttaacggtacgaacgtaccccgaaagtccccgtaccgtcccccgtggttacccc

SEQ ID NO: 156758 - DNA, 693 bp, Homo sapiens
  misc_feature: GYAE6OF01CO1T8.35.15.B04.1.454.CMB.1.raw
tcagtacagatcgtcacgaccggtgctcgatttagacagtatatatccgcgggggggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcgacctgcctctggagatgctagttgaccaaagcaaatatacttattggtaccagtcagaagtcaggccaggcccctgtacttgatgatagtataaagacatgagacgcctagaggctcccgtagagcgtattcgtacgtcggacctccgagtccgtacgacgggtaacaaacgtacgtacctaacgttcgaacctattacgaaggtcgacgtacccgaggacgaaggaacgacggtaggtacgttaggtaactttaacgttacgttagtacgtaacgtacgtaacgacgtaaaccgaaacctaacctaaaccgttaaacgtttaacccgggttacccgtttagggttttacgggaaccgggtaacggggtaacccaaaccgggttccgttaccgggtaacccggttacccgggtttaacgggacccgtaaccggtaaccccggtaaacgggtcccgtacccggtccccccggttacggttaacccccg

SEQ ID NO: 156759 - DNA, 542 bp, Homo sapiens
  misc_feature: GYAE6OF01CD9JK.35.15.B04.1.454.CMB.1.raw
  modified_base (372)..(372): a, c, t, g, unknown or other
  misc_feature (372)..(372): n is a, c, g, or t
tcagtacagatcgtcacgaccggtgctcgatttagacagtatatatccgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaagcaatatactttattggtaccagacagaagtcaggccaggcccctgtatgatgatgtataaagacacgtgagaggccctgacgggatcccgtgagcgattctctggcctcagctacgacgggacaacgcgtacacgttnaccatacagtggacgtcgaggacagagacgagctagattatactgtacaatcagacaagtacaaccaataattcgtacccgttggttacggacgggaagggtacccgaaggtcctacggacccgttaccgtaggaccacgacccgaaggtcctccgggcccccttacggg

SEQ ID NO: 156760 - DNA, 500 bp, Homo sapiens
  misc_feature: GYAE6OF01DA67Z.35.15.B04.1.454.CMB.1.raw
  modified_base (489)..(489): a, c, t, g, unknown or other
  misc_feature (489)..(489): n is a, c, g, or t
tcagtacagatcgtcacgaccggtgctcgatttagacagtatatatccgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaagcaatatacttattggtaccagcagaagtcaggccaggcccctgtattgatgatgtaataaagacactgagagccctgagggactcccgtgagcgtattctctggctccagctcgagggacaacagtcacgttgaccatcgagtggagtccaggcaagagacgaggctagattattactgtcaatcagcagacaccaacaagtacgtccgtagttggcggaggaccaagctacgaccgtacgtaggcacgccagcncgccccgtcgg

SEQ ID NO: 156761 - DNA, 572 bp, Homo sapiens
  misc_feature: GYAE6OF01EIZZA.35.15.B04.1.454.CMB.1.raw
tcagtacagatcgtcacgaccggtgctcgatttagacagtatatatccgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaagcaatatacttattggtaccagcagaagtcaggccaggcccctgtattgatgatgtataaagacatgagaggccctcagggactcccgtgagcgatttctactggctccgagcctacgagggacaacagtctacgttgaccatcagtggagtcaggcaggaagacgaggctagtattattactagtacaatcagacaagaccaaccaaacgtaacttacggtcccgttagggtttacgggacgggaacgggtaccaacggtcgtacggtacccggttaccgttacgggtaccgaaccggaccccgaaagggtccctcccggtcccccccggttacccggg

SEQ ID NO: 156762 - DNA, 601 bp, Homo sapiens
  misc_feature: GYAE6OF01ENNQ5.35.15.B04.1.454.CMB.1.raw
tcagtacagatcgtcacgaccggtgctcgatttagacagtatatatccgtgtcaggtgcagctggtggagtctgggggaggcttggtcaagcctggagggtccctgagactgtcttgtgcagcctctggattcaccttcagagactatttcatgacctggatccgccagactccagggaagggactggagtgggtctcacacatcagcagtactggcaatcccatgtactacgcagactctgtgaaggccgattcacctattttagggacaacgccaaggttcgctgtatctgcaaatgaacagcctgagagtacgaggacacggcatctatactgtgcagagtctgtagtggtgctagttgttgctacggtactacgtacggtatggacgttcgtgggaccgaaagggtaccaagggtcaaccggttcttcccgtcgaacgtccgttacccgaccgtaaacgggtccccgtaacgttcccggtccgttaccccccgtggcccgtaccccgttcggccgttcccggacgggaccgcccgtacccgttcggtcgggggaccctacggaccgggtcccggaccccggtggggcccgtccgggg

SEQ ID NO: 156763 - DNA, 688 bp, Homo sapiens
  misc_feature: GYAE6OF01BXSCJ.35.15.B04.1.454.CMB.1.raw
tcagtacagatcgtcacgaccggtgctcgatttagacagtatatatccgcgggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgaccaaagcaatatacttattggtaccagcagaagtcaggccacggcccctgtattgatgatgtaataaagacactgacgacggccctacgagggactcccgtgacgtcgtattctctcggcctaccgagtcctacggacgggtaacaacgagtccacggttacgaccactacgtacggtgggacgttacccgaagggtacgaaggaacggaacggacggtactagttagtttaacttaacgttgtaacctaattaccgaagacgaacgtaacccaaacccgaaaaccgtaacgttaaccggttaccccggtttacgggttttaccgggaccgggggtaaaccggggtaacccgtaacgggtccgttaaccgggtaacccggttaccccggttaacgggttacccgtaaccggtaaccccgtaacggggtccccgttacccgggccccccccggttacccggg

SEQ ID NO: 156764 - DNA, 543 bp, Homo sapiens
  misc_feature: GYAE6OF01CJVRZ.35.15.B04.1.454.CMB.1.raw
  modified_base (402)..(402): a, c, t, g, unknown or other
  misc_feature (402)..(402): n is a, c, g, or t
tcagtacagatcgtcacgaccggtgctcgatttagacagtatatatccgtgtcaggtgcagctggtggagtctgggggaggcttggtcaagcctggagggtccctgagactgtcttgtgcagcctctggattcaccttcagagactatttcatgacctggatccgccagattccagggaagggactggagtgggtctcacacatcagcagtactggcaatcccatgtactacgcagactctgtgaaggccgattcacctatttttagggacaacgccaaggttcgctgtatctgacaaatgaacagcctgagagtcgaaggacacggccatctattactgacgcaagagtctgtagtggtgcgtagttgttggctacggtactacgacggtatggacgtcgngggacaagggaccaaggtcaccgtctcctacgacgtcctaccaccgaacgggcccagtccggttccttccccgtcggccgtccctgtccgtccgacggacgctaccgtcgtcggggcacgacggccggccgtgggcgtcgg

SEQ ID NO: 156765 - DNA, 584 bp, Homo sapiens
  misc_feature: GYAE6OF01CPCE2.35.15.B04.1.454.CMB.1.raw
tcagtacagatcgtcacgaccggtgctcgatttagacagtatatatccgcgggggcctggggagcctagctgtgctgtgggtccaggaggcagaactctgggtgtctcaccatggcctggatccctctacttcctccccctcctcactctctgcacaggctctgaggcctcctatgagctgacacacgcccaccctcggtgtcagtcgtccccaggacaggacggccaggactccacctgctcgtggagatgcattcgaccaaaagcaaatatacttattggtaccagcagaagtcgaggccaggaccctgtatgatgatgtaataaagacacgtgaagacggccctagagggactcccgtgacgcgtattcgtctggcctcagctacgacgggacaacgacgtcgtacgttacgaccagtcgaggtacgagtacccgaggacaaggaacgacggaggtcgtagtatttaattactacgtacaatacgagacaacgaaccaaaccgaaactaaacgttaccggttcccggttaggtttacgggaccgggtaaacgggaccgaaacggtccgtacggtaacccgg

SEQ ID NO: 156766 - DNA, 494 bp, Homo sapiens
  misc_feature: GYAE6OF01CLNB6.35.15.B04.1.454.CMB.1.raw
  modified_base (306)..(306): a, c, t, g, unknown or other
  misc_feature (306)..(306): n is a, c, g, or t
  modified_base (410)..(410): a, c, t, g, unknown or other
  misc_feature (410)..(410): n is a, c, g, or t
tcagtacagatcgtcacgaccggtgctcgatttagacagtatatatccgcgggggggtccaggaggcagaactctgggtgtctcaccatggcctggatccctctacttctccccctcccactctctgcacaggctctgaggcctcctatgagctgacacagccaccctcggtgtcagtgtccccaggacagacggccaggatcacctgctctggagatgcattgccaaagcaatatacttattggtaccagcagaagtcaggccaggccctgtattgatgatgtataaagacactgagaggccctnagggatccctgagcgattctctggctccagctcagggacaacagtcacgttgaccatcagtggagtcaggcagaagacgaggctagattatactgtacaatcancaagacaaccaactaatacgtccgtgttggacggaggaccagcgtcgacgtcgtagcacgccgacggctcgcccctgtctaccg

SEQ ID NO: 156767 - DNA, 605 bp, Homo sapiens
  misc_feature: GYAE6OF01BIMYT.35.15.B04.1.454.CMB.1.raw
tcagtacagatcgtcacgaccggtgctcgatttagacagtatatatccgcgggggtgggtccaggaggcagaactctgggtgtctcaccatggcctggatccctctacttctccccctcctcactctctgcacaggctctgaggcctcctatgagctgacacagccaccctcagtgtccgtgtccccaggacagacagccagcatcacctgctctggagataaggttgggataaatatgcttgctggtatcagcagagcagccacgtccctgtgttgcatctatcaagatagacaagccgacctgacggactccgtgacgcgtacttctcgtggtacctaccaactcgtacggaacaacgacgcctactactacgacctactaccgacgggaccggaccccaggtacgtaacgtggacgtgggacgtcgtacgtaacttagttacgtgtacgacgggcggtacggaacacgtacgagaccgtacgttggttaggtacgttaccggggacgggtaaccggaacgtaacggccgttacgggtacccgttaccggtaacggtacccgaacggtaccccgaaacggtccccgcccgttaaccccccggg

SEQ ID NO: 156768 - DNA, 605 bp, Homo sapiens
  misc_feature: GYAE6OF01ALJ08.35.15.B04.1.454.CMB.1.raw
  modified_base (278)..(278): a, c, t, g, unknown or other
  misc_feature (278)..(278): n is a, c, g, or t
  modified_base (337)..(337): a, c, t, g, unknown or other
  misc_feature (337)..(337): n is a, c, g, or t
tcagtacagatcgtcacgaccggtgctcgatttagacagtatatatccgtgtcaggtgcagctggtggagtctgggggaggcttggtcaagcctggagggtccctgagactgtcttgtgcagcctctggattcaccttcagagactatttcatgacctggatccgcagactccagggaaggactggagtgggtctcacacatcagcagtactggacaatcccatcgtactacgcagactctgtgaaggcgattcacattttaggacacgcgaaggtcnctgtatctgcaaatgaacagcctgagagtcgaggacacggcatctaattctgtgcaagngtctgtagtggtgtctagttgtcgcttaggtactacggtacgtatggacgtggtcgggcgaacgggaccgtaagtcccgtaccggtccttaccgcgtaacgtccgtttacccaaccggtaccgggtacccctacgttcccggttaccctttaccccccggtgtccccggtccccgtaccgtccgaaccggtacgggaccgtaccgaccccgttcggacgggggaccctaaccgacgggtcccgggtccccgtagggtccctaccgggg

SEQ ID NO: 156769 - DNA, 721 bp, Homo sapiens
  misc_feature: GYAE6OF01B0J09.35.15.B04.1.454.CMB.1.raw
  modified_base (220)..(220): a, c, t, g, unknown or other
  misc_feature (220)..(220): n is a, c, g, or t
tcagtacagatcgtcacgaccggtgctcgatttagacagtatatatccgcgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgganatgcattgaccaaagcaatatacttattggtaccagcagaagtcaggccaggcccctgtattgatgatagtaataaagacacgtgagacgccctagagggactcccgtgacgcgtattctacgtcggtccttccgacgtcctacggacggggtaaccaaccgtagtccgaacgtttacgaaccctacgttacgaggttcgggtaacgttaccccgaacgggaccgtaaacgggaaacggaaccgggtaaggtccgttaacggttaaagtttaacgtttaaccgtttaggttaaccgtaacgttaccgaagtaaccgaacgtaaaccctaacccgaaaccgtaaacgttaccggttaccccggttagggttttaccggggaccgggtaaacgggtacccgtaacggtaccgttaacgggtaccccgttaccggttaacgggttacccgaacgggtaccccgtaaagggtccccgttacccggtcccccccggttaacccggg

SEQ ID NO: 156770 - DNA, 688 bp, Homo sapiens
  misc_feature: GYAE6OF01D7UD4.35.15.B04.1.454.CMB.1.raw
tcagtacagatcgtcacgaccggtgctcgatttagacagtatatatccgcggggggggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctcgtggagatgctattgaccaaagcaattatacttattaggtaccagcagaagtcaggccaggcccctgtatgatgatgtaataaagacacgtagagacggccctacgagggtactcccgtgacgcgtacttctcgtcggcctaccgacgcctacgaacgggaaccaaacgtacggtaccgtaacggttacgaaccgtaagtaccgtaacggttacgggaccgtacggtaacggacgaaggaacgaacggaggtaccgtagtaacgtttaagttacgtacggttactaatacgaacgtacgaaacgtaaccaaccgtaaacgtaacgttaccggttacccggtttacgggtttaccggggaccgggtaacgggaacccgtaagggtccgttaaccggtacccgttaccgggttaaccggtaccgaaccgtaccccgaacggtcccgtccccggttcccccgtccgggttacccccg

SEQ ID NO: 156771 - DNA, 713 bp, Homo sapiens
  misc_feature: GYAE6OF01BX22E.35.15.B04.1.454.CMB.1.raw
  modified_base (296)..(296): a, c, t, g, unknown or other
  misc_feature (296)..(296): n is a, c, g, or t
  modified_base (322)..(322): a, c, t, g, unknown or other
  misc_feature (322)..(322): n is a, c, g, or t
  modified_base (350)..(350): a, c, t, g, unknown or other
  misc_feature (350)..(350): n is a, c, g, or t
tcagtacagatcgtcacgaccggtgctcgatttagacagtatatatccgtgtcaggtgcagctggtggagtcgtgggggaggcttggtcaagcctggagggtccctgagactgtcttgtgcagcctctggattcaccttcagagacttatttcatgacctggactccgccagactccgagggaaggactggaggtgggtctcgacacatcagcagtactggcaactcccatcgtactacgcagactctgtgaacggccgatcactagtttaggacaacgccgaaggttcgcttgtntctgactaaatcgaacagcctgaagngtacgagacacggccagtctaattacgngtacgacgaagtgttacgtgtaggtggtcgtagttcggttggtcggtacgttacggtacgtacgggtaacggttaggtacggtacggttcgggacgggaaccggtaacgggtaaccggtaacggtacccgtacccgttccgtacccgtaacgtccgttcccgttaaccccgaaccggtaacccgggtaccccgttaccggtttaccccgggttccccccgttaccccggtccggaccccgttccccggtccggtacccgtacccggacggttaccgccccggttacccggtccggggtacccgggggaccctaccgggtacccgggaccccgggtcccggtccggggtcccgttaccccgggg

SEQ ID NO: 156772 - DNA, 535 bp, Homo sapiens
  misc_feature: GYAE6OF01EZE2V.35.15.B04.1.454.CMB.1.raw
  modified_base (359)..(359): a, c, t, g, unknown or other
  misc_feature (359)..(359): n is a, c, g, or t
tcagtacagatcgtcacgaccggtgctcgatttagacagtatatatccgcgggggcctggggagcctagctgtgctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaagcaatatacttattggtaccagcagaagtcaggccaggcccctgtatgatgattgtaataaagacacgtgaggaggccctagagggactcccgtgagcgatttcnctggctccagctcgagggacaacagtacacgttgaaccatctagtggacgccgagggacagaaaggacggaaggctagtatttacttagtcgtactaatctagacaagaccaaccaaacaatacgtacccgtggtttacggacgggtaacgggacccaaggtcgtcggtaacccgg

SEQ ID NO: 156773 - DNA, 571 bp, Homo sapiens
  misc_feature: GYAE6OF01C7OR5.35.15.B04.1.454.CMB.1.raw
tcagtacagatcgtcacgaccggtgctcgatttagacagtatatatccgcgggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaagcaatatacttattggtaccagcagaagtcaggccaggcccctgtattgatgatgtataaagacactgagacggccctacgagggactccctgacgcgtattctcgtggtctccagctacgagggaacaacgtagtcacgttgaccctatcgaagttggacgtccgaggcaagaacgacgaggtactagtactttattacgtgtacaatccgtaagactaagaccaacctaaacaattacgtacccgttggtttacgggccgggtaagggacccgaacggtctcggaacccgttaccgtacggtcgtaacgacccgaaggtccctccgtcccccgtccgg

SEQ ID NO: 156774 - DNA, 512 bp, Homo sapiens
  misc_feature: GYAE6OF01BQ4FJ.35.15.B04.1.454.CMB.1.raw
  modified_base (417)..(417): a, c, t, g, unknown or other
  misc_feature (417)..(417): n is a, c, g, or t
tcagtacagatcgtcacgaccggtgctcgatttagacagtatatatccgcgggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgaccaaagcaatatacttattggtaccagcagaagtcaggccaggcccctgtattgatgatgtataaagacactgagaggccctgagggactccctggagcgtattctcgtcggctccgagctcgagggacaacagtcacgttagaccatcagtggagtccaggcaagaagacgaggctagtattattactntacaatcagcaagaccaccaacaatacgtccgtgttggcggaggaccagctcggaccgtcgtacggtacacgacccaggcctccgccccgtacgg

SEQ ID NO: 156775 - DNA, 514 bp, Homo sapiens
  misc_feature: GYAE6OF01BN58A.35.15.B04.1.454.CMB.1.raw
  modified_base (423)..(423): a, c, t, g, unknown or other
  misc_feature (423)..(423): n is a, c, g, or t
  modified_base (433)..(433): a, c, t, g, unknown or other
  misc_feature (433)..(433): n is a, c, g, or t
tcagtacagatcgtcacgaccggtgctcgatttagacagtatatatccgcgggggggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgctattcgaccaaaagcaatatacttattggtaccagcagaagtcaggccaggcccctgtacttgatgatgtataaagacactgagaggccctgagggatcccctgagcgattctctggctccagctcgagggtacaaacagtacacgttcgaccaatcgagtggacgtccgaggcagaaagacggagcgtgattattacgtntacaatcgancagaccaaccaacaatacgtccgtgttggacggaggaccagctgaccgtcaggtcacgccgagcctcgccccgtggtaccc

SEQ ID NO: 156776 - DNA, 646 bp, Homo sapiens
  misc_feature: GYAE6OF01EX37O.35.15.B04.1.454.CMB.1.raw
  modified_base (295)..(295): a, c, t, g, unknown or other
  misc_feature (295)..(295): n is a, c, g, or t
tcagtacagatcgtcacgaccggtgctcgatttagacagtatatatccgcggggggggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattgaccaaagcaatatacttattggtaccagcagaagtcgaggccacggcccctgtattgatgatagtaanaaagacacgtgagacggccctacgagggctcccgtggacgtcgtacttctcgtggcctcgacgtcctcgaacggggaaccaaacgtacggtacctaaccggttacgaaccctagtacgtaaggtagggacggtacccgaggacgaaggaacggaacggagggtacgtagtaatttagttacgtagtacatacagacacgaaccaacctaaactaacgttacggtcccggttagggttacggggacgggtaaccgggaaccgtaacgggtccgtacggtacccggttaccgtacgggtacccgaacggtaccccggaacggtcccgtcccggtcccccgtcgggttaccccg

SEQ ID NO: 156777 - DNA, 638 bp, Homo sapiens
  misc_feature: GYAE6OF01CC51T.35.15.B04.1.454.CMB.1.raw
tcagtacagatcgtcacgaccggtgctcgatttagacagtatatattccggtcgggggggtccacggaggcagaactcgtggggtgtctcaccatggcctggatccctctacttctcccctcctcacctctctgcacaggctctgaggcctcctatgagctggacacagtcctacccgtggtgtcgtaggtcgtcccctagggacctaggacggtccgaggatccgaccgtgcgtctagggacagtgcctattcgaccaaagcctaaatactacgttacttggtacccagtccaggaacgtccacggccaaggcccctgtacttgagtcgatagtacgtaaacgacgacgtgacggtaggcccctacgagggtacttccccgtaggacgcgtactttcgtcgtacgggccgttccaggccgtacgacggggtacaaacgagtcacgttcgaccatcgagtggacgtcgaggcaggaacgacggaggctagtatttattactgtacaatcgagcagacaccaaactaatacgtccgttggttcgggacggtacgggaccaaggccgtaggtacccggtccgttacggttaccgaaccggtccccgaaggtcctccggtccccccgttcgggttaccccg

SEQ ID NO: 156778 - DNA, 625 bp, Homo sapiens
  misc_feature: GYAE6OF01B3TP0.35.15.B04.1.454.CMB.1.raw
tcagtacagatcgtcacgaccggtgctcgatttagacagtatatatccggtgtcaggtgccagctaggtggagtctgggggagcttggtcaacgcctggagggtcccctgagactgtcttggtgcagcctcgtggatttcctacctttcgaggagactatttcatcgaacctggactccgccaggactccgaggggaaggctggagtgggtctcacgacgatcgagccgagttactggacaaacgtcccatgtaacctacgccagtactctgtcgaagggccgattccaactagtttttacggactaacgccgtaagggtcgcgtcgtatcgtggctaaagtgaacgagtccgtagtagtagtcgaaggacacggcctatacgtaattactgtgcaaggtgtcgtgtagtggtgctagttgtggcgtacggtactacggtacggtagtacggacgtacgtcgggacgtaacgggtaccaagggtccaccgttctccgtacagttccgtaccgaaccgtacgggtccctattccggtacccttccccgtgcccgtccgtcgtaccgccgaggaccgcgtcccgtcggtcgggacctacggacgcccggtcccgtgggccttacggg

SEQ ID NO: 156779 - DNA, 217 bp, Homo sapiens
  misc_feature: GYAE6OF01BVMB0.35.15.B04.1.454.CMB.1.raw
  modified_base (211)..(217): a, c, t, g, unknown or other
  misc_feature (211)..(217): n is a, c, g, or t
tcagtacagatcgtcacgaccggtgctcgatttagacagtatatatccgcgggggaccaaggtcaccgtctcctcagcttccaccaagggcccatcggtcttcccctggcgccctgctccaggagcacctctggggacacagcggccctgggctgcctggtcaaggactacttccacgatctgtactgagcgggctggcaaggcgcatagnnnnnnn

SEQ ID NO: 156780 - DNA, 670 bp, Homo sapiens
  misc_feature: GYAE6OF01A66WW.35.15.B04.1.454.CMB.1.raw
tcagtacagatcgtcacgaccggtgctcgatttagacagtatatatccgcgggggtgggtccaggaggcagaactctgggtgtctcaccatggcctggatccctctacttctcccctcctcactctctgcacaggctctgaggcctcctatgagctgacacagccaccctcggtgtcagtgtccccaggacagacgaccaggatcacctgctctggagatgcattgaccaaagcaatatacttattggtaccagcagaagtcaggccaggcccctgtattgatgatgtataaagacactgagacggccctgaggactcccgtagacgtcgtattctcgtcggcctccgagtcctacgacggggtaaccaaacgtaggtacctaccggttcgaaccctagttaccgaggttacgggaacgtcccgaagggaccgaaaggaaacgacgggaaggtaccgttagtaacgtttacgtttacgtcgttaaccaagttacgaaggacaacgtaacctaaaccaaaacgtaacgttaaccggttccccggttagggtttacgggaccgggaacggggaacccgtaagggtaccgtacggtaaccccggttaccggttaaacgggtaccctaacggacccccggaagggtcccgttcccggtccccccggttaccggg

SEQ ID NO: 156781 - DNA, 495 bp, Homo sapiens
  misc_feature: GYAE6OF01D44JK.35.15.B04.1.454.CMB.1.raw
  modified_base (241)..(241): a, c, t, g, unknown or other
  misc_feature (241)..(241): n is a, c, g, or t
  modified_base (455)..(455): a, c, t, g, unknown or other
  misc_feature (455)..(455): n is a, c, g, or t
tcagtacagatcgtcacgaccggtgctcgatttagacagtatatatccgcgggggcctggggagcctagctgtgctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgganatgcattgccaaagcaatatacttattggtaccagcagaagtcaggccaggaccctgtattgatgatgtaataaagacactgagaggccctcgagggactcccgtgagcgattctctggctccagctcgagggacaacagtcacgttgaccatcagtggagtccaggcaagaagacgaggctagattattactgtacaatcagcagacaccaanaatacgtcccgtgttcggcggaggaccaagcgtgtacccg

SEQ ID NO: 156782 - DNA, 505 bp, Homo sapiens
  misc_feature: GYAE6OF01B8XH2.35.15.B04.1.454.CMB.1.raw
tcagtacagatcgtcacgaccggtgctcgatttagacagtatatatccgcgggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgaccaaagcaatatacttattggtaccagcagaagtcaggccaggcccctgtatgatgatgtataaagacactgagaggccctcgagggactccctgacgcgtattctcgtcggctccagctcgagggacaacgagtcacgttgaccatcgagtggacgtccaggcaagaagacgaggctgattatactgtacatcagcagacaacaacatacgtccgtgttcggacggaggaccgagtcacggtccgtcgtaggcacgaccaggctcgccccgtaccgg

SEQ ID NO: 156783 - DNA, 662 bp, Homo sapiens
  misc_feature: GYAE6OF01A9838.35.15.B04.1.454.CMB.1.raw
  modified_base (236)..(236): a, c, t, g, unknown or other
  misc_feature (236)..(236): n is a, c, g, or t
tcagtacagatcgtcacgaccggtgctcgatttagacagtatatatccgcgggggcctggggagcctagctgtgctgtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggacttaccgngctcgtggagatgctattgtacaagtaaagtagtttttgggtttttaggaaccgtaagaagtagtcgaggccacggtcccctggtccttggtctagttcggttcgaggacgacgaacgccggtacccgtccgggactcccgtgacgagtacttcgtcgtcggcctccgagctcgagggtactagtcggtctaccttgacttcgactcgacgtcggggaccctagggtcggaggtagtagggacggtcgtgtaacttagtttagtttggttacgttaacaaacgtaaacgttaccaagttagttaattttaacgtttttcggtacggggtttacgtccggggtacgggtaacggttaccgttaagggttcgtaacgttggttaccgtacgggttaccgaccggtcccgtaagggtccctaccccggg

SEQ ID NO: 156784 - DNA, 580 bp, Homo sapiens
  misc_feature: GYAE6OF01EK0HV.35.15.B04.1.454.CMB.1.raw
  modified_base (454)..(454): a, c, t, g, unknown or other
  misc_feature (454)..(454): n is a, c, g, or t
tcagtacagatcgtcacgaccggtgctcgatttagacagtatatatccgcgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaagcaatatacttattggtaccagcagagtcaggcaggccctgtatgatgatgtataaagcactgagaggccctgagggtactccgtgagcgtattctcgtggctcagtcctcgaagggacaaacagtcacgttcgacctagtcaaggtggagtcgaaggacagtaagacggtaggcttaggtaatttaacgtaacttcggtaactaaattcgaacgtanaacgaaccaaaccgtaaataacgtacgttacccggttagtttacgggaccgggaagggtaaccaaggtcctacggacccgttaccgttacggtaccaacggaccccgtaaaggtccgtaccccggg

SEQ ID NO: 156785 - DNA, 760 bp, Homo sapiens
  misc_feature: GYAE6OF01CW72V.35.15.B04.1.454.CMB.1.raw
  modified_base (174)..(174): a, c, t, g, unknown or other
  misc_feature (174)..(174): n is a, c, g, or t
  modified_base (246)..(246): a, c, t, g, unknown or other
  misc_feature (246)..(246): n is a, c, g, or t
tcagtacagatcgtcacgaccggtgctcgatttagacagtatatatccggcgggggtgggtccaggaggcagaactctgggtgtctcaccatggcctggatccctctacttcctcccctctcactctctgcacaggctctgaggcctctatgagctgacacagccaccgtggtntacagtcgtacccaggacagacggccaggtactccacctgctcgtgagatgctattcgaacaagctaattanacgtttatacggtaaccagacgtaagaacgtccgacggtaccaacggtccccttaggtattacggatagtatacgtaaagtaaaacgacctacgttacgacggtacggtccccgtaagacgggtacttcccgaggaacgtcgttacgttacgttcgtacggtcgtaacccgtaacggcgttaaccggaacgggaacctaaacggtacgtacccgtaggtttaccaaccgtaacgttccgaggttacgggacttaccggaaggacaacggaacggtacgtacggtacttagtaacttttaacttacggtacgttaacagttaaaccgagggttaacctaacgttacccgaaaacccggttaaacttaaccgggttaacgttccccgggttttaaggtaaccggttaacggggggaaacccttaacggtaacgtaacccggttccgaaacggttcccggtaagtacccgtaaccgtaaccggtaacgtcgtaacccccgtttcccgttaacccggg

SEQ ID NO: 156786 - DNA, 641 bp, Homo sapiens
  misc_feature: GYAE6OF01CQBGK.35.15.B04.1.454.CMB.1.raw
  modified_base (256)..(256): a, c, t, g, unknown or other
  misc_feature (256)..(256): n is a, c, g, or t
  modified_base (277)..(277): a, c, t, g, unknown or other
  misc_feature (277)..(277): n is a, c, g, or t
tcagtacagatcgtcacgaccggtgctcgatttagacagtatatatccgcggggagctctgggagaagagccccagccccagaattcccaggagtttccattcggtggtcagctctgaacacagaggactcaccatggagtttgggctgagctgggttttcctgttgctattataaaaggtgtccggtgtcaggtgcagctggtggagtcgtgggggagcttggtcaagcctgggaggtccctgagactgtcttgngcagcctctggattcaccttnaagagtactattcatgacctggactccgccagcctccgagggaggactgggagtcgggtctacgacgacatcgagcaggtacctggaccaatcccaatcgtaacctacgcagtactctgtaggaacgggaccgtacgttacaccgttaagttttaacgggaacgtaaccgtacccgtaacggggttaccgacgtagttacttcgtacggactaaagtacgaaacgagtacccgtaggaacggtacgtacggacgggaaccgtaaccgggacctaacgtacgttaacgtttaaccggttagttacggaacgtaaacggtagttacgtacgggttacggttaggggtcggtacggtggtttacggg

SEQ ID NO: 156787 - DNA, 669 bp, Homo sapiens
  misc_feature: GYAE6OF01E514T.35.15.B04.1.454.CMB.1.raw
tcagtacagatcgtcacgaccggtgctcgatttagacagtatatatccgcgggggtgggtccaggaggcagaactctgggtgtctcaccatggcctggatccctctacttctcccctcctcactctctgcacaggctctgaggcctcctatgagctgacacagccacccttggtgtcagtcgtccccaggacagaccggccaggatcacctgctgtggagatgctattcgaccaaagcaaatattacttattggtaaccagcagaagtcaggaccacggcccctgtatgatgatagtaataaagacacgtaggagacggccctacgaggtactcccgtaggacgtacgtattctccgtcggcctccgacgtcgtacgaacgggaaccaacgtacgtactacgttacgaccatacgaggtacggacgtaccggaaggacgaaggaaacggacgaggtactagttaacttacgtttacgtacgttaactaactacgaacgacgaacgtaaccaaaccgtaaactaacgttaccgttccgggttacgggtttacggggaccgggaaacgggtaacccgtaacggttaccgtacccgggtacccggttacccgtaacggttacccgaaccggaccccggaacggtcccgttacccggcccccggttacccggg

SEQ ID NO: 156788 - DNA, 563 bp, Homo sapiens
  misc_feature: GYAE6OF01BUGEJ.35.15.B04.1.454.CMB.1.raw
tcagtacagatcgtcacgaccggtgctcgatttagacagtatatatccgcgggggggtccaggaggcagaactctgggtgtctcaccatggcctggatccctctacttctccccctcctcactctctgcacaggctctgaggcctcctatgagctgacacagccaccctcggtgtcagtgtccccaggacagacggccaggactcacctgctctggagatgcattgccaaagcaatatacttattggtaccagcagaagtcaggccaggcccctgtattgatgatgtaataaagacactgagacggcctcgagggactcccgtgacgcgtatttctcgtcggcctccagctacgagggacaacagtcacgttgacctatcgagtggacgtccgaggcgaagaaggacgaggctagattattactagtacaatcaagcaacgacaaccaacgtaagtacgtaccggtaggtttcgggacggtacgggaacctaaggccgtacggacccgttccgtaacggtacacggacccgaacggtcctccggtcccccgttcggtaccccg

SEQ ID NO: 156789 - DNA, 669 bp, Homo sapiens
  misc_feature: GYAE6OF01CLF5T.35.15.B04.1.454.CMB.1.raw
  modified_base (221)..(221): a, c, t, g, unknown or other
  misc_feature (221)..(221): n is a, c, g, or t
tcagtacagatcgtcacgaccggtgctcgatttagacagtatatatccgcgggggtgggtccaggaggcagaactctgggtgtctcaccatggcctggatccctctacttcctcccctcctcactctctgcacaggctctgacggcctctatgagctgacacacgcccaccctcggtgtcagtcgtcccaggacagacggccaggatcactgctcgtgganatgctattcgaaccaaagactaattaacttacttagttacggtaaccagacgaagaagtccgaacggcccgaacggtccccttagttaacgtttcgaagttagaagtttagtaaaagtaaaacgtacgtacggttacggaacggtaccggaccccgttaacggacgggtaacccttcccggtagtacgtcggttactttcgttccgtcggtacctaccgacgtacgtacgaacgggaacaacgtcgtacctacggttacgacctagtacgtaggtacggacgtaccgaggacgaacggaacgacggagtacgttagtacgtttactacgtagtaacaacgttacgaagtacaacgtaaccaactaacgtagtacgttcgtaggtacggacgggacgaaccgagtcgtacgaccgtacgtacgacgcgaccgagcctcgtccccgtacg

SEQ ID NO: 156790 - DNA, 671 bp, Homo sapiens
  misc_feature: GYAE6OF01DEEGJ.35.15.B04.1.454.CMB.1.raw
  modified_base (218)..(218): a, c, t, g, unknown or other
  misc_feature (218)..(218): n is a, c, g, or t
tcagtacagatcgtcacgaccggtgctcgatttagacagtatatatccgcgggggtgggtccaggaggcagaactctgggtgtctcaccatggcctggatccctctacttctcccctcctcactctctgcacaggctctgaggcctcctatgagctgacacagcccaccctggtgtcagtcgtcccaggacagacggccaggatcacctgctctgganatgcattcgaccaaagcaatatacttattgtacagacagaagtcaggcacgccctagtattgatgatagtaataaagacacgtgagacgcctacgaggactccgtgagcgtattcgtcgtcggctcgacgtctacggaaacgggaacaaacgtacgtaccgtacggttacgaaccctagtacggtaaggtacggaaccggttaccgaacggaaccggaaaggaaacgggaaccgggtaagggtcgtaacggttaaattaacgtttaacgttacgtactaaacgttcgaacgacgaaacgtaaccaaaccgtaaactaacgttaccggtacccggttggtttacggggacgggaaacggtacccgtaaacggtctaaccgggtacccttaccggttaacggtacccgaaccggacccgtaaaccggcccttacccggtccccccggttacccgg

SEQ ID NO: 156791 - DNA, 912 bp, Homo sapiens
  misc_feature: GYAE6OF01CNR06.35.15.B04.1.454.CMB.1.raw
  modified_base (104)..(104): a, c, t, g, unknown or other
  misc_feature (104)..(104): n is a, c, g, or t
  modified_base (111)..(111): a, c, t, g, unknown or other
  misc_feature (111)..(111): n is a, c, g, or t
  modified_base (236)..(236): a, c, t, g, unknown or other
  misc_feature (236)..(236): n is a, c, g, or t
  modified_base (275)..(275): a, c, t, g, unknown or other
  misc_feature (275)..(275): n is a, c, g, or t
tcagtacagatcgtcacgaccggtgctcgatttagacagtatatatccggcgggggggtccaggaggcagaactctgggtgtctcaccatggcctggatccctntacttcncccctctcactctctgcacaggctctgacgcctcctatgagctgacacagccacccgtcggtgtcaggtcgtccccagggaccaggaccggcccagggtatccgaaccgtggccttccgtggganagttcggacctaatttcggacccaaaaggccaaaagttnttaacccgtttagtttcgggttaacccaggtaccgaaggtaaaacgttcgaacggggtacccgtaacgggccccccgttaggtttaagtttacggaagttaccgggtaactttacgggttaaatttaaaaacgggtaaccaaccgttaggaaacggaccggtacccccgttaacgaacggggtaacttcccccgttaggtaacgaccggtaactttacgttccgtaacgggtcccttcccgtaaggcccgtttacgaacggggtaaccaaaccgtacggttaccgtaacgggtttaccgaaccgacgtttaccgacggttaacggggacgttacccggaagggaccctaaggggaaaacggtaccccggaaggggtaccctttaaggtaaccgttttaacgttaaccgtttacggtaccgtaaaacgtccgtaaacggaccggtaacggtaaacctaaccccggtaaaaccttaaacggttaccggtaccccggttggtttaccggggtaccggtaaaccggggacccgtaaaacgggtcccgttaaccgggacccgtttacccgggtaacggtaccggttaacccggacccgtaaacggtaaccccgtcccggaccccggtttacccggtaccccg

SEQ ID NO: 156792 - DNA, 759 bp, Homo sapiens
  misc_feature: GYAE6OF01DI2DU.35.15.B04.1.454.CMB.1.raw
tcagtacagatcgtcacgaccggtgctcgatttagacagtatatatccgtgtcaggtgcagctggtggagtctgggggaggcttggtcaagcctggagggtccctgagactgtcttgtgcagcctctggattcaccttcagagactatttcatgacctggatccgccagactccgagggaaggactggagtgggtctcacacatcagcagtactggcaactcccatcgtactacgacagtacctctgtaggaacgggccgtattccaaccttagtttttaacgggaaccaaccggtaccgtaacgggttcgtaccgttggttactcgttcgaactaaaatcgaaacgacgccgtagaacggacgtacggaaggaccgaacggtacctaattacttaagttacgtgtacgtacgtaaggtagttcgtaggtaggttggtggtacgtaggtttcggtcggtacgttaacggttacgtaacggtacggttagtacgggtacggtcggtacggggaccgtaaacgggacccgtaacggtccaccgttcctaccgtacgtacgtccttaccccgaaccggtaaccgggtaccctaaccggttcccggtttaccccgttcccccggtcgggtaccccgtccccgtccgtacccgttacccggaacgggtacccgtaccccgtacccggttcccggggtaccgggggaccctaacccggtaccggggtaccccgggttccccgggtccgggtccggttccccgggg

SEQ ID NO: 156793 - DNA, 680 bp, Homo sapiens
  misc_feature: GYAE6OF01CZLPM.35.15.B04.1.454.CMB.1.raw
tcagtacagatcgtcacgaccggtgctcgatttagacagtatatatccgcgggggtgggtccaggaggcagaactctgggtgtctcaccatggcctggatccctctacttcctcccctcctcactctctgcacaggctctgaggcctcctatgagctgacacagcccaccctggtgtcagtcgtccccaggacaggacggccaggatcacctgctctggagatgcattgaccaaagcaatatattattggtaacagcagaagtcaggccaggcccctgtacttgatgtatgtaataaagaacacgtgagacggaccctagacgggactcccgtgacgcgtattccgtcgtggcctccgagctaccgagggtaaccaacgagtacgacggttgaaccctaagtccaaggttacggacgtacccgacggacaaagggaacggaaccggtagggtaccgttagtaattttaactttacgtacgtaccgtaaattcgaacgaccgtaaacggaccaaaccctaaacgaaacgtttaccggttacccggtttaggttttaccgggggaaccgggacgggtaaaccgaaacggtacccggttaaccgaaccccggttaccggttaaccgggttcgaaacccggttaccccgaaagggtcccctcccgggttccccccgttaccggg

SEQ ID NO: 156794 - DNA, 885 bp, Homo sapiens
  misc_feature: GYAE6OF01BI00O.35.15.B04.1.454.CMB.1.raw
tcagtacagatcgtcacgaccggtgctcgatttagacagtatatatccgcggggggggtccaggaggcagaactctgggtgtctcaccatggcctggatccctctacttctcccctcctcactctctgcacaggctctgaggcctcctatgagctgacacagccaccctggtgtcagtcgtccccaggacagacggccaggatcacctgctctggagatgcattcgaccaaagcaattatacttagttggtaccagcagaagtcaggccaggcccctgtattgatgatgtaataaagacactagaggacggccctacgagggtactcccgtggacgcggtaactttcgtcgtcgggtaccttccgacggtccttacggaacgggggtaacctaaacgtacggttaccgtaaccggtttacggaaaccctaacgttaccgtaacgggttcggggaaccggtttaccccggaaggggttacccgaaagggtaaaaacggggtaacccgggtaacgggggtacccgttttaaagggtaaacgtttttttaaaccggtttaaaccccggttaaggttttaacccgtaaaaacggttttacccgaaaccgggtaaccggtaaaacccggtaaaccccggtaaaacccccgtaaaacgttaaaaacccggtttaccgggtttaacccccggggtttacgggtttttaaccgggggaacccggggtaaaccggggtaaaccccgtaaacgggtcccggtttaaccgggtaaccccgggtttaccccggttaaacggggttaacccggaaaccccgggtaacccggtaaacccggggttaccccgttaccccccggggttaacccccccggttccgggggtttaaaccccccc

SEQ ID NO: 156795 - DNA, 741 bp, Homo sapiens
  misc_feature: GYAE6OF01DZEBZ.35.15.B04.1.454.CMB.1.raw
tcagtacagatcgtcacgaccggtgctcgatttagacagtatatatccgtgtcaggtgcagctggtggagtctgggggaggcttggtcaagcctggagggtccctgagactgtcttgtgcagcctctggattcaccttcagagacttatttcatgacctggatccgcagactccgagggaagggactggagtgggtctcgacacatcagcagtactggacaactcccatcgtactacgcagacctcgtagtggaacggccgtattccaaccttagttttaggacaaccgacgtaagggttcgacttagtacttcgtagacaaagtcgaacacgtcctagaagtagtcgaacggacgacggcctaatcgtaattacgtgtacgtacgaaagtacgtcgttagtaggttggtgtacgttaggttggttaggtaccgttaacgggttacgtacggtaacggttagtacgggtcgtacggtacgggacgtaacgggacctaacggtccgtacccgttcgtacctcgacggtccgttaccgaacccggtaaccgggtccccttaaccggttcccggttaccccgttcccccgtcgggtcccccgtaccccgtccggtacccgtacccggtaacggggtacccgtaccccggtaacccgggttcccggggtaaccgggggtaccccgaaaccgggtaccccgggtaccccggggtccccggttacgggggtccccgttaccccgggg

SEQ ID NO: 156796 - DNA, 622 bp, Homo sapiens
  misc_feature: GYAE6OF01DM0TW.35.15.B04.1.454.CMB.1.raw
  modified_base (296)..(296): a, c, t, g, unknown or other
  misc_feature (296)..(296): n is a, c, g, or t
  modified_base (583)..(583): a, c, t, g, unknown or other
  misc_feature (583)..(583): n is a, c, g, or t
tcagtacagatcgtcacgaccggtgctcgatttagacagtatatatccgtgtcaggtgcagctggtggagtctgggggaggcttggtcaagcctggagggtccctgagactgtcttgtgcagcctctggattcaccttcagagactatttcatgacctggatccgcagactcgagggaaggactggagtggtctcacacatcagcagtactggacaactcccatcgtactacgcagactcgtgtaggaacggccgattccaaccttagttttacggacaacgaccgtaagggttcnctgtatcgtgacaaatcgaacagacctgagagtcgaggacacggcctatctattacgtgtacgcaaagtgtcgtagtacggtggtaggctaggttggttcggaccgttaacggtaccgtacggtacgggttagtacgggaccgttcggtacggggacctaaaggggtacccgtaaacggtccgtaacccgtccgtcctacgacgtcccttaccgaacccggacgggtcccacgttcccggttacccttccccgtcggccgtcccctgcccgtacgacggaccgtccnccgtccggtggggacccacgcgccggccgtgggcctcgg

SEQ ID NO: 156797 - DNA, 696 bp, Homo sapiens
  misc_feature: GYAE6OF01BZB8W.35.15.B04.1.454.CMB.1.raw
  modified_base (404)..(404): a, c, t, g, unknown or other
  misc_feature (404)..(404): n is a, c, g, or t
tcagtacagatcgtcacgaccggtgctcgatttagacagtatatatccgcgggggttgggtccaggaggctagaactctgggtgtctcaccatggcctggatccctctacgttctcccctcctcactctcgtgcacaggctctgaggcctcctatgagtctagactacgacgccctacccgttgggtgtcgacggttcgtcccccgaggacacggaccggccgaggactcgacgtgctctagagatgctagttcgaaccaaagtctatatacttagttacggtaccaggcaagtacgtccgaggcccgacgtccctaggtactacgaatacgtattagtaaataacgactaacgtaggaacgtaccggtacccgtaggacgggtactcccgaggacggtacgtnttccgtagtcgtccttacgcggtaccgtacggaacgggaaactacgtacgttacgtaacggttacgaccgtagtacgaggtacgtacgtacgaggaaccgtaaggtaacgacggtacgtcggtagttacttaacgtacttacgtactactcgactacgtacgtaacccaacgtaaccgaacggttccggtacgttacgggttccggaccgggtaccgacgaccgtcggtacccgtaccgtaccgtacggaccctaccggacccggtaacggcctccccggacccgtacccgg

SEQ ID NO: 156798 - DNA, 560 bp, Homo sapiens
  misc_feature: GYAE6OF01BQM36.35.15.B04.1.454.CMB.1.raw
  modified_base (339)..(339): a, c, t, g, unknown or other
  misc_feature (339)..(339): n is a, c, g, or t
  modified_base (530)..(530): a, c, t, g, unknown or other
  misc_feature (530)..(530): n is a, c, g, or t
tcagtacagatcgtcacgaccggtgctcgatttagacagtatatatccgtgtcaggtgcagctggtggagtctgggggaggcttggtcaagcctggagggtccctgagactgtcttgtgcagcctctggattcaccttcagagactatttcatgacctggatccgccagactccagggaaggactggagtgggtctcacacatcagcagtactggacaatcccatgtactacgcagactctgtgaaggccgattcacctatttttaggacaacgccgaaggttcgctgtatctgacaaatgaacagcctgagagtcgagacacggccatctatactgtnacgaagagtcgtgtagtggtgcgtagttgttgtcgtacggtactacgacggtatggacgtcgtgggaccgtaagggaccgtaagtcgaccgtctcctcgagtcctacgaccgacgggccctacgttccggtccttccccgtcggccgtccctcgccgtaccgacggtacgccgaccgtcggtcggggaccncggacgccggtcccggtcgggtctcccggg

SEQ ID NO: 156799 - DNA, 635 bp, Homo sapiens
  misc_feature: GYAE6OF01AU7JV.35.15.B04.1.454.CMB.1.raw
tcagtacagatcgtcacgaccggtgctcgatttagacagtatatatccgcgggggtgggtccaggaggcagaactctgggtgtctcaccatggcctggatccctctacttctcccctcctcactctctgcacaggctctgaggcctcctatgagctgacacagcccaccctcggtgtcagtcgtccccaggaccagacggccaggactcacctgctcgtggagatgcattgaccaaagcaatatacttattaggtaccagcagagtcagccagccctgtatgatgatagtaataagacactagagacgccctcgaggacttcccgtgacgtcgtattccgtcgtacggcctaccgacgtccgttacgaacgggaaccaaacgtcgttaccgtacgtttacgaaccctagtaccgaaggtcggaacgtaccgaagggacaaaggtaacggacggagtccgtagtaactttacgttacgtacgtacctaagttcgaacgcgtaacgaacctaaccaaactaaacgttaccggtcccggtttaggttacgggaccgggtaaacgggtaccgaacgtcgtacggtacccgtacgtacggtaccgaccgtacccgaagcccgtacccgtccccgtaccgg

SEQ ID NO: 156800 - DNA, 560 bp, Homo sapiens
  misc_feature: GYAE6OF01AOH4A.35.15.B04.1.454.CMB.1.raw
  modified_base (347)..(347): a, c, t, g, unknown or other
  misc_feature (347)..(347): n is a, c, g, or t
tcagtacagatcgtcacgaccggtgctcgatttagacagtatatatccgtgtcaggtgcagctggtggagtctgggggaggcttggtcaagcctggagggtccctgagactgtcttgtgcagcctctggattcaccttcagagactatttcatgacctggatccgccagactccagggaagggactggagtgggtctcacacatcagcagtactggcaatcccatgtactacgcagactctgtgaaggccgattcacctatttttagggacaacgccaagggttcgctgtatctgacaaatgaacagcctgagagtcgaggacacggccatctattactgtgcaagngtctgtagtggtggctagttgttgtctacggtactacggtacggtatggtacgtcgtggggaccgaagggaccaaggtcaccgtctcctcacgtcttacccgaccgacgggccccagtccgttcctcccccgtggcccgcccctcgcctcccgacggacgccgtacccgtccggtcggggccacggacgcccgggccccgtggggcctccggg

SEQ ID NO: 156801 - DNA, 573 bp, Homo sapiens
  misc_feature: GYAE6OF01BUJT8.35.15.B04.1.454.CMB.1.raw
tcagtacagatcgtcacgaccggtgctcgatttagacagtatatatccgcgggggggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattgaccaaagcaatatacttattggtacagcagaagtcaggccacggcccctgtattgatgatgtataaagacactgagacggccctacgagggactcccgtgacgcgtattctcgtggcctcagctcgacggacaacgagtacacgttacgacctagtcagtggacgtccgaggcaagaagacgaggtctagatttatactgtacagtacagacagaccaaccaaactaacttacggttcccgttaggtttcggaccgggtacggaaccgaacggtccgtacggtaccgtccgtaagggtcccacggtaccccgaacgggtcccgtcccggtcccccgtcggtaacccg

SEQ ID NO: 156802 - DNA, 748 bp, Homo sapiens
  misc_feature: GYAE6OF01EG5KO.35.15.B04.1.454.CMB.1.raw
tcagtacagatcgtcacgaccggtgctcgatttagacagtatatatccgcgggggtgggtccaggaggcagaactctgggtgtctcaccatggcctggatccctctacttctccccctcctcactctctgcacaggctctgaggcctcctatgagctgacacagccaccctcggtgtcagtcgtcccaggacagacggccaggatcacctgctctggagatgcattgaccaaagcaatatacttattggtaccagcagaagtcaggccaggcccctgtattgatgatgtaataaagacatgagacggccctacgagggactcccgtaggagcgtattctcgtcggctccgaagtcctacgaaggggaacaaacgagttaccgtaaccggtttacgaaccctaattaccgagggttcgggtaacggttaccccgagggacaagggaaaaggaccggaagggtacgttaggtaacttttaacgtttaaccgttaggttaccaaacgttccgaacggtaccaaggtaaaccctaaaccctaaaacgtaacgtttaaccggttaccccgggtttagggttttaaccgggggaccggggtaaaaccggggtaaccccgtaaacgggtacccggttaccggggtaaaacccccggttcccggttaaaccggggttaccccgtaaaaccgggtaccccccgggtaaaacgggttcccccgtaaccccgggtcccccccccggtttaaccccgggg

SEQ ID NO: 156803 - DNA, 584 bp, Homo sapiens
  misc_feature: GYAE6OF01ESXOK.35.15.B04.1.454.CMB.1.raw
  modified_base (543)..(543): a, c, t, g, unknown or other
  misc_feature (543)..(543): n is a, c, g, or t
tcagtacagatcgtcacgaccggtgctcgatttagacagtatatatccgtgtcaggtgcagctggtggagtctgggggaggcttggtcaagcctggagggtccctgagactgtcttgtgcagcctctggattcacctttcagagactatttcatgacctggatccgccagactccagggaagggactggagtgggtctcacacatcagcagtactggcaatcccatgtactacgcagactctgtgaagggccgattcacctatttttaggacaacgccgaagggttcgctgtatctgacaatgaacagcctgagagtcgaggacgacggccatctattactgtgacaagtagtcgtgtagtggtggcgtagtttgttggcgttacggtacgtacggtacgggttagtagggacgttcgtacggggaccgaacgggaccgtaaggtccaccgttctcctcgagtccttaccgaaccgaacgggtcccctagttcccggtccgttcccccgtcggcccgtcccgtcgccgtccgacggtacgccnccgtccggtcggggccacgcggccggcccgtgggcgtccgg

SEQ ID NO: 156804 - DNA, 214 bp, Homo sapiens
  misc_feature: GYAE6OF01CIM5M.35.15.B04.1.454.CMB.1.raw
  modified_base (209)..(214): a, c, t, g, unknown or other
  misc_feature (209)..(214): n is a, c, g, or t
tcagtacagatcgtcacgaccggtgctcgatttagacagtatatatccgcggggaccaaggtcaccgtctcctcagcttccaccaaggcccatcggtcttcccctggcgccctgctccaggagcacctctgggggcacagcggccctgggctgcctggtcaaggactacttccacgatctgtactgagcgggctggcaaggcgcatagnnnnnn

SEQ ID NO: 156805 - DNA, 745 bp, Homo sapiens
  misc_feature: GYAE6OF01B76CP.35.15.B04.1.454.CMB.1.raw
  modified_base (429)..(429): a, c, t, g, unknown or other
  misc_feature (429)..(429): n is a, c, g, or t
  modified_base (479)..(479): a, c, t, g, unknown or other
  misc_feature (479)..(479): n is a, c, g, or t
tcagtacagatcgtcacgaccggtgctcgatttagacagtatatatccgcgggggtgggtccaggaggcagaactctgggtgtctcaccatggcctggatccctctacttcctcccctcctcactctctgcacaggctctgacggcctcctatgagctgaccacacgcccacccgtcggtgtcagtccgtccccaggacacggaccggccgaggactccacctgcctcgtagggagtagtcgactagttacgaccaaaagacctaaattaacttaaccgtttagtttacggaaccgagaccgaaaggtaacgtaccgaacggcccggaacgggtcccccgttaagttgttaggaagttcgaagttagtaaactaaaacgtactacgtaggacggacggccctacgacggtactcccgtagacgtacgtnttccgtgtaccggcctaccgactaccgtacggaacggaacctaaccggtntaccggtaacgtacgtacctagtacgtcgggtacggacgtccggaacggacgaaagacgggacgtaggtacgtaacgttacgttaatttacgagttaccgaattacggaactacgaactacccaaacgtaacttaccgtacgttccggttgggtaccgggacgggtaaccggtacgaacggttccggtaacccggtccggtacccgttgggaacccgtaccgggtaaccctaccgggcccgttccccgggcccccgtttacccggg

SEQ ID NO: 156806 - DNA, 648 bp, Homo sapiens
  misc_feature: GYAE6OF01BC2LS.35.15.B04.1.454.CMB.1.raw
tcagtacagatcgtcacgaccggtgctcgatttagacagtatatatccgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattcgaccaaagcaatatacttattggtaccagcagaagtcagccaggcccctgtatgatgatagtataaagacacgtgagacggccctcgagggactcccgtgacgcgtattcgtacgtcggcctcccgagccgttacgaacgggaaccaaacgtacggtaccgtaacgtttacgaacctacgttaccgaagggttcgggaacggttacccgaacgggtaccgaaaggaacggaacggacgggtctaggtaatttacgttactagtactaatcgaagtacaagaccaaccaaactaacgttacggttacccgttggtttaccggggacgggtaacgggacccgaaacggtccgtacgggtaccccgttaccgtacggtacccgaccggaccccgaacggtcccgtcccgcccccggttacccgg

SEQ ID NO: 156807 - DNA, 593 bp, Homo sapiens
  misc_feature: GYAE6OF01EHVWC.35.15.B04.1.454.CMB.1.raw
  modified_base (541)..(541): a, c, t, g, unknown or other
  misc_feature (541)..(541): n is a, c, g, or t
  modified_base (544)..(544): a, c, t, g, unknown or other
  misc_feature (544)..(544): n is a, c, g, or t
  modified_base (554)..(554): a, c, t, g, unknown or other
  misc_feature (554)..(554): n is a, c, g, or t
tcagtacagatcgtcacgaccggtgctcgatttagacagtatatatccgtgtcaggtgcagctggtggagtctgggggaggcttggtcaagcctggagggtccctgagactgtcttgtgcagcctctggattcaccttcagagacttatttcatgacctggatccgccagactccagggaagggctggagtgggtctcacacatcagcagtactggcaatcccatgtactacgcagactctgtgaagggccgattcacctagtttttaggacaacgcgaaggttccgtctgtatctgacaaatgaacagcctgagagtacgaggacacggccatctattacgtgtgacaagtagtctggtagtggtagcgtaggtttgttggacgtacggtacgtacggtaggtagtggacgtcgcggggtaccgaagggaccgaggtcctaccgtctacccgtcacgtccttacccgaaccgtaaccgggccctaacgttcccggttacccttccccccgtggcccgtccctcgccgtcccgacgggtcnccnccggtccggngggggaccaccgaacgggccggcccggtgggccgtccgg

SEQ ID NO: 156808 - DNA, 630 bp, Homo sapiens
  misc_feature: GYAE6OF01DLPOK.35.15.B04.1.454.CMB.1.raw
  modified_base (333)..(333): a, c, t, g, unknown or other
  misc_feature (333)..(333): n is a, c, g, or t
tcagtacagatcgtcacgaccggtgctcgatttagacagtatatatccgtgtcaggtgcagctggtggagtctgggggaggcttggtcaagcctggagggtccctgagactgtcttgtgcagcctctggattcaccttcagagactatttcatgacctggatccgcagactccgagggaaggactggagtgggtctcacacatcagcagtactggacaatcccatcgtactacgcagactctgtgaaggccgattcactatttttaggacaacgcctaaggtcgctgtatctgacaaatgaacagctgagagtcgagacacgcatctattacngtgacagagtcgtgtagtggtggctaggttgtggtctacggtactacggtacggttagtaggtacggtcgtacggggtaccgaaaggggtacccaaaggtcccgaaccgttccgtacctaccacgtccttacccgacccgaaccggggtcccctaacgttcccggttaccctttccccccgaccggtcccgtccccgtcggtaccctccggaaacgggtccgtacctcccggttaccggtcgggggtaccccaacggtaccgggccccggtaccccgggtgggtcccgttacccggg

SEQ ID NO: 156809 - DNA, 750 bp, Homo sapiens
  misc_feature: GYAE6OF01EZZY6.35.15.B04.1.454.CMB.1.raw
tcagtacagatcgtcacgaccggtgctcgatttagacagtatatatccgcgggggtgggtccaggaggcagaactctgggtgtctcaccatggcctggatccctctacttctcccctcctcactctctgcacaggctctgaggcctcctatgagctgacacacgcccaccctcggtgtcagtcgtccccaggacagacggccaggactccacctgctcgtggagatgcattcgaccaaagcaatatacttattgtacagcaagagtgacggccacggcccctgtattgatgatagtaataaagacactaggaacgacgtacccgtacgacggtactccgtagagtaccgtagtttctacgttcgccttaccgacgtccgttacgaaacgggtaacctaaacggtacgttaccgtaccggtttacgaaccctaacgtacgtaacggttacggggaccggttaacccgagggtaaccgaagggaaaccggaaccgggtaacggtacgtacgttaatttaacgtttacggttacgtacctaacaccggtaacgaccgtaaactaaccgaaacccttaaacgtaaccgttaaccggttacccgggtttaggtttaccggggtaaccgggtaaaccggtaaacccggtacggttacccggtaaccggttaccccggttaacccggtaacggtaccccgtaaaccgggaccccggttaacggtcccccggttccccgtccccccgggtttacccgg

SEQ ID NO: 156810 - DNA, 602 bp, Homo sapiens
  misc_feature: GYAE6OF01CZMTJ.35.15.B04.1.454.CMB.1.raw
tcagtacagatcgtcacgaccggtgctcgatttagacagtatatatccgcgggggggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattgaccaaagcaatatacttattggtaccagcagaagtcaggccaggcccctgtacttgatgatagtataaagacactgagacgcctacgagggactcccgtgagcgtattctcgtggctccagctacgaggacaacagtacacgttgaccatcgagtggagtccgaggcaagaaacggacgaggtactaggtaattacttaacgtgtacaaattcgaagtacaagaacctaaccaaacgtaacgttaacggttccgttaggtttacgggacgggtaacgggaaccgtaaacggtccgtacggtaacccgttccggtacggttacccgaacggtaccccgtaaacggtcccgtacccggtcccccgttacggtaccccg

SEQ ID NO: 156811 - DNA, 575 bp, Homo sapiens
  misc_feature: GYAE6OF01CFUS2.35.15.B04.1.454.CMB.1.raw
  modified_base (339)..(339): a, c, t, g, unknown or other
  misc_feature (339)..(339): n is a, c, g, or t
  modified_base (456)..(456): a, c, t, g, unknown or other
  misc_feature (456)..(456): n is a, c, g, or t
tcagtacagatcgtcacgaccggtgctcgatttagacagtatatatccgcgggggggtccaggaggcagaactctgggtgtctcaccatggcctggatccctctacttctcccctcctcactctctgcacaggctctgaggcctcctatgagctgacacagccaccctggtgtcagtcgtccccaggacagacggccaggatcacctgctcgtggagatgctattgaccaaaagcaaatatacttattggtaccagcagaagtcaggccaggcccctgtattgatgatagtataaagacactgagacggccctgagggactcccgtgagcgtattctcnggctccagcctacgaagggacaacgagtcgacgttcgaccatcgagttggacgtcgaagcaagaagccggaggcttagactttagttactgtacaatcagactagaaccacctaaanaacgttacgtcccgttagggttacggacgggtaacgggaacctaacggccgtacgacccggttccgttaaacgggtcccaacgtaccccgaaggtccctccggtcccccgtcggtaccc

SEQ ID NO: 156812 - DNA, 528 bp, Homo sapiens
  misc_feature: GYAE6OF01BSVRX.35.15.B04.1.454.CMB.1.raw
  modified_base (490)..(490): a, c, t, g, unknown or other
  misc_feature (490)..(490): n is a, c, g, or t
tcagtacagatcgtcacgaccggtgctcgatttagacagtatatatccgtgtcaggtgcagctggtggagtctgggggaggcttggtcaagcctggagggtccctgagactgtcttgtgcagcctctggattcaccttcagagactatttcatgacctggatccgccagactccagggaagggactggagtgggtctcacacatcagcagtactggcaatccccatgtactacgcagactctgtgaagggccgattcaccatttttagggactaacgccaagggttcgctgtatctgcaaatgaacagcctgagagtcgaggacacggccaatctattactgtgcaagagtctgtagtggtgcagttgttgctacggtactacgacgggtatgggacgtcgtggggaccaagggaccaaggtcaccgtctcctcagcttccaccgagggcccagtccgtcctcccctggcctccctgcctccgaggcgcnccgtcgtggggccacgagccggcccctgggcctccggg

SEQ ID NO: 156813 - DNA, 654 bp, Homo sapiens
  misc_feature: GYAE6OF01D5CJ4.35.15.B04.1.454.CMB.1.raw
  modified_base (235)..(235): a, c, t, g, unknown or other
  misc_feature (235)..(235): n is a, c, g, or t
  modified_base (350)..(350): a, c, t, g, unknown or other
  misc_feature (350)..(350): n is a, c, g, or t
tcagtacagatcgtcacgaccggtgctcgatttagacagtatatatccgtgtcaggtgcagctggtggagtctgggggaggcttggtcaagcctggagggtccctgagactgtcttgtgcagcctctggattcaccttcagagactatttcatgacctggatccgccagactccagggaaggactggagtgggtctcaacacatcagcagtactcggcaatcccatgtactacgnagactctgtgaaggccgattcacctattttacgggacaacgccaagggttcgtctgtatctgacaaatcgaacacgctgagagtcgaggacacggccatctatactgtgacaagngtactggtacgtggaggtcgtagttgtcgtacgtacgtacgtacggtacggtacggtacggtacggtacggtacgggtaccggtaacggtaaccggtaaccggtaccgtacccgtaccgttaccgtaccgtaccgttaccgtacccgtaacccggtaacccggtacccgtaccgttacccgttaccccgttcccggttcccggtcccgtcccgtccggtaccgtaccgtacggaccggtacccgtacccggtaccgggtaccgggtaccggaccggaccggcccgggtcccgggtccggtccgg

SEQ ID NO: 156814 - DNA, 160 bp, Homo sapiens
  misc_feature: GYAE6OF01BV5IN.35.15.B04.1.454.CMB.1.raw
  modified_base (156)..(160): a, c, t, g, unknown or other
  misc_feature (156)..(160): n is a, c, g, or t
tcagtacagatcgtcacgaccggtgctcgatttagacagtatatatccgcggggaggtgtgtcacaagatttgggctctgggcacagcggccctgggctgcctggtcaaggactacttccacgatctgtactgagcgggctggcaaggcgcatagnnnnn

SEQ ID NO: 156815 - DNA, 757 bp, Homo sapiens
  misc_feature: GYAE6OF01D7FY6.35.15.B04.1.454.CMB.1.raw
  modified_base (137)..(137): a, c, t, g, unknown or other
  misc_feature (137)..(137): n is a, c, g, or t
tcagtacagatcgtcacgaccggtgctcgatttagacagtatatatccgcgggggggtccaggaggcagaactctgggtgtctcaccatggcctggatccctctacttctccccctcctcatccccccccccccctntgcacaggctctgacggcctcctatgagctgacacacgcccacccgttcggtgtcagtcgtaccccgaggacaggaccggaccaaggactccaccgtgcttcgtaggaagtatgctagttacgaaccgaaaagactaaattaacgttaactttaagtttacggtaaccaagacgaaggaacgtacgaacggaccgaccggtaccccttagttattagtatagtaagttagttaaagtaaagactaacgtaggaacggacggtacccgtacgacggtacgtaccgtagacgacgtactttctcgtcggtcctaccgacgtacgtacgaacggaacaaacgtacgtaccgtaccgttacgacctagtacgtacggtaggtacgtacgaggacgaaggaacggacgacggtacgttagttaatttaacgttacgtacgtaactaacgtacgaacgacgaacgaaccctaaaccgtaaacgtaaacgttaccggttaccggtttacgggttacgggaccgggtaacggaaccgtaacggtaccgttacgtaacccggttaccgttaacggtaccgaacccgtacccgaaccggtacccgtaccccggtcccccgtcggtacccg

SEQ ID NO: 156816 - DNA, 955 bp, Homo sapiens
  misc_feature: GYAE6OF01DSC2Q.35.15.B04.1.454.CMB.1.raw
tcagtacagatcgtcacgaccggtgctcgatttagacagtatatatccgtgtcaggtgcagctggtggagtcgtgggggaggcttggtcaagccgtggagggtccctgagactgtcttgtgcagcctctggattcaccttcagagacttattcatcgacctggactccgcagactccgagggaaggactggaggtggtctcacacatcagcagtactggacaacgtccagtcgtacctacgacagtacctcgtggtacggaacgggcctaattccaaccgtttagttttaacgggaaccaaccggtccgtaaaggggttctacgttagttaacttcgtacgactaaacgtacgtaaacgacgtaccgtaggaacggtaccggtaccgggaacggaacccgaaccgggtacctaacgttaccgttaaacttaccggtaaggtacggtaaccaaagggttacgttaccgttaggggtttaacggtggggtcggttacggttagggtttacgggttaccgggtaaccgtttaaccgggtaaccgtttaacggggttaaccggggttaagggtttcccggggtaacgggtttcccgggtaaaccggggggaacccgggtaaaacccggggtaacccggttaaacccggggttcccttaaccccgggtttcccccgttaacccggttacccgtaaccggtcccccgtttaaaccccgggaaccccgggttaaacccggggtaccccctttaaccggggttcccccggttttccccccggttacccccggttacccgggcccccggttaccccgggtcccgtaacccccgggttaccggtaaacccggggacccgttaccccggtaacccccgggttcgggggttaacccggggccccgttaaaccccggggccggtaccccggggggttccccgttacccgggggccgtttaccccgggg

SEQ ID NO: 156817 - DNA, 542 bp, Homo sapiens
  misc_feature: GYAE6OF01D6DIR.35.15.B04.1.454.CMB.1.raw
  modified_base (457)..(457): a, c, t, g, unknown or other
  misc_feature (457)..(457): n is a, c, g, or t
  modified_base (465)..(465): a, c, t, g, unknown or other
  misc_feature (465)..(465): n is a, c, g, or t
  modified_base (499)..(499): a, c, t, g, unknown or other
  misc_feature (499)..(499): n is a, c, g, or t
  modified_base (503)..(503): a, c, t, g, unknown or other
  misc_feature (503)..(503): n is a, c, g, or t
  modified_base (506)..(507): a, c, t, g, unknown or other
  misc_feature (506)..(507): n is a, c, g, or t
  modified_base (512)..(512): a, c, t, g, unknown or other
  misc_feature (512)..(512): n is a, c, g, or t
  modified_base (514)..(514): a, c, t, g, unknown or other
  misc_feature (514)..(514): n is a, c, g, or t
  modified_base (516)..(516): a, c, t, g, unknown or other
  misc_feature (516)..(516): n is a, c, g, or t
  modified_base (519)..(519): a, c, t, g, unknown or other
  misc_feature (519)..(519): n is a, c, g, or t
  modified_base (535)..(535): a, c, t, g, unknown or other
  misc_feature (535)..(535): n is a, c, g, or t
tcagtacagatcgtcacgaccggtgctcgatttagacagtatatatccgtgtcaggtgcagctggtggagtctgggggaggcttggtcaagcctggagggtccctgagactgtcttgtgcagcctctggattcaccttcagagactatttcatgacctggatccgccagactccgagggaagggctggagtgggtctcacacatcagcagtactggcaactccatcgtactacgcagactctgtgaaggccgattcacctagtttttacgggacaacgaccgaagggttcgctgtactctagcaaatgtaacagcctagagtaggtcggaaggacacggctactctacttactgtcgacaagtcgtcgtcgtagtcggtggcgtagtttggttcggtacgtacggtacgtacggtacggttagtggtacgtcggtcgggacgaagggaccaaggtcnccgtctcncagtctaccgacgacggccacgtcgtcctcccgngccnccnnctcgngncncgngtggctacgcgacgcnggctcgg

SEQ ID NO: 156818 - DNA, 691 bp, Homo sapiens
  misc_feature: GYAE6OF01AGLC4.35.15.B04.1.454.CMB.1.raw
tcagtacagatcgtcacgaccggtgctcgatttagacagtatatatccgcgggggtgggtccaggaggcagaactctgggtgtctcaccatggcctggatccctctacttctcccctcctcactctctgcacaggctctgaggcctcctatgagctgacacagccaccctcggtgtcagtcgtccccaggacagacggccaggatcacctgctctggagatgcattgaccaaagcaatatacttattaggtacagcaagaagtcacgccaggcccctgtattgatgatagtaataaagacactagacgacggccctagacggtactccgagacgcgtattccgtacgtcggtctaccgagtcgtacgacgggaaccaaacgtacgtaccgtacgttacgaccgtaataccgagggtacggtacggtaccgaagggacgaaaggaaacggaacggacggtcgtaaggttaactttaacgttacgttacgtaaccgtaacgttacgaacgactaaaccggaaaccctaaaccgaaacgttaaaccgttacccgggttacccggtttagggttaccggggaaccggggtaaccggaaccgtaaccggtacccgttacccggtacccggtacccggttaacggacccgtaaccggtacccgaaccggtcccgttacccgcccccggttaacccgg

SEQ ID NO: 156819 - DNA, 664 bp, Homo sapiens
  misc_feature: GYAE6OF01AKO2V.35.15.B04.1.454.CMB.1.raw
tcagtacagatcgtcacgaccggtgctcgatttagacagtatatatccgcgggggggtccaggaggcagaactctgggtgtctcaccatggcctggatccctctacttctccccctcctcactctctgcacaggctctgaggcctcctatgagctgacacagccaccctcggtgtcagtcgtccccaggacaggaccggccaggactcacctgctctggagatgcatcgaccaaagcaaatatacttattcggtaccagcgaagaagtcaggccgacgcccctgtacttgatgatgtaataaagacactagacggacggcccgtgacgggactccgagacgcgtacttcgtcgtcggccttaccgacgtcgtacgacggggaaccaaacgacggtaccgtacgttacgaaccgtacgtaccggtaggtacgggtacgtacccggagggacgaacggaaacggacgggtaaccgtcgttaacggtactttaagttaccgtagttaacgtaacctacgaacgtacgaaaccgtaaccgaacctaaacgtaccgttacgttcccggttaggttcgggacggtacgggaccgacggtcgtaccggacccggttccgtacggtaccacggtaccccgtaacggtccctcccggtccccgtcggttaccc

SEQ ID NO: 156820 - DNA, 160 bp, Homo sapiens
  misc_feature: GYAE6OF01BA7MJ.35.15.B04.1.454.CMB.1.raw
  modified_base (157)..(160): a, c, t, g, unknown or other
  misc_feature (157)..(160): n is a, c, g, or t
tcagtacagatcgtcacgaccggtgctcgatttagacagtatatatccgcgggggaggtgtgtcacaagatttgggctctgggcacagcggccctgggctgcctggtcaaggactacttccacgatctgtactgagcgggctggcaaggcgcatagnnnn

SEQ ID NO: 156821 - DNA, 726 bp, Homo sapiens
  misc_feature: GYAE6OF01DL860.35.15.B04.1.454.CMB.1.raw
tcagtacagatcgtcacgaccggtgctcgatttagacagtatatatccgcgggggggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaagcaatatacttattggtaccagcagaagtcaggccaggcccctgtattgatgatgtaataaagacactgacgaggccctcgagggatcccgtgaacgtcgtaacttcgtctacgggctccgaacgtctaccgaggggaacctaaaccgaggtacccgtacgtttcgaaccctaataccgaggttcgggtaacggttaccaacgggtacaacgggtaaaggtaccggacgggtccgttagtaacgtttaacgtttaaccgtaggttacctaaacgttcgaaacgtccgtaaacgaacccgtaaacccgtaaaccgttaaagttaaccggtttaccccggttaggggttttaccgggaccggggtaaaggggtaaccccggtaaacgtaccggttaccggtacccgggttaacccggtaacggggttacccgaaaccgggtaccccgtaaaacggggtccccttaacccgggtccccccccgttcgggttaacccccg

SEQ ID NO: 156822 - DNA, 762 bp, Homo sapiens
  misc_feature: GYAE6OF01CJLH4.35.15.B04.1.454.CMB.1.raw
  modified_base (103)..(103): a, c, t, g, unknown or other
  misc_feature (103)..(103): n is a, c, g, or t
  modified_base (237)..(237): a, c, t, g, unknown or other
  misc_feature (237)..(237): n is a, c, g, or t
tcagtacagatcgtcacgaccggtgctcgatttagacagtatatatccgcgggggggtccaggaggcagaactctgggtgtctcaccatggcctggatccctntacttcctccccctctcactctctgcacaggctctgagcctcctatgagctgaacacagcccacccgttcggtgtccaaggttccgtacccccgaaggaccaggaccggccaaggactcacctgcctgtggganatcgctaagttcgaaccaaagtcaaattacttacgttagttcggtaccagacaagtaagtcgacggccacggtccctagtatgtatgtaattagtaataaacgacgtacgtaggaacgacggtaccccgtgaacgggtacctcccgtagacgtcgttattccgtcgtcgtcctcgacgtccgtacgaacgggacaacgtacgtactacgttaccggacctaacgtccgtaagggtacggtaccgtaccgaggaactaagggaaacgggtacggtaacggtacttaaggttaactttaaccgttacgtacgtaattaacgtacaacgaccgtaacgaaacctaaacccgtaaagttaaccgtttaccgggtacccggtttaacgggttacggggaaacccgggtacgggtaaacccgaacggtacccggttaaccggtaacccggttacccgttaacgggacccgtaacggaacccccggtacgggtaaccccctcccccggtcccccggtaaccgttacccccgg

SEQ ID NO: 156823 - DNA, 726 bp, Homo sapiens
  misc_feature: GYAE6OF01BWN9T.35.15.B04.1.454.CMB.1.raw
  modified_base (219)..(219): a, c, t, g, unknown or other
  misc_feature (219)..(219): n is a, c, g, or t
tcagtacagatcgtcacgaccggtgctcgatttagacagtatatatccgcgggggtgggtccaggaggcagaactctgggtgtctcaccatggcctggatccctctacttcctcccctcctcactctctgcacaggctctgaggcctcctatgagctgacacagccacactcggtgtcagtcgtcccaggacagacggccaggatcactgctcgtgganatgctattcgacaaagacaatatactttagtacggtaccagacaagtacgtacgacggaccgtacggaccccgttagttagttaggtagttagtaagttaagtaaacgttaaacgaccgtacgtaggaacggtaccggtaccccgttaggaacgggtacctacccgtaggacgtacgtacttcgtcgtacggacctaccagtaccgtacgaacggaacaacgacgtacgtaacgttcgaacctagtacgacggtacggactacggaaggacgaaggaagggaccggaggtaccgtaagtaagtttaacgttaacgtcgttaacgaacgttaacgaacggaacgaaaccgtaaacccaaccgtaaaagttaaccggttaccggttacccgggtttaagggttacccggggaaagggaacccggggtaactaaccgggtaccgtaccgggtaaccccgtacgtacggtaccgaccggtaccggaccggtcccgtccccgtacccccggg

SEQ ID NO: 156824 - DNA, 687 bp, Homo sapiens
  misc_feature: GYAE6OF01BHDEM.35.15.B04.1.454.CMB.1.raw
tcagtacagatcgtcacgaccggtgctcgatttagacagtatatatccgtgtcaggtgcagctggtggagtctgggggaggcttggtcaagcctggagggtccctgagactgtcttgtgcagcctctggattcaccttcagagactatttcatgacctggatccgccagactccagggaaggactggagtgggtctcacacatcagcagtactggcaatcccatgtactacgcagactctgtgaagggccgattcacctatttttaggactaacgccaagggttcgctgtatctgacaaagtgaacagcctgaggagtcgaggacaccggcagtctaattactgtacgcgaagtagtcgtaggtaggttgggtggcgtaggtttgggttcggtacgttaaccgggttacgtaacggtacgggttagtcgggtacggttcggtcgggggacccgaaggggaaccgtaacgggtaccgaccggttaccgtcccgtacgacggtcccgtttaacccgaaccggtaaccggggtacccctagttccccgggttaccccgttccccccgtcgggtacccgtccccgtcggtcccgttacccggaacgggaccgcccgtaacccggttccgggtacgggggcccctaacggaccgggtaccccgggtccccggttggggcccgttacccgggg

SEQ ID NO: 156825 - DNA, 770 bp, Homo sapiens
  misc_feature: GYAE6OF01AUOS2.35.15.B04.1.454.CMB.1.raw
  modified_base (325)..(325): a, c, t, g, unknown or other
  misc_feature (325)..(325): n is a, c, g, or t
tcagtacagatcgtcacgaccggtgctcgatttagacagtatatatccgcgggggtgggtccaggaggcagaactctgggtgtctcaccatggcctggatccctctacttctccccctcctcactctctgcacaggctctgaggcctcctatgagctgacacagccacccgtcggtgtcagtcgtccccaggacagaccggccaggatcacctgctcgtggagatgcattcgaccaaagcaatatacttattaggtaccagcagaagtcaggccaggacctgtatgatgatagtaataaagcatgagacgcctagaggactccgngacgacgtattctcgtcggcctccgacgtcctacggaacgggaacctaaacgtacgttaccgtaaccggtttacgaaccctaacgtacgaacgggttacgggtaaccggttacccggaaacgggtaccggtaaacgggaaacgggaaccgggtaacgggttccgttaaacggttaacgttttaacgtttaaccggttacgtaaacccgtaacgttaccgaacgtaacccgtaaacgtaaaccccaaaacccgttaaaaccgttaaccggtttacccggttacccggtttaacgggtttaccggggaaaccgggggtaaaccggtaaaccggtaaccgggttacccggttaacccggtaaccccgggttaacccggttacgggtacccgaaccggtaccccggtaaacgggtcccgttacccccgggtccccccggttaacccggg

SEQ ID NO: 156826 - DNA, 714 bp, Homo sapiens
  misc_feature: GYAE6OF01ECNKC.35.15.B04.1.454.CMB.1.raw
  modified_base (556)..(556): a, c, t, g, unknown or other
  misc_feature (556)..(556): n is a, c, g, or t
tcagtacagatcgtcacgaccggtgctcgatttagacagtatatatccgcggggggggtccaggaggcagaactctgggtgtctcaccatggcctggatccctctacttctccccctctcactctctgcacaggctctgaggcctcctatgagctgacacacgcccacccgtcggtgtcaggtccgtacccccgagggaccacggaccggccgaaggactccaccgtgccttcgtgggacgatgactattcgaccaaagctaaattactacttattcggtaccagtacagaagtcgacggccacggtcccctagttacgtgatgatagtaataaacgactacgtaggacgacggtcccgtagacgggactccgtaggacgacgtacgttccgtacgtcgtactccgacgaccgtacggaacggaactaacgtacggtacgtacggttacgaccgtagtacgtagggtacggtacgtaccggaaggaccaagggtaaacggacggtacggtacttaggttaacttttacgtacgtagtacctaagtacgaacgtaanaccgaaccctaaaccgtaaacgtaacgttaccgttacccgggtttacggttacggggacggtaaccggtaaccgtaacggtccgttaacggacccggttcccggtacggaccgaccggtaccgtacgacccgtcccggtacccccgtggttaaccccg

SEQ ID NO: 156827 - DNA, 628 bp, Homo sapiens
  misc_feature: GYAE6OF01DRC93.35.15.B04.1.454.CMB.1.raw
  modified_base (293)..(293): a, c, t, g, unknown or other
  misc_feature (293)..(293): n is a, c, g, or t
  modified_base (311)..(311): a, c, t, g, unknown or other
  misc_feature (311)..(311): n is a, c, g, or t
  modified_base (343)..(343): a, c, t, g, unknown or other
  misc_feature (343)..(343): n is a, c, g, or t
  modified_base (346)..(346): a, c, t, g, unknown or other
  misc_feature (346)..(346): n is a, c, g, or t
  modified_base (352)..(352): a, c, t, g, unknown or other
  misc_feature (352)..(352): n is a, c, g, or t
  modified_base (527)..(527): a, c, t, g, unknown or other
  misc_feature (527)..(527): n is a, c, g, or t
  modified_base (557)..(557): a, c, t, g, unknown or other
  misc_feature (557)..(557): n is a, c, g, or t
tcagtacagatcgtcacgaccggtgctcgatttagacagtatatatccgtgtcaggtgcagctggtggagtctgggggaggcttggtcaagcctggagggtccctgagactgtcttgtgcagcctctggattccaccttcagagacttatttcatgacctggatccgccagactccgagggaagggactggagtgggtctcacacatcagcagtacgtggacaactcccatcgtactacgcagactcgtgtggaagggccgattcacctattttaggacaacgcgaagggtcntgtatctgacaatgaacngctgagagtcgaaggacgacggcatctattcngtnacaagntctggttagtggtagcgtaggttgttggtacttacggtacgtacggtaggtagtcggacggtcggtacggggaccgaacgggaaccgacggtaccgacccgttcctcctacgacgtcccttacccgaaccgtaccgggccctacgttcccggttcccttcccccgcgggtccccncccgtcgtacccgtccggtaacgggtaccncccgttaacccgtccgggtcggggacccgtaccgaccgggtacccgggtcccggtccgggtcgtcccgggg

SEQ ID NO: 156828 - DNA, 570 bp, Homo sapiens
  misc_feature: GYAE6OF01A2IP3.35.15.B04.1.454.CMB.1.raw
tcagtacagatcgtcacgaccggtgctcgatttagacagtatatatccgcgggggcctggggagcctagctgtgctgtgggtccaggaggcagaactctgggtgtctcaccatggcctggatccctctacttcctccccctcctcactctctgcacaggctctgagcctcctatgagctgacacagcccaccctggtgtcagtcgtcccccaggaccaggaccggccaggatccacctgctcgtggagatggcattgaccaaagcaatatacttattcggtaccagcaagaagtcaggccacggaccctgtattgatgatgtaataagacagtgagacgccctacgaggactcccgtggacgtcgtaattcgtcgtcggcctccgagcctacgagggacaacgtacgtctacggttacgaccagtcgaggtacggtacgtccgaggacaaggaacgaacggtagacgtagtacttagttactcgtactaactctaagacaacgaacctaaccaacaacgttacgtaccgttggttacggacggacggaaccacggtccgtcgtaacccgg

SEQ ID NO: 156829 - DNA, 808 bp, Homo sapiens
  misc_feature: GYAE6OF01D70NF.35.15.B04.1.454.CMB.1.raw
tcagtacagatcgtcacgaccggtgctcgatttagacagtatatatccgcggggggggtccaggaggcagaactctgggtgtctcaccatggcctggatccctctacttctccccctcctcactctctgcacaggctctgaggcctcctatgagctgacacagcccacccgtcggtgtcagtcgtccccgaggacagacggccaggactcacctgctcgtaggagtatgctattcgaccaaagacaattacttaactttagttacggtaacccagtaccaagaacgttaccgaggacccaaccgggtccccccttaggttacgttaggtagttaggtaacttaggttaataaaacggtactaaccgttaggaacgggtacgggtacccccgttacggaacggggtactaccccgtaggacggaccggttactttccgttcgtacgggtccctaccgtaacgtccgttaacccggaacggggaaacctaaaccgtaacggttacccgttaaccggtttaccggtaaacccaagttaccgtaacgggttaacggggaaccggttacccggaacgggaccgtaaacgggaacggaaaccgggtagggacctttaaggtaactttttaacgttaaccgttcgttaaacgtaacttacgaacggtaccaacggtaacccaaacccgtaaactaacgttaccgtcccggttagggttaccgggacgggaacgggacaaccggtcgtacccgtaccggttaccgtaacgggccgacccgtaccggacgtccccgtccgtccccgtcgttaccccg

SEQ ID NO: 156830 - DNA, 688 bp, Homo sapiens
  misc_feature: GYAE6OF01EXN98.35.15.B04.1.454.CMB.1.raw
  modified_base (281)..(281): a, c, t, g, unknown or other
  misc_feature (281)..(281): n is a, c, g, or t
tcagtacagatcgtcacgaccggtgctcgatttagacagtatatatccgtgtcaggtgcagctggtggagtctgggggaggcttggtcaagcctggagggtccctgagactgtcttgtgcagcctctggattcaccttcagagactatttcatgacctggatccgccagactccagggaaggactggagtgggtctcacacatcagcagtactggcaatcccatgtactacgcagactctgtgacggccgatcactattttaggactaacgccgaaggtcnctgtatcgtgacaatgaacagcctgagagtcgaggacacggcatctattacgtgtgacaagtagtctaggtaggtggtgcgtaggtttggttcggtacgttaaccggtacgtacggaggttagtcggacggttcgtacggggacgaagggaccgaacgggtccgacccgttctacccgtacgtacgtaccttcccgaacccggtaacgggaccccgttagttaccccgggtttcccccttaccccccgggttcgggtaccccgtcccccgttcggtccccgttcccggtaaccgggtaggtaccccccgtaaccccgttcccggggggttccgggggaaccccctaaccggggaacccgggtccccccgggggttccccggttccgggggtccgtttaccccggggg

SEQ ID NO: 156831 - DNA, 651 bp, Homo sapiens
  misc_feature: GYAE6OF01BSSL0.35.15.B04.1.454.CMB.1.raw
tcagtacagatcgtcacgaccggtgctcgatttagacagtatatatccgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaagcaaatatacttattggtaccagcagaagtcaggccaggcccctgtattgatgatagtaataaagacacgtgagacggccctacgagggactccctggacgcgtattcgtctggcctacgacgtctacgaacgggacaacgagtacctacggttcgacctatccgaggtacggacgtcccgaaggacgtaaggaaacggacggacggtacgtaggtaactttacttaacgtgtactaatcgtaagacaacgtaaccaaaccctaacgtaacgtaccggttacccggttaggtttacgggaccgggtaacgggaacccgtaacggtcccgttaccggtaacccggttacccgtaacggttcccgaaccggtacccccgaaaccgggtcccccttaaccccccggttccggttaaccccg

SEQ ID NO: 156832 - DNA, 633 bp, Homo sapiens
  misc_feature: GYAE6OF01AN34J.35.15.B04.1.454.CMB.1.raw
tcagtacagatcgtcacgaccggtgctcgatttagacagtatatatccgcgggggggtccaggaggcagaactctgggtgtctcaccatggcctggatccctctacttctccccctcctcactctctgcacaggctctgacggcctcctatgagctgacacacgcccacccgtggtgtcagtcgtccccaggacagaccggccaggactccacctgctcgtggagatgctattcgaccaaagcaatattacttagtcggtaaccagcaagaagtcgacggccgacggcccctgtattgatgatagtaataagacacgtaggacgcgggcccgtcgggactcccgaggacgtacgtacttccgtcgtcgggtcctccgacgccgtacggaagggaaccaacgtacgtacgtacggttcgaacctagtacgtaggtaggacgtaccggacggacgaaggaacgaacggtaaggtaccgtagttaatttaacgttaccgtagtaacaacgtacacgacaacgaaccaaccgtaaactaacgttaccggtccggttaggtacggggacggaaggaccacggtccgtacggtaccgtacgcgtacgaccgaccgaagccctaccgcccctcgcctccg

SEQ ID NO: 156833 - DNA, 794 bp, Homo sapiens
  misc_feature: GYAE6OF01ELFY3.35.15.B04.1.454.CMB.1.raw
tcagtacagatcgtcacgaccggtgctcgatttagacagtatatatccgtgttcaggtgcagctggtggagtctgggggaggcttggtcaagcctggagggtccctgagactgtcttgtgcagcctctggattccaccttcagagacttatttcatgacctggatccgcagactccgagggaaggctggagtgggtcctcacacatcagcagtactggacaactcccatcgtactacgcagtactcgtgtaggaacgggcctattacctaccttaagtttttaacgggaacctaacgtacccgtaagggttccgcttaggtactcgtagacaaagttacgaacacggtccttagaagtacggtcggaacggacgaccggactaagtacttaattacgtggtacgtacgaaacggtacggttctaggtagggttggtcggtacgtagggtttggttcggtaccgtttaacgggttaaccgtaacgggtaacgggtacggttacgggtaccggttcggtacgggggtaacccgaaaggggtaaccccgtaacgggtccctaacccgggttccttacccgtacgtactacccgtttaaccccgaacccgtaaaccggggtccccttacgggtttccccggttcccccgtttacccccggtcggcccccgtacccggttcccggtacccgtaccccggtaaggggaccttacccccggtaacccggttcccggggtcggggaaccccgtacgggaccggggtaccccggttccccggtacgggtcccggttacccggg

SEQ ID NO: 156834 - DNA, 671 bp, Homo sapiens
  misc_feature: GYAE6OF01BM1XO.35.15.B04.1.454.CMB.1.raw
tcagtacagatcgtcacgaccggtgctcgatttagacagtatatatccgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacgccaggatcacctgctctggagatgcattgaccaaagcaatatacttattggtaccagcagaatcaggccagccctgtatgatgatgtataaagacacgtgagacggccctcgagggtactcccgtagacgtcgtatttcctcgtcggtccttaccgacgtcctaccggagggaaccaaacgtacgttaccgaacggtttacgaaccctaagtaccgtaaggtacgggaacgttacccgaagggacaaaggaaacggacggagggtactagggtaactttaagttacgttaggtaactaacgtcgaagaccgaacggtaaccaaaccaaaacgtaacgttaccggttacccgttagggtttacggggaccgggtaaacgggaacccgaaggtcccgtaacgggtacccgttacggttaacggtaccgaaccggtaccccgaaagggcccgttacccggccccccgttaacccggg

SEQ ID NO: 156835 - DNA, 810 bp, Homo sapiens
  misc_feature: GYAE6OF01BG3E7.35.15.B04.1.454.CMB.1.raw
  modified_base (294)..(294): a, c, t, g, unknown or other
  misc_feature (294)..(294): n is a, c, g, or t
tcagtacagatcgtcacgaccggtgctcgatttagacagtatatatccgtgtcaggtgcagctggtggagtctgggggaggcttggtcaagcctggagggtccctgagactgtcttaagtgcagcctctggattcaccttcagagacttatttcatgacctggactccgccagactccgagggaaggactgggagtgggtctcacacatcagcagtactggcaactccatgtactacgcagactctgtagaacgggcctactcacttagttttaggacaacgacgtaaggttcncgtgtatcgtgacaagtagaacacgaccgtgacgtacgtacgaggaccgacggcctagtacttacttacgtgtacgacgtaagtacgttcgtaggtacggttggtacgggtcgttaggtttgggttacgggtacgtttacccggggttaacgttaaccgggtaacgggtttacgttacggggtaccggttaccgggttacgggggaacccggtaaaccggggaacccggtaaacgttaccccgggtaacccggtttcccgttacccgttacccgtaaccgggttaccccgtttaaccccgaaccccgggtaaacccggggtacccccttaacgggtttacccccggttttacccccttaccccccgggttccgggtacccccgtcccccggttccgtaccccgttacccggccgggttaacccggacccgttccccgggttaccgggtccgggggtaacccctcccgggacgggtccccccggggtcccggttcgggggtccccgttaccccgggg

SEQ ID NO: 156836 - DNA, 637 bp, Homo sapiens
  misc_feature: GYAE6OF01BC4MO.35.15.B04.1.454.CMB.1.raw
  modified_base (286)..(286): a, c, t, g, unknown or other
  misc_feature (286)..(286): n is a, c, g, or t
tcagtacagatcgtcacgaccggtgctcgatttagacagtatatatccgtgtcaggtgcagctggtggagtctgggggaggcttggtcaagcctggagggtcccctgagactgtcttgtgcagcctctggattcaccttcagagactatttcatgacctggatccgccagactccagggaaggactggagtgggtctcacacatcagcagtactggcaatcccatgtacctacgcagactctgtgaaggccgtattcacctattttaggacaacgccgaaggttcnctgtatctgacaatgaacagcctgagagtcgagacacggcctatctaatactagtagaaaagtcgtagtaggtggtagtcgtaggttggttcggtacgtacgggttactacggtacggtagtcggtacgtcggtacgggaccgaagggtacccgaacggtcctaaccgttccgtacccgtcgacgtcccttacccgaaccgtaaccggccccgtaacgttcccgggttcccctttacccccgtcgggtccccgtcccgtggcccgtaccggacggtaccgccgtcccggtccggttccggggccacccggacggtcccgggtccccgtagggtccctcggcccgttacggg

SEQ ID NO: 156837 - DNA, 810 bp, Homo sapiens
  misc_feature: GYAE6OF01EBUXJ.35.15.B04.1.454.CMB.1.raw
  modified_base (225)..(225): a, c, t, g, unknown or other
  misc_feature (225)..(225): n is a, c, g, or t
  modified_base (786)..(786): a, c, t, g, unknown or other
  misc_feature (786)..(786): n is a, c, g, or t
tcagtacagatcgtcacgaccggtgctcgatttagacagtatatatccgcggggggggtccaggaggcagaactctgggtgtctcaccatggcctggatccctctacttcctccccctcctcactctctgcacaggctctgaggcctcctatgagctgacacacgcccaccctggtgtcagtcgtccccaggacagaccggccaggtacttacctgctcgtgganatgctatttcgacaagtaaagttagtttttagggttttacgaaccgaaggtaaagtaacggtaccgacgggacccgtaccgggtcccccgtttaggttccgtttacgggtactaaggtttcggttaccgggaacgggtaaccgaaccgaaacgggcccggtaacccccggtacggggtaaccttcccgtaggaggtaacgttactttcgtcgtacggcctacgagtccctagggacggtacttaggtcggtacctaccttgaactcacgtccgacggtcgggaccgtagggtcggaaggtagtagggacgtgttacgttagttatttgtttacggtttacgttaaacaaaccgttaaagttacctaagttacgttttaactttttaaggttttcggtttggggttacggttacggggtacgggtaacggttaccgttaacgggtttcggtaccgttacggttccgttaaacgggtcctaaccgggtaacccgtacggtccccgttacccgggttcccccgttacgggtaccttacccggtttccctcccggtttccccccncccgttcccgtaccggttaacccg

SEQ ID NO: 156838 - DNA, 776 bp, Homo sapiens
  misc_feature: GYAE6OF01BTIMT.35.15.B04.1.454.CMB.1.raw
  modified_base (127)..(127): a, c, t, g, unknown or other
  misc_feature (127)..(127): n is a, c, g, or t
  modified_base (425)..(425): a, c, t, g, unknown or other
  misc_feature (425)..(425): n is a, c, g, or t
tcagtacagatcgtcacgaccggtgctcgatttagacagtatatatccgtgtcaggtgcagctggtggagtcgtgggggaggcttggtcaagcctggagggtccctgagactgtcttgtgcagcctntggattcaccttcagagactatttcatgacctggactccgccagactccgaagggtaaggactggaggtgggtctcacacatcagcagtactggacaactcccattcgtactacgactagacttcgtggtacggaacgggtccgtacttacgaaccgttaggtttttaacgggacctaaccggcccgtaaagggttccgcgttacgtacttcgttaggactaaagtacgtaaacgacgtccgttaggaacggtaggtaccggaagaccggaccggacgtacttacgtattacgtgtanacgaagtacgtcgtaggtaggtggtcggtacgttggttaggttcggtcggttaaccggttacgtacggtaccgggttagtacgggtacggtacgggtacggggtaccgaaacggggtaacccgaacggttacccgtacccggttacgtacccgttacgacgttacccgtttaacccggacccggaaaccgggtcccccgttaacgggttcccggtttacccccgttacccccgtccgggtacccgtaccccgtccggtacccgtacccggaccggtaccggaacccttccgggtcccggggtaacgggtcccaccgggacggtcccgggccggttcgggccttacccgggg

SEQ ID NO: 156839 - DNA, 684 bp, Homo sapiens
  misc_feature: GYAE6OF01C5SAS.35.15.B04.1.454.CMB.1.raw
  modified_base (220)..(220): a, c, t, g, unknown or other
  misc_feature (220)..(220): n is a, c, g, or t
  modified_base (327)..(327): a, c, t, g, unknown or other
  misc_feature (327)..(327): n is a, c, g, or t
  modified_base (349)..(349): a, c, t, g, unknown or other
  misc_feature (349)..(349): n is a, c, g, or t
tcagtacagatcgtcacgaccggtgctcgatttagacagtatatatccgcgggggggtccaggaggcagaactctgggtgtctcaccatggcctggatccctctacttctccccctctcactctctgcacaggctctgaggcctcctatgagctgacacacgccaccctcggtgtcagtcgtccccaggacagacggccaggatccacctgctctggganatgctatcgaccaaagctaatatacttattcggtaccagcaagagtcgacggccacggcccctgtactgatgatagtaataaagacactgagcgcctgaggctccgngcgcgtattctcgtggcctcgngtcgtacgaagggaccaacgactcgacgttcgacatcgaggtggacgtccgaggacaaggaacgacggagtctaggtactttagtacgtcgttacaagttacgacgacgaacgtaacccaacccgtaaacgttaaccgttaaccggtttcccgggtttagggttttaccggggaccggggaacccggtaaccggaaccggtttacccggacccggggtttaacccggttaacccgggttaaaccgggtacccgtaaaccccgggtaaaccccggttaccgggttacccccggttaccccccgggttaccccccggttccggtttaaaccccccgg

SEQ ID NO: 156840 - DNA, 611 bp, Homo sapiens
  misc_feature: GYAE6OF01DP02M.35.15.B04.1.454.CMB.1.raw
  modified_base (249)..(249): a, c, t, g, unknown or other
  misc_feature (249)..(249): n is a, c, g, or t
  modified_base (527)..(527): a, c, t, g, unknown or other
  misc_feature (527)..(527): n is a, c, g, or t
tcagtacagatcgtcacgaccggtgctcgatttagacagtatatatccgtgtcaggtgcagctggtggagtctgggggaggcttggtcaagcctggagggtccctgagactgtcttgtgcagcctctggattcaccttcagagactaggggggggtttcatgacctggatccgccagactccgagggaagggactggagtgggtctcacacatcagcagtactggcaactcccatgtactacgcagacnctgtgaaggccgattacacctagtttttaggacaacgcaagggttcgtctgtatctgacaaagtgaacacgctagagagtcgagacacgcatctattactcgtgacaagagtcgtagtagtggtgcgtagttggttcggactacggtaacctaaggacgggttagtgggaccggttcgtacggggaccgaacgggaaccgtaaggtcccaaccgttctcctaccgacgtcctacccgaccgaacgggtcccacgttccgtcccttccccacgggtccnccctcgtcctacccgagggtaccaccgtcccgtccggtacgggggccctacggaccggtcccggcccggtgggtccgtcccggg

SEQ ID NO: 156841 - DNA, 734 bp, Homo sapiens
  misc_feature: GYAE6OF01CQIJS.35.15.B04.1.454.CMB.1.raw
  modified_base (318)..(318): a, c, t, g, unknown or other
  misc_feature (318)..(318): n is a, c, g, or t
  modified_base (371)..(371): a, c, t, g, unknown or other
  misc_feature (371)..(371): n is a, c, g, or t
tcagtacagatcgtcacgaccggtgctcgatttagacagtatatatccgtgtcaggtgcagctggtggagtcgtggggggaggcttggtcaagcctggagggtccctgagactgtcttgtgcagcctctggattccaccttcagacccgatatttcatgacctggatccgccagactccgagggaaggactggaggtggtctcacacatcagcagtacgtggacaactcccatcgtactacgcacgactcgtggtgaagggccgattccaaccttatttttaagggacaaccggaccgtaagggttcgctagtactcncgacaaatgaaacacgcctgagagtcgaggacgacggacctatactattaccngtcgacgaagtgtacgtggttagtgggtggtcgtaggtttgttacgggtaccgttaacgggttaccgttaacggtacgggttacgtcgggtacggttcggtaccgggggacccgaaacggggaacccgtaacgggtcccgaacccgttccgtacccgtacgtaccgtcccgttaccccgaaccggaacccgggtcccgtaacgttccccggttcccccgttacccccgtcgggcccgtaccccgtccgtccgttccccggaacgggtacccgcccggtacccgttacccggggtaccgggggacccggtaacccggtaaccggggccccgggttacccccggtcgggggtcccttacccgggg

SEQ ID NO: 156842 - DNA, 722 bp, Homo sapiens
  misc_feature: GYAE6OF01D6DL0.35.15.B04.1.454.CMB.1.raw
tcagtacagatcgtcacgaccggtgctcgatttagacagtatatatccgcgggggtgggtccaggaggcagaactctgggtgtctcaccatggcctggatccctctacttctccccctcctcactctctgcacaggccctgaggcctcctatgagctgacacagccaccctggtgtcagtcgtccccaggacagacggccaggatcacctgctcgtggagatgctattcgaccaaagcaatattacttatgtaccagcaagagtcgacggaccacggtcccctgttacgttgagtagtagtaggttaataaagacgtactaggaaggaccggtacccgtacgaacggggtactaccccgaggtacgacggttatttccgtcgtcggtaccttaccgacgtaccgtacgaacggggaaccaaccgtacgttacctacgtttacgaccagtacgtaggtaggtacgtaccgaggtacgaaagtaacggaacggtacgtacgttagtaactttaagttacccgtattaaccgaacgttcaaacggtactaacgaaaccctaaaccgtaaaccgttaacgttaaccggtccccggtttaggggttaccgggaacgggtaacggtaacgaaccgggttggtacccggtaccggttaccggtaccggtaccgtaacccggtacccggaaccggtacccgttacccggtcccccgtcgggttacccccg

SEQ ID NO: 156843 - DNA, 678 bp, Homo sapiens
  misc_feature: GYAE6OF01EDR2K.35.15.B04.1.454.CMB.1.raw
  modified_base (65)..(65): a, c, t, g, unknown or other
  misc_feature (65)..(65): n is a, c, g, or t
  modified_base (105)..(105): a, c, t, g, unknown or other
  misc_feature (105)..(105): n is a, c, g, or t
  modified_base (150)..(150): a, c, t, g, unknown or other
  misc_feature (150)..(150): n is a, c, g, or t
  modified_base (171)..(171): a, c, t, g, unknown or other
  misc_feature (171)..(171): n is a, c, g, or t
tcagtacagatcgtcacgaccggtgctcgatttagacagtatatatccggcgggggcctggggancctagctgtgctgtgggtccaggaggcagaactctgggtntctcacatggcctggatccctctacttcctcccctctcactctcngcacagctctgacgcctctangagcagacacacgcccaaccgtggtgtaccagttcgaccccgaggacaggacgctaaggactccacctgctagaggatactgactattagaccaaaagactaaatatacctttaagtacggtaccagacagtaagcacggcagaccctagtatgtatgagtagtaataagacataggacgaacgccctagaggtaccttccgagagtcgtacttctgtagctaccgcgtactagacggaacaacgtagtacctaacggttcaactactacggaggttacggtacgtaacgaacggtaacgaaaggtaaccggaacggaccgttagtaacgttaacgttttaaacgttacgttaaccgttacgaaaacgtttacgaacggaacctaaaccgtaaacccgaaaaccttaaaacgtagttaacccggggttacccggttttaacggttaacgggggacccgggttaaaacgggaacccgttaacggtacccggttaagtaaacccccggg

SEQ ID NO: 156844 - DNA, 690 bp, Homo sapiens
  misc_feature: GYAE6OF01CL9B6.35.15.B04.1.454.CMB.1.raw
tcagtacagatcgtcacgaccggtgctcgatttagacagtatatatccgcgggggtgggtccaggaggcagaactctgggtgtctcaccatggcctggatccctctacttctcccctcctcactctctgcacaggctctgaggcctcctatgagctgacacagccaccctcggtgtcagtgtcccccgaggacaggacggccaggatcacctgctctggagatgcagttgacctaaagcaatatacttattcggtacagtacagaagtcgaacggtccgaacggtccccgttagttagttacgtagtagtaagttagtaaaagtaaacgaacaacgttaggacggtaccggtcccgtacgacgggtacctcccgtggaacgtcgtacgttccgtcggtcggtccttaccgacgtccgtaacggacgggtaaaccaaccgtaggtaccgtaaccgtttacgaaccgtactaccggtagggtacgggaacgtcccggaagggaaccgtaaaggaacggtacgagggtccttaaggtaacctttaattacgtacgttacgtaataccgaacgtacgaacgtaaccaacccgttaataacgttcggtacccgttgggttacgggaccggtaaggaacccgtagtaccgacgtacccgtacgtacgacgtacaccgacgcctcccgcccgtaccg

SEQ ID NO: 156845 - DNA, 648 bp, Homo sapiens
  misc_feature: GYAE6OF01EUOV1.35.15.B04.1.454.CMB.1.raw
  modified_base (593)..(593): a, c, t, g, unknown or other
  misc_feature (593)..(593): n is a, c, g, or t
tcagtacagatcgtcacgaccggtgctcgatttagacagtatatatccgtgtcaggtgcagctggtggagtctgggggaggcttggtcaagcctggagggtccctgagactgtcttgtgcagcctctggattcaccttcagagactatttcatgacctggatccgccagactccgagggaaggactggagtgggtctcacacatcagcagtactggcaactcccatcgtactacgcagactctgtgaacggccgattcacctagtttttacgggacaacgccgtaaggttcgacttaggtacttcgtgacaaatcgaaacacgcctagagtagtacgacggacacggtccagtcttaattactgtagacgaaggtcgttcgtggtagttagggtgacgtaggtttggtggtaccgttacggtaccgtaacggtacggttagtacgggtacggtaggtcgggggaaccaaggggaccgtaagggtcctaccggtcttcccgtagacgtccttaccgaaccgtacgggtccctacgttcccggttacccttccccggccgcccgtcccgtcgtccgtacccgaggaccgtacccncccggttacgggcggggaccacggtacgggacccggtcccgtcggggctcccggg

SEQ ID NO: 156846 - DNA, 768 bp, Homo sapiens
  misc_feature: GYAE6OF01ERI6F.35.15.B04.1.454.CMB.1.raw
tcagtacagatcgtcacgaccggtgctcgatttagacagtatatatccgcggggggggtccaggaggcagaactctgggtgtctcaccatggcctggatccctctacttctccccctcctcacctctctgcacaggctctgaggcctcctatgagctgacacagccaccctggtgtcagtcgtccccaggacagacggccaggatcacctgctcgtgagatgctattcgaccaaagctaatacttacttagtttaggtaaccagcgaaggaacgtcgacggaccgacggtcccccttaggttattgatgtaagttgttaaagttaaaagacctaacggtaggtaacggaccggtccccgtacggacgggtacttacccccggtaggacgtacgtaattttcccgtacggttcggtaccttaccaacgtccgttacggaacgggaaaccaaaccgtacgtaccgtaacgtttacgaaccctagtacgtaaggttaggggaccgttaccggacggaaacgaacgggaaacgaacgggtacgggtcgttaagtaaacgtttttaattaccgttagtaccgtaaatacggaagacctaacgaacccaaacccgtaactaaacgttaccggttaccccggttagggtttacgggaaccggggtaggaacccgtaaacgggtccgtaccgggtacccgttcccgggtaacgggttacccaacgggtaccccgagggtaccccgttaccccgtccccccggttcggttaaccccg

SEQ ID NO: 156847 - DNA, 623 bp, Homo sapiens
  misc_feature: GYAE6OF01D5K1N.35.15.B04.1.454.CMB.1.raw
  modified_base (103)..(103): a, c, t, g, unknown or other
  misc_feature (103)..(103): n is a, c, g, or t
tcagtacagatcgtcacgaccggtgctcgatttagacagtatatatccgcgggggggtccaggaggcagaactctgggtgtctcaccatggcctggatccctntacttctccccctcctcactctctgcacaggctctgaggcctcctatgagctgacacagccaccctggtgtcagtcgtccccaggacagacggccaggatcacctgctcgtggagatgcattgaccaaagcaatatacttattggtaccagcagaagtcacggccaggcccctgtattcgatgtatgtaagtaaagacactgagacgcctcgaggactcccgtgacgcgtattctcgtgcctcagtctacgagggaacaacgacgtacgacgttacgaccgtatacgaggtaggacgtaccgacggacaaggtaaacggacggaggcttaggtatttaacgttacgttgtaaccaagttacgaacggacaacggaaccctaaccaaactaagttaccgtacggtacggtttacggtttgggaaccgggtacgggaaccgtaacggccggtcgggtacccttaccggtaggtaccctaccgggtaacccgaaggtccccgtccgtcccccggttacccggg

SEQ ID NO: 156848 - DNA, 740 bp, Homo sapiens
  misc_feature: GYAE6OF01AHC9Y.35.15.B04.1.454.CMB.1.raw
  modified_base (334)..(334): a, c, t, g, unknown or other
  misc_feature (334)..(334): n is a, c, g, or t
tcagtacagatcgtcacgaccggtgctcgatttagacagtatatatccgcggggggggtccaggaggcagaactctgggtgtctcaccatggcctggatccctctacttcctccccctcctcactctctgcacaggctctgaggcctcctatgagctgacacacgcccacccgtcggtgtacagtcgtccccgaggacacgaccggccgaggactccactcggctcgtggagagtcgacagttacgaccaaagctaaattaattactttaagttacggtaccagacaagaacgtaccgacggccgacggcccctgtacgtgagtgactagtaanaaacgacgacgtagacggacggccgtacggacgggtacctcccgtggaacgtcggtaacttctcgtcggtctacccgtacgaccgtacggaacggaacctaaacgtacggtacctacggttacgaacctaagtacggaggtacggtaccggtaccggaagtaaccgaaagggaacggacggtaacgggcgtttaacgtacgttttaaacgttacgttacgtttaaccgaaacttaccggaacgtaaccgtaaacgacctaaaacccgtaaacgtaaacgttaccgggttacccggttacgggtttacggggaccgggtaacggaccgtaaacgtccgtacggtacccggtccgtaacggtaccacccggaccgtacggaccgtccccgtccccggtcgttaccccg

SEQ ID NO: 156849 - DNA, 752 bp, Homo sapiens
  misc_feature: GYAE6OF01DWGUM.35.15.B04.1.454.CMB.1.raw
  modified_base (231)..(231): a, c, t, g, unknown or other
  misc_feature (231)..(231): n is a, c, g, or t
  modified_base (247)..(247): a, c, t, g, unknown or other
  misc_feature (247)..(247): n is a, c, g, or t
tcagtacagatcgtcacgaccggtgctcgatttagacagtatatatccgcgggggggtccaggaggcagcgctctcgggacgtctccaccatggcctgggctctgctattcctcaccctcctcactcagggcacagggtcctgggcccagtctgccctgactcagcctgcctccgtgtcgtgggtcctcctggacagtcgatccaccatcctcctgccacgtaggaacccngcagtcgtacgttggnctgactaactatcgtctcgtagtaccaaccaccaccgaggaccaaaccgaccccctaaactcatagtactttagacgtatcgtactaaggtaacgtcccgggtacccttacggtacgggttttacctaacgttccgtctttccgttcgtcggtacctaccgtaacgtcgtacggaccaaccgtcccggtcccttccctacgacctacgttccgtcggtcgggtccctacggacggtccgtaggaccggaacggtcggtacttacgttaatttacttacgtcgacgtacgtacctaacgtaactaacctaaccctaaccgacgtaccgtaaccgtaccctacccgtttacggttccggttacggggttaccgggaccggggtaaaccgggtaaccgtaaccggtaccgttaacccggtaccccggttaccggttaaccggtaaccccgtacccggtaaccccggaccgggttccccccgttccccggtcccccccggtttaccggg

SEQ ID NO: 156850 - DNA, 756 bp, Homo sapiens
  misc_feature: GYAE6OF01ELZZH.35.15.B04.1.454.CMB.1.raw
  modified_base (215)..(215): a, c, t, g, unknown or other
  misc_feature (215)..(215): n is a, c, g, or t
tcagtacagatcgtcacgaccggtgctcgatttagacagtatatatccgtgtcaggtgcagctggtggagtctgggggaggctggtcaagcctggagggtccctgtagactgtcttgtgcagcctctggattcacctttcagacgactatttcagtgacctggactccgccagctcgagggaaggactggagtggtctcacacatcagcagtacngacaactcccatcgtacacgcagactgtgtgaggccgattcactattttaggacaacgccgtaagggttctcgtgtactctgactaagtgaacacgcctagagagtcgaacgacgaccggcactactacttactcgtcgacgaaggtacgtcgttaggtacggtgggtggtacgttaggtttggttgggtaccgttacgggttaaccgtacgggtaacgggttaggtacgggtaccgggttcgggtacgggggtacccggtaaacggggtaacccggtaaacgggtacccgtaccccgggtttaccttaccccgttacgtaaccgtcccgttttaccccggaacccggtaacccggggtaccccgttaaccggtttcccgggttacccccgtttccccccggtccgggtccccggtcccccgttccggtaccccgttacccggtacgggtacccgtaccccgtcccggtaccggggttccgggggacccgtacccggaccgggtccccggggtccccggttggggtccccgttacccgggg

SEQ ID NO: 156851 - DNA, 651 bp, Homo sapiens
  misc_feature: GYAE6OF01D3C7R.35.15.B04.1.454.CMB.1.raw
  modified_base (226)..(226): a, c, t, g, unknown or other
  misc_feature (226)..(226): n is a, c, g, or t
  modified_base (614)..(614): a, c, t, g, unknown or other
  misc_feature (614)..(614): n is a, c, g, or t
  modified_base (622)..(622): a, c, t, g, unknown or other
  misc_feature (622)..(622): n is a, c, g, or t
tcagtacagatcgtcacgaccggtgctcgatttagacagtatatagtccggcgggggggtccaggaggcagaacctcgtgggtgtctcaccagtggcctggactcccctctacttctccccctctcactctctcgcacaggctctgaggcctcctatgagctgacacagccaccctggtgtcagtcgtccccaggacagacggccaggactcacctgctctgggantgcattcgaccaaagcaatatactttagttcggtaccagcagaacgtcacggccaacggccctggtatggatgtatgtaataaagactacaggaagcgcccgtagaacgggtactaccccgtaggacacggtactttaccgtcgtggacccttccgacgtcctacggaacgggaactaacgtacggttacccgtaacgtttacgaaccgtaatcccgtagggtcgggtaacttaccggaacggaacgaacggtaaacggtaaccggaggtacgttagttaatttacgttaacgtttcgaattacagagaccaacgtaaccaactaaactaaggttcccgttacgtggttacggacgggtagggtaccgacgtcgacggtaccgtccgnggtaaccnccgaccgacgcctccgccccgtggtaccc

SEQ ID NO: 156852 - DNA, 767 bp, Homo sapiens
  misc_feature: GYAE6OF01C4IC4.35.15.B04.1.454.CMB.1.raw
  modified_base (183)..(183): a, c, t, g, unknown or other
  misc_feature (183)..(183): n is a, c, g, or t
tcagtacagatcgtcacgaccggtgctcgatttagacagtatatatccgcgggggctgtgggtccaggaggcagaactctgggtgtctcaccatggcctggatccctctacttcctccccctcctcactctctgcacaggctctgaggcctcctatgagctgaccacacgcccacccgtggtntcagttcgtccccgaggacacggaccggcccgaggactccaccgtgcctcgtggagtatcgctagttcgaccaagtcaatattacttagttacgtaccagacagaacgtcgacggccaacggccccgttagtacgtgtatcgtaatagtaataaacgacctagtagacgacgccgtacgacggctccgagacgcgtattcgcgtcggtcctcgacgcgtacgacggaacctaacgtacgtacgtacgttacgaacgtacgtacgaacggtacggtaccgtaacccggtacggaacggaacgggtaaaccgggaaccggtaacgggtaccgttaaggtttaaacgttttaacgtttaccggttaacgtaaccgttaaacgtacggaaccggtaaacccgaaaccggtaaccccgtaaaacgaaacccggtttaaacgttacccgggtttaacccggtaggggtttaaccggggaaccggtaaccgggtaaaccgtaacgggtaccggttacccggtaacccggttaccggtaacgggtacccgtaccgggtaacccggtaacggtcccccggttaaccccccggg

SEQ ID NO: 156853 - DNA, 956 bp, Homo sapiens
  misc_feature: GYAE6OF01ES3BX.35.15.B04.1.454.CMB.1.raw
  modified_base (173)..(173): a, c, t, g, unknown or other
  misc_feature (173)..(173): n is a, c, g, or t
  modified_base (200)..(200): a, c, t, g, unknown or other
  misc_feature (200)..(200): n is a, c, g, or t
tcagtacagatcgtcacgaccggtgctcgatttagacagtatatatccgcgggggtgggtccaggaggcagaactctgggtgtctcaccatggcctggatccctctacttctccccctcctcactctctgcacagctctgagcctctatgagctgacacagccacccgtggtntcagtcgtcccaggacagacgccaggntaccacctgctcgtggagactgctagttgaaccaaagactaaattacgttaccttaattcggtaaccagacgaagtaacgtacgacggaccgacggtccccgtagttaacttggataggtagttagtaaagtaaaagtacctaacgtaggacggacggtacccgttacgaacggtacctacccgtaggacgtaccgtaacgttcgttcgtacggtaccctaccgtacggaccgttacggaacgggaaacctaacggaacggttaccgtaaccggttaccgtaaccgtaacgttaacccggtaagggtttacgggtaaccggttacccggaaacgggtaaaccggtaaaacggggtaaaacccgggaacgggttaaaccggggttacgtttaacgggttttaaaaccgtttaacggtttttaaaccgttacgggttaaaacccgttaaacgttaacccggtaaacggtaaacccgaaaaccgggtaaaacccccctaaaaccgttaaaaaccgttaaacgggtttttaaacccccgggtttcccgggttttaacgggggtttaaacccgggtaacgggggtaaaaccccggggtaaacggttaacccgggttaaccgtttaaaccccggggttaaaccccggtttaaccccggggtttaacgggaaacccccggttaaacccgggaacccccgggtaaaacccgggtttccccccggtttaaacccccgggttcccccccgggtttaaacccccggg

SEQ ID NO: 156854 - DNA, 774 bp, Homo sapiens
  misc_feature: GYAE6OF01BM1DE.35.15.B04.1.454.CMB.1.raw
tcagtacagatcgtcacgaccggtgctcgatttagacagtatatatccgcgggggtgggtccaggaggcagaactctgggtgtctcaccatggcctggatccctctacttcctccccctcctcactctctgcacgaggctctgacggcctcctatgagctgacacacgccctacccgtcggtgtccgagtccgtccccgaggaccacggaccggccgaggactccaccgtcgtcctacgtagggagtacgtcggtacctagttacgaaccaaagtacctaaattacttaacgtttacgttacggtaaccagaccgtaaggtaacgtcgaaccggtcccgaaccggtccccgttaggttagttacggtagtacggtaagttaaggtaaacgtaaacggacctacgtaggaacggaccggtacccgtacggacgggtacctacccggtagaccggtctacttcgtcgtccgtacctaccgtagtacgtacggaaacggtaccaaacgtcgtaccgtacgtaccgactagtacggtaggtacggacgtaacacgggtacgtaaagggaccggtagacggttacgtagttacttaacgttacgtacgtaactagtaccgaagtacgaaccgtaaacaacccgttaaattacggtacccggtacggttaggggtaccggagggtaaccggtaaccgtcgtacccggtacggtaccgtaccggtaccggaaccgtacccggtaccggtacccgtcccggtccccgtaaccccggtaccgg

SEQ ID NO: 156855 - DNA, 685 bp, Homo sapiens
  misc_feature: GYAE6OF01B5MSO.35.15.B04.1.454.CMB.1.raw
  modified_base (136)..(136): a, c, t, g, unknown or other
  misc_feature (136)..(136): n is a, c, g, or t
  modified_base (241)..(241): a, c, t, g, unknown or other
  misc_feature (241)..(241): n is a, c, g, or t
  modified_base (260)..(260): a, c, t, g, unknown or other
  misc_feature (260)..(260): n is a, c, g, or t
  modified_base (386)..(386): a, c, t, g, unknown or other
  misc_feature (386)..(386): n is a, c, g, or t
  modified_base (410)..(410): a, c, t, g, unknown or other
  misc_feature (410)..(410): n is a, c, g, or t
tcagtacagatcgtcacgaccggtgctcgatttagacagtatatatccgcgggggtgggtccaggaggcagaactcgtgggtgtctcaccatggcctggactccctctacttcctcccctcctcactctctgcagnggctctgacggcctcctatgagctagacacacgcccacccgtcggtgtcacgttccgaccccgaggacacggaccggccgaaggactccaccttgccttgagganatgctagtacgaaccgaanactaattacgttaacttagttacgaaccagagaagtaacgcgacggtccgaccggtcccttagttagtgtaagtgtagttacgtaaataacgacctagtagacgaccgccgtagaacggctaccgngacgtcgtcttcgcggctctacgngacgacgaacggtaactaacgcgtacgtacggttaacaccgtagtacggtacggtacggtaacgtaccggaacgaacggaaaagggttaacggaccgggtaaggtaccttaaggtaacttttacgtaacgtacgtaaactacgacgaacggaccaaacgtaaccaaaccgtaagttaacccgttcgggtaccgttagggtacgggacggtaaccgacgtacgtccgtaacggccgtagacggtaccaccggacctaggcccctccgcccgttccg

SEQ ID NO: 156856 - DNA, 712 bp, Homo sapiens
  misc_feature: GYAE6OF01EAWU8.35.15.B04.1.454.CMB.1.raw
tcagtacagatcgtcacgaccggtgctcgatttagacagtatatatccgcgggggtgggtccaggaggcagaactctgggtgtctcaccatggcctggatccctctacttcctccccctcctcactctctgcacaggctctggacggcctcctatgagctagacacacgcccacccgttggtgtccgagttccgtaccccgaggaccaggaccggaccaggactccacctgctcgtaggatatgactagttcgaacaaagctaaattacttactttagttacggtaaccaggacaagtaacgtcgacggaccgaccggtccccgttagttacgttagaagtggtaattaacggtaaagtaaaaggtaacctaacgttacggaacggtaccgtacccgtaggacggtacctcccgtaggacgtacgtactttcgtacgtcggtacctccgacgtcgtacgacggactaacgacgttacgtacgttacgaccgtagtacgtacggtaggtacgtacgaaggacgaaacggggaacgacgggtacgtacgttagtttattacgtttacgttacgataacgtacgacgacgactaacaaacctaactacgtaccgggttccgttagggtacggaccgggaacggtacgacggtacccgtacggtcccgtacgtacggtaccgacgacccgtacggtcccgtcccgcccgttacccg

SEQ ID NO: 156857 - DNA, 960 bp, Homo sapiens
  misc_feature: GYAE6OF01D4XJB.35.15.B04.1.454.CMB.1.raw
  modified_base (138)..(138): a, c, t, g, unknown or other
  misc_feature (138)..(138): n is a, c, g, or t
  modified_base (174)..(174): a, c, t, g, unknown or other
  misc_feature (174)..(174): n is a, c, g, or t
tcagtacagatcgtcacgaccggtgctcgatttagacagtatatatccggcgggggtgggtccaggaggcagaactctgggtgtctcaccatggcctggactccctctacttcctccccctcctcactctctgcacgnggctctggacggtccctctatgacgtctacgacacncgacccacccgtcggtcgtcgtacgttccggacccgaaggaccgacggaccggccgaacggtactccaccgtcgtcgtcggtaggatactcggtactacggtttaccgaaaccgaaacgtacgtttaaaacttacgtttaaccgttttacggttaacggaacccgtaaggtaccggtaaagggttaaccggtacggaaccgggtaccgtaccccgggttacccttaggttaacgttagtaacgttaggtaaaggttaaacgttaaaccggtaaacgaaccgtacgggtacggggtaaacccgggcggttaacccgtaacggggtacccgggttaacctcccgggtaaggtaaccgttaccggtttagttcccgttcggtacccggttcctaaccggacgttacccgaacggtaaccggaaccttaaacggtccgtaacttaccggtacgtaacgtacgtaggtacggtaccggaacgtaccggaaacggtacggaaacggtaacgacgggtaacgttacggttaagttaacgtttaacctaacggttacggttaactaacgttaaccgacgtaaacccggtaaccctaaccgaaaccgttaaacccgttaacgggtttacccgggttaccggttaacgggggttaacgggaacccggtaaacgggtaacccggtaacccgggttaggttaacccccgggtccgggtaaacccggttcgggaacccggtaaaccccgggttacgaccccgggtttacccgggtacccccgtccccggtttaacccgg

SEQ ID NO: 156858 - DNA, 953 bp, Homo sapiens
  misc_feature: GYAE6OF01BKSWY.35.15.B04.1.454.CMB.1.raw
  modified_base (318)..(318): a, c, t, g, unknown or other
  misc_feature (318)..(318): n is a, c, g, or t
tcagtacagatcgtcacgaccggtgctcgatttagacagtatatatccgcgggggggtccaggaggcagaactctgggtgtctcaccatggcctggatccctctacttcctccccctcctcactctctgcacaggctctgaggcctcctatgagctgacacacgcccacccgtcggtgtcagtccgtccccgagggacaggaccggccgaaggtactttaccgtgctcgtggaagtagtgctagttgtacaaagtaaagttgtttttgggttttacggacaaggtaacgagtcgacggccgacggtccctgtctgtanagtgtcgacgacgacgaacgtccgacccgtccggactcccgtaggaagtacgttactttccgtcgtcggtacctacccgtcggtacctacgggtaacgggtcttaaggtccgggttacccttacccgtttaggacttaccgtacgttaccgggtaccgggtccgggggtacccgtaaggggttagggaacggttacggtacgggtacgggttactttaacggttaacgttttaaacgttttaggtttaacggttttaccgttaaaccgtaaaaaccggttaacccgtttaaaccgttaaaggttttacgttttaaaacggttttttttaccgggtttttttaacggggtttcccgggggttttaacgggggttttaccgggggtaacccggggggttaaagggtttaaacccggtttaaacggggtttttaacccggtaccggttttaaccgggttaacccggttacgggttaacccggtaaacccggtaccccggtaaaccggggtttccccggttaacccccgtttccccccggggtaccccggtttacccttaaccccccggttttacccgtttcccccccgggttaaaccccccctttaccccccggttcccgttaacccggttaccccgg

SEQ ID NO: 156859 - DNA, 663 bp, Homo sapiens
  misc_feature: GYAE6OF01AEYLX.35.15.B04.1.454.CMB.1.raw
  modified_base (338)..(338): a, c, t, g, unknown or other
  misc_feature (338)..(338): n is a, c, g, or t
  modified_base (351)..(351): a, c, t, g, unknown or other
  misc_feature (351)..(351): n is a, c, g, or t
  modified_base (357)..(357): a, c, t, g, unknown or other
  misc_feature (357)..(357): n is a, c, g, or t
  modified_base (372)..(372): a, c, t, g, unknown or other
  misc_feature (372)..(372): n is a, c, g, or t
  modified_base (384)..(384): a, c, t, g, unknown or other
  misc_feature (384)..(384): n is a, c, g, or t
  modified_base (423)..(423): a, c, t, g, unknown or other
  misc_feature (423)..(423): n is a, c, g, or t
  modified_base (445)..(445): a, c, t, g, unknown or other
  misc_feature (445)..(445): n is a, c, g, or t
  modified_base (447)..(447): a, c, t, g, unknown or other
  misc_feature (447)..(447): n is a, c, g, or t
  modified_base (483)..(483): a, c, t, g, unknown or other
  misc_feature (483)..(483): n is a, c, g, or t
  modified_base (504)..(504): a, c, t, g, unknown or other
  misc_feature (504)..(504): n is a, c, g, or t
  modified_base (512)..(512): a, c, t, g, unknown or other
  misc_feature (512)..(512): n is a, c, g, or t
tcagtacagatcgtcacgaccggtgctcgatttagacagtatatatccgcgggggggtccaggaggcagaactctgggtgtctcaccatggcctggatccctctacttcctccccctcctcactctctgcacaggctcgtgacggcctcctatgagctgacacacgccctacccgtcggtgtcaggttccgtaccccgaggactacggaccggccaaggtacttccacccgttgccttcgtacggaatgcgactattaccggaaccaaagacctaaagttacttaacctttagtacggtacccagacagtaacgtcgaacgccgtacgcctagtgtanatagatacgtaanaacgcngtagacgcgtaccgnacggtactccgngtactagcttgtcgcgcctacagtcacgaacgacgtacncggtactacggttccgactagngngtaccggtaccagacgacgagtaacggacgagttanacgtattacgtatcggtaacnggtaaccntacaacccgtaactacgtaagaccggttcgtaacgggtgtaccggggagtaacccggactaacgtacgggttcccgacgtttaccggtacgtaacccggaccgtaacccggacccggttccctcccccgggttaacgtccggttaaccccg

SEQ ID NO: 156860 - DNA, 737 bp, Homo sapiens
  misc_feature: GYAE6OF01BXSD4.35.15.B04.1.454.CMB.1.raw
tcagtacagatcgtcacgaccggtgctcgatttagacagtatatatccgcgggggtgggtccaggaggcagaactctgggtgtctcaccatggcctggatccctctacttctccccctcctcactctctgcacaggctctgaggcctcctatgagctgacacacgccaccctcggtgtcagtcgtcccaggacacgacggccaaggactccaccgtgctctgggagatgcaattcgaccaaaagacaaattacttaactttagtttacggtaaccagacaagaacgtcgacggacccgaacggtccccttagttacttgatagaattgtaataaagacacgtgacgacgcccgtagacgggtaccttcccgtaggacgtacgtactttctcgtcggcctaccgacgtacgtcgaacgggaaccgaactcgtacctacgttacgaccactacgagtacggtacgtaccgacggacgaaggtaagacgaggacttagtaacgtttacttacgtaacgttacaaacttcgaacgtacgaaccgtaaaccgaaaccaaacccgtaacgttaccggtttacccggttacgggtttaaccggggaccgggtaaccgggaaccggttaaaaccggtccggttaacccggtaaaccccgggtttcccggttaaaacccgggtccccgtaaacccgggaccccgtaaccgggtcccctacccccgggtccccccggtttacccggg

SEQ ID NO: 156861 - DNA, 724 bp, Homo sapiens
  misc_feature: GYAE6OF01A07VG.35.15.B04.1.454.CMB.1.raw
tcagtacagatcgtcacgaccggtgctcgatttagacagtatatatccgcgggggggtccaggaggcagaactctgggtgtctcaccatggcctggatccctctacttctccccctcctcactctctgcacaggctctgaggcctcctatgagctgacacagcccaccctcggtgtcagtcgtccccaggacaggaccggccaggatccacctgctcgtaggagatgctattcggaccaaaggccaattattacttattggtaccagcaagagtcgaggccacggcccctagttacttgatgatgtaacaaagacacgtgagacggccctagagggtactccgagacgcgtacttctcggtcgtcctccgacgtccgtacggaagggtaaccaacgtacgtaccgtaacggttaccgaacctactacggaggttacgggtacgtacccggaacggacgaagggaacgtacggacgtacgttacgtaagttttacgttacgtacgtacgtaacttaccgagtaaccaacgtaacccaacccgtaaacttaacgttacccgggttaccgggtttacgggttaccgggggaaccgggtaacccgggtaaccggtaaccggtccggttacccggaacccccgggtttccggtaacggtacccggtaacggtacccccggaacgggttcccccgttacccccggtccccccggttcggttaacccccgg

SEQ ID NO: 156862 - DNA, 764 bp, Homo sapiens
  misc_feature: GYAE6OF01BSYF9.35.15.B04.1.454.CMB.1.raw
  modified_base (565)..(565): a, c, t, g, unknown or other
  misc_feature (565)..(565): n is a, c, g, or t
tcagtacagatcgtcacgaccggtgctcgatttagacagtatatacccgcgggggtgggtccaggaggcagaactctgggtgtctcaccatggcctggatccctctacttctccccctcctcactctctgcacaggctctgagcctcctatgagctgacacacgccctacccgtcggtgtcagtcgtccccgaggacaggacgcaggactccacctgctcgtggagatgacattcgaccaaagtcaaattacttaacgttagttacgtaaccagacaaggtaacgtccgacggaccgacggtcccttaggttaacttggaattaggtaacgttagttaaacgtaaacgacgtacgtaggacggtaccggtacccgtacggaacggtaccgtaccgtaggacgtacgttacttcgtcgtcggcccttacgacgtacgtacggaacggtaccaaacggtcgtaccgtaccggtacaacctacgtacgtaggtacggacgtaccgaggaacgaaggtaacggacggtaggtacttaggttaatttacgttacgtacgtaactacgtanaacgacctaaacggaacctaaaccgtaaaccgtaacggtttccggtttacccggttaagggttacccggggaacgggtaaccggtaaccggtaacgggtcccggtttaaccgggacccgttccggtaacgggtacccgaacccgggtaacccggtaacgggtcccccgttaccccgggtcccccgttccggttaacccg

SEQ ID NO: 156863 - DNA, 992 bp, Homo sapiens
  misc_feature: GYAE6OF01AGNGZ.35.15.B04.1.454.CMB.1.raw
tcagtacagatcgtcacgaccggtgctcgatttagacagtatatatccgcgggggtgggtccaggaggcagaactctgggtgtctcaccatggcctggatccctctacttctcccctcctcactctctgcacaggctctgaggccctctatgagctgacacacgccctacccgtcggtgtccagtcgtaccccaggaccacggaccggccgaaggactccgacccgtgaccgttcgtaggggagtactcggacctagttaccgaacccgtaaaaggtccgttaaaacttacgtttaaccgttttaggtttaccggtaacccaggtaacctaaggtaacgtaccgggaaccggtacccggtaaccccggtccccgttaaggttacgtttacggaagtttaggaagtttacgtaaaacgttaaacggtaccgtaacggtagggtaaccggtaccggtacccggttaacgggaaccggggttaccgttacccggttaagggtaccggtaccggtttaccgtttaccggtacccggttaccggggtacccttacccggtaccggtaccggttaaccgggaaaccgggtaaaccttaaaacccggtcggttaacccggttaccgggttaacgtaacccggtacgtaaccggggtaaggggtaccccgggtaccgttaacgggaaccgggtaaccgggaaaccgggtaaaacggccgggggttaaagtttccgttaaaggttttaaccgttttacgtaaccggttaagtaacccgttaaaacgtccggaaaccggtacggttaaaacccaaacccgttaaaccgtaacccggttaacggggttacccccgttcgggggttttaacggacccgggggaaacggtaaccgggttaacccgtaaccggttccgaaccgggttaccccggtacggtaaccccgtccgtaaccggggtacccccggtaacgttccccggtacccccgtccccggttacccggg

SEQ ID NO: 156864 - DNA, 597 bp, Homo sapiens
  misc_feature: GYAE6OF01EQQKX.35.15.B04.1.454.CMB.1.raw
  modified_base (190)..(190): a, c, t, g, unknown or other
  misc_feature (190)..(190): n is a, c, g, or t
  modified_base (410)..(410): a, c, t, g, unknown or other
  misc_feature (410)..(410): n is a, c, g, or t
tcagtacagatcgtcacgaccggtgctcgatttagacagtatatatccgtgtcgaggtgcagctggtggagtctgggggaggcttggtcaagcctggaggtccctgagactgtcttgtgcagcctctggattcaccttcagagactatttcatgacctggatccgcagactccaggaagggactgggagngggtctcacacatcagcagtacgtggccaatcccgatacgtactacgcaagactactgtgaagggccgtatcacctagttttaggacaacgaccaagggttacgcgttgtatctgtacaatgaaacagccttgagagtcgaggtacacggcatctatactgtgataaggatcgtcgtagtggtgagtgttgggttgacgttacggactacggtacggtangggtacgtacgtgggaccgtaagggtaccgaacgtccgtaccggtcacctgacgtcttaccgaccgtaaggacctacgtccggtcctccccgtaggcctcccgtcgcgttacccgaggtacgcccgtaccgttcccggtaggggcccctaacggaccgggtaccgcccccggtgggtcgtacccggg

SEQ ID NO: 156865 - DNA, 557 bp, Homo sapiens
  misc_feature: GYAE6OF01EUUZL.35.15.B04.1.454.CMB.1.raw
  modified_base (218)..(218): a, c, t, g, unknown or other
  misc_feature (218)..(218): n is a, c, g, or t
  modified_base (445)..(445): a, c, t, g, unknown or other
  misc_feature (445)..(445): n is a, c, g, or t
tcagtacagatcgtcacgaccggtgctcgattttagacagtatatatccgcgggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcactgctctgganatgcattcgaccaaagcaatatacttatgtaccagcagaagtcaggccaggcccctgtattcgatcggatagtataaacgacactagagtacgcctacagggtactccctgacgcgtattctctaggcttacgacgtctacgacggaacaacgtagtcacgtttacgaccagtcaagtcggacgtaccaggcaagaggtacgaggtctaggatttacgtattacgtntaatcgagacgtacgaacctacaaacaactacgtaccgtgtttggacgggagaccgagtcgtacggccgttactaggaccgtacgacccgaaggtccgtcgcccccgtacgg

SEQ ID NO: 156866 - DNA, 713 bp, Homo sapiens
  misc_feature: GYAE6OF01BBLMP.35.15.B04.1.454.CMB.1.raw
  modified_base (156)..(156): a, c, t, g, unknown or other
  misc_feature (156)..(156): n is a, c, g, or t
tcagtacagatcgtcacgaccggtgctcgatttagacagtatatatccgcgggggtgggtccaggaggcagaactctgggtgtctcaccatggcctggatccctctacttctccccctcctcactctctgcacaggctctgaggcctcctatgganctgacacacgacccacccgtcggtgtaccgagtccgtaccccgaggacgacgacggccgaaggactccacctggcctacgtaggagtaagttaagggttagggggaataaagtgtgtacgttgtagtaggtatcgagacgacggaacgcgtacgccgtacgtcccgtgtagttcgtacatcgtatacgaagataggaccaaggcccggtacctacgacgggtaccctcgtaggacgtaccgtacgttccgtaacgtcggacctccgtaccgtacgaaccggtacgaacctaacgtaaccggttacgtaacgtttaccgaaactactaccggtaggtacgggtaccgtaccggaaggacgaaacggaacgaggtaacgggtatacggttaagtttacctacggtaactagtaaccgactaacgacgtaaccaacctaaccggaacttaaacggtcgttaccggtagggttacgaccgggtaacggacgtacgacgtacggtaccgtacggacccgtagacccgtaaccggcgtaacccgcccgtcccgttcgtacccg

SEQ ID NO: 156867 - DNA, 701 bp, Homo sapiens
  misc_feature: GYAE6OF01BUAVP.35.15.B04.1.454.CMB.1.raw
  modified_base (177)..(177): a, c, t, g, unknown or other
  misc_feature (177)..(177): n is a, c, g, or t
  modified_base (313)..(313): a, c, t, g, unknown or other
  misc_feature (313)..(313): n is a, c, g, or t
tcagtacagatcgtcacgaccggtgctcgatttagacagtatatatccgcgggggtgggtccaggaggcagaactctgggtgtctcaccatggcctggatccctctacttcctcccctcctcactctctgcacaggctctgaggcctcctatgagctgacacacgccacccgtcggngtcagtcgtccccaggacaggacgcaggactcacctgctgtaggagagtgctattcgaccaaagcaaatattaacttagtcggtacagacaagaagtcaggcctagcccgtgtattgagtgtatagtaataaaganacgtagagagcccagaggtactccgtagacgcgtattcgtcgtacgcctacaggtcctacggaacggacaacgacgtcgtacgttacgacaacttcgaggtacggtaagtaccgaaggacgaaacggaaggaacgaagggtacttaaggaagttttaactacgtagtacgaaacgttacgaagacccgaaagaaccctaaacccgtaaaacaaccggttttaacgttacccccgggttaggtttaccgggggaaacggggaaaccggtaacccgggtaaaccggtacgttaacccgggttaaccccggttacccggtaccggggttaaacgtaaccccgggacccgaaaccggggtccccttacccggtaccccccggtttaaccggg

SEQ ID NO: 156868 - DNA, 700 bp, Homo sapiens
  misc_feature: GYAE6OF01DOQIE.35.15.B04.1.454.CMB.1.raw
  modified_base (288)..(288): a, c, t, g, unknown or other
  misc_feature (288)..(288): n is a, c, g, or t
  modified_base (297)..(297): a, c, t, g, unknown or other
  misc_feature (297)..(297): n is a, c, g, or t
  modified_base (349)..(349): a, c, t, g, unknown or other
  misc_feature (349)..(349): n is a, c, g, or t
tcagtacagatcgtcacgaccggtgctcgatttagacagtatatatccgtgtcaggtgcagctggtggagtctgggggaggcttggtcaagcctggagggtccctgagactgtcttgtgcagcctctggattcaccttcagagactatttcatgacctggatccgcagactccgagggaaggctggagtgggtctcacacatcagcagtactggacaactcccatcgtaactacgcagtactctgtgaaggccattcacgtatttttaggacaacgacgtaaggttcnctgtatcgngacaatcgacacgcctagagagtacgacggacacggcctatactaattacgngtcgacgaagtagttcgtagttaggtcggtggtaccgtaggtttcgttaggtaccgttacggttaccgtaacggtaacggttacgtcgggtaccgttcggtaccggggtaccgtaaacggggtaacccgacgggttaccgaacccggttcctccccgtaacgtacgtccccgtttacccgaacccggtaaccgggtccctaacggttcccgggtttcccccttacccccggtggtacccccggtacccgtcggcccttcccggacgggtaccgcccggtacccgtaccgggtccgggggtacctacccggacgggtccccgggttacccggtcgggtaccttaccccgggg

SEQ ID NO: 156869 - DNA, 784 bp, Homo sapiens
  misc_feature: GYAE6OF01AHS4I.35.15.B04.1.454.CMB.1.raw
  modified_base (243)..(243): a, c, t, g, unknown or other
  misc_feature (243)..(243): n is a, c, g, or t
tcagtacagatcgtcacgaccggtgctcgatttagacagtatatatccgcgggggtgggtccaggaggcagaactctgggtgtctcaccatggcctggactccctctacttcctccccctcctcactctctgcacaggctctggacggccctcctatgagctgaccacacgcccacccgtcggtgtcacgtcgtccccgaggaccaggaccggccaggactccaccgtgcctcgtagggagtntcggctacttacggaaccaaaacgactaaagtttaacttaacgttttacggttacggtaaccgtagacgaaacggtaacggtacgaccgggacccgaccgggttccccgttaggttacgttggatttagacgttagtaaacgtaaacgacgacgtaggacggaccgtcccgtacggacgggtactcccggtagacgtcgtacttccgtacgtcggtacctaccgacgtccgtacggacgaaacctaacgtaccggtacgtaccgttaaccgtactacgtacggcggtacggaccggtacggacggacggaaacgggaagacgggtcgtacgttacgtttacttacggttactcgtaactaacgtctaacgacctaacgaacccgaaaccttacgttaacgttacccgggtcgggtttacggcggggttaaccgggaacggtaacccgacgggtccggtaacccggttcgttaacccggtacggtaccccggaaccggtacccgggtacccgccccgggtttaccccgccccggtttaccgg

SEQ ID NO: 156870 - DNA, 718 bp, Homo sapiens
  misc_feature: GYAE6OF01A6QTU.35.15.B04.1.454.CMB.1.raw
  modified_base (87)..(87): a, c, t, g, unknown or other
  misc_feature (87)..(87): n is a, c, g, or t
  modified_base (229)..(229): a, c, t, g, unknown or other
  misc_feature (229)..(229): n is a, c, g, or t
tcagtacagatcgtcacgaccggtgctcgatttagacagtatatatccgcggggggtgggtccaggaggcagaactctgggtgtctnaccatggcctggatccctctacttctcccctcctcactctctgcacaggctctgaggcctcctatgagctgacacagtcccacccgtcggtgtccagtcgtccccaggacgagaccggccaggactccacctgctcgtgganatgcattcgaccaagctaatatacttagtagaccagacagtagtcgacgccgacgcccttagtattgatgattagtaactaagaccacgtaggaacggacgccctaggacggtactcccgagacgacgttacttcgtcgtacggtcctaccgcgtacgacggtacgggaacacgtacgtacgtacgttcgactatacgagtaggacgtacgaggacgtaacggaacggaacgtcggacgttaagtacgtttaacgttaacttaggaaaccttacgaaccgtaaggaaccgtaaccgtaaacccaaaccggtaaacctaaaccgggttaaccgttacccgggtttagggttaaccggggacccgggtaaacgggtacccggtaaccgggtaccggtaacccgggttaccccggtacggtaaccggttacccggaccgggttaaccccggaacgggttccccccgtacccgggtcccccggttaaccccgg

SEQ ID NO: 156871 - DNA, 680 bp, Homo sapiens
  misc_feature: GYAE6OF01D409C.35.15.B04.1.454.CMB.1.raw
tcagtacagatcgtcacgaccggtgctcgatttagacagtatatatccgcgggggtgggtccaggaggcagaactctgggtgtctcaccatggcctggatccctctacttctccccctctcactctctgcacaggctctgaggcctcctatgagctgacacacgccaccctggtgtcagtcgtccccgaggacacggacggccaggactcacctgactatggagtatgactagttcgacctaaagctaatactacttagttagtaccagacaagaagtcacggccacggccctgtattgatagattagtaataaagcaagtgaggaccggaccctagacgggtacctccgtagaggacctagttccgtcgtcgggcctaccgagtaccgtaccggaacgggaactaaacggtacgtacgttaaccggtttacgaaaccgtactacggtaagtacgggaacgtaccgaacggaacgaaggaaacggacggacggtactagtaactttactaacgtcgtaactaacgtcgaagaccgaacgtaccaaaccgaaacgttaagtacccggttaccggttaggttacgggaccgggtaacggaacccggtacggtaccgtaccggtaacccggtccgtaacggaccgtaacgaccccgaaggtccccacccggtccccgtacccg

SEQ ID NO: 156872 - DNA, 630 bp, Homo sapiens
  misc_feature: GYAE6OF01AGNF3.35.15.B04.1.454.CMB.1.raw
  modified_base (304)..(304): a, c, t, g, unknown or other
  misc_feature (304)..(304): n is a, c, g, or t
  modified_base (373)..(373): a, c, t, g, unknown or other
  misc_feature (373)..(373): n is a, c, g, or t
  modified_base (379)..(379): a, c, t, g, unknown or other
  misc_feature (379)..(379): n is a, c, g, or t
tcagtacagatcgtcacgaccggtgctcgatttagacagtatatatccgtgtcaggtgcagctggtggagtcgtgggggaggcttggtcaagcctggagggtccctgagactgtcttgtgcagcctctggattcaccttcagagacttatttcatgacctggactccgcagactccgaggggaaggctgggagtgggtctcacacatcagcagtactggacaactcccatcgtactacgcagactctgtaggaacgggccgattccacctagtttttacgggactaacgccgtaaaggggttcncgtagtatccgtagacaaatacgaacagccgtagagagtacggaggaccacggcatcttatacgtagtnacaagngttctacggtagtggtaggctaggtttggtcggcgtacggtactacggtacggtagtcgggacgttcgggtacggggaccaaggggaccctaagggtcccaccgtctacctacgacgtcctccgaaccgacggtccccgtagtcccgttcccttaccccgcgggcccgtccctcgcccgtaccggacgaccgtccgaccgttcgggcgggaccaccgggacggtccccggaccgtcggggtctacccgggg

SEQ ID NO: 156873 - DNA, 724 bp, Homo sapiens
  misc_feature: GYAE6OF01EMS4A.35.15.B04.1.454.CMB.1.raw
tcagtacagatcgtcacgaccggtgctcgatttagacagtatatatccgcgggggtgggtccaggaggcagaactctgggtgtctcaccatggcctggatccctctacttctcccctcctcactctctgcacaggctctgaggcctcctatgagctgacacacgcccacccgtcggtagtccagtcgtcccgaggacaggacggccaggatccgaccgtgccttcgtgggacgtatgactagttacgaccgtaaagactaaattagttacctttaagttacggtaccaagacgaacgtaagtaccgaacggaccgaccggtccccgtagttattaggatacgtagttacggtaataaaacgtctacgtaggaaggtacggcccgtacgtacgggctcccggtagtacgacgtagttccgtcgtacggtcctacgtacggtacctaacggtaacgggaacctaaacggtaaccgttaccgtaccggtttacgaacctacggttaacgacgggttacggtacggtacgaaacggtacaaggaacggacgtacgtgtaacgtatttaacttaggtacgtactagtacgacgaaccgtacgaacctaaccaaacgttacgttaccggtaccggttacgtttacggggacgtaaccggacgtacgttacggtaccggtaccgtacgttacgaccgaccgtaaccgacggtccgtccggccccgttacgg

SEQ ID NO: 156874 - DNA, 685 bp, Homo sapiens
  misc_feature: GYAE6OF01EXBCP.35.15.B04.1.454.CMB.1.raw
  modified_base (216)..(216): a, c, t, g, unknown or other
  misc_feature (216)..(216): n is a, c, g, or t
tcagtacagatcgtcacgaccggtgctcgatttagacagtatatatccgcgggggggtccaggaggcagaactctgggtgtctcaccatggcctggatccctctacttctcccctctcactctctgacacaggctactgaggcctctatgagctgacacagccaccctggtgtcagtcgtccccaggacaggacgccaggatcacctgctctgganatgaccattcgaccaagctaattactacttagttacggtaccaggtcgaaggtaacgtacgacgggcctacggcccccttaggtattcggataggtattaggttaaataaacggtactacgtacggaaggtaccggtacccctacggaaacgggtacttccccggtaggaccgtccgtaactttccgtacggcggtacctccgtaagccgttacggacgggtaaccaacgtacgttacgtaacgttccgaactactaccggtaaggtcgggaacgttccggaaggtaccgaagacggacggagggtacgttacgtaatttacgtattacggtacacgtacgacgacgtacgaacctaaccgtaagttacgttacggtccgttagggtacggacgggacggtaccacggtccttacggacccgtagtacgacgtaccgaccggtaacgtctcccggaccttcgggtaacc

SEQ ID NO: 156875 - DNA, 771 bp, Homo sapiens
  misc_feature: GYAE6OF01CEMF2.35.15.B04.1.454.CMB.1.raw
  modified_base (104)..(104): a, c, t, g, unknown or other
  misc_feature (104)..(104): n is a, c, g, or t
  modified_base (160)..(160): a, c, t, g, unknown or other
  misc_feature (160)..(160): n is a, c, g, or t
tcagtacagatcgtcacgaccggtgctcgatttagacagtatatatccgcggggggggtccaggaggcagaactctgggtgtctcaccatggcctggatccctntacttcctcccctctcactctctgcacaggctctgaggcctctatgagctgacacncgaccacccgtcgggtgtaccagttccgtaccccgaaggacgacggaccggccaagggacttccaccgttgccttcgtagggagtagtgacctagttaccggaccaaagctaaattacttactttagttacggtacctagacgtaaggaacgtcgacggtaccgacggtccccttaggttacttacggtataggtattacggtaataaacgacgacgtacggacggtaccggtcccgtaggacgggtccttaccgaggacgtcgttacttccgtcgtcggtacctcgacgtaccgacgaacggactaacgtacggtaccgtacgttcgaacctacgtccggtaggtacgggtaaccgtccggaaggtacgaacggaacgtacgggacgtacgttacgttaatttacgttacgtactaacgtaagtacgaacgtaaccaaccggaaccaaaccgtaaacgtaccggtttaccggttacccggttagggttaccggggaccggggtacggtaaccggtacggtccggtaaacgggttcccgttcggtacgtacccgggaaccgtacccgggtacctaaccccgggtcccgttacccccgggtcgtacccccgg

SEQ ID NO: 156876 - DNA, 758 bp, Homo sapiens
  misc_feature: GYAE6OF01C5LPB.35.15.B04.1.454.CMB.1.raw
  modified_base (227)..(227): a, c, t, g, unknown or other
  misc_feature (227)..(227): n is a, c, g, or t
tcagtacagatcgtcacgaccggtgctcgatttagacagtatatatccgcgggggtgggtccaggaggcagaactctgggtgtctcaccatggcctggatccctctacttctccccctcctcactctctgcacaggctctgaggcctcctatgagctgacacacgcccaccctcggtgtcagtcgtccccgaggacagacggccaggactccaccgtgctcgtgganagtgctatcgaccaaagacaattattacttagttcggtaaccagacaagaacgtccgaacggacccgaccggtcccctagttacttagaatagtaatagtaaagtaaaacgaccagtaggacggaccgtcccgtagacggtacctcccgtagaacgtcgtattccgtcgtcgtcctacgacgtccgtacggaacgggaaactaacgtacggttaccgtacgtttacgaacccgtagtaccgggtaaggtacggtaaccggtacccgtaagggaaccgaaacgggaacggtaccgggaagggttccttaaggtaacttttagttacgtagtaacctaagtaccgaacggaacccgtaaccgaaaccaaacccgtaaaacgttaacgttacccgggttaccccgtttaggggttaccggggaccgggaaccgggtaacccgtaacgtacccggtaccggttacccgtacggttaccggaccctacccgggtaacccgtacggtaccccggtccccggttcccccgttaaccgg

SEQ ID NO: 156877 - DNA, 732 bp, Homo sapiens
  misc_feature: GYAE6OF01A1KOC.35.15.B04.1.454.CMB.1.raw
tcagtacagatcgtcacgaccggtgctcgatttagacagtatatatccgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaagcaatatacttattggtaccagcagaagtcaggccaggcccctgtattgatgatgtataaacgacacgtgagagggccctacgaggtactcccgtgacgtcgtacttctcgtcggctccgtagcctacgacgggaacaacgtacgtccgtaacggtttacgacctaacttacgagggttcgggtaacgtacccggaagggaccgaaggaaaacgggaccgggtaacgggtcgttaaccggttaagttttaaccgttttaaccgttaggtaacctaaacgttaccaacgggaccaacgggtaacccctaaacccaaacgttaaacgtttacccgggttaccccggtttagggtttaccggggtaaccggggtaaccggggtaaacccgaacgggttcccggtaacccgggttacccgggttacccgttacggggtaccccgtaaaccggtaccccggaaacgggtccccgttacccgggttcccccccggttaacccggg

SEQ ID NO: 156878 - DNA, 668 bp, Homo sapiens
  misc_feature: GYAE6OF01DFMTS.35.15.B04.1.454.CMB.1.raw
  modified_base (157)..(157): a, c, t, g, unknown or other
  misc_feature (157)..(157): n is a, c, g, or t
  modified_base (181)..(181): a, c, t, g, unknown or other
  misc_feature (181)..(181): n is a, c, g, or t
  modified_base (218)..(218): a, c, t, g, unknown or other
  misc_feature (218)..(218): n is a, c, g, or t
  modified_base (231)..(231): a, c, t, g, unknown or other
  misc_feature (231)..(231): n is a, c, g, or t
  modified_base (297)..(297): a, c, t, g, unknown or other
  misc_feature (297)..(297): n is a, c, g, or t
  modified_base (339)..(339): a, c, t, g, unknown or other
  misc_feature (339)..(339): n is a, c, g, or t
  modified_base (428)..(428): a, c, t, g, unknown or other
  misc_feature (428)..(428): n is a, c, g, or t
  modified_base (494)..(494): a, c, t, g, unknown or other
  misc_feature (494)..(494): n is a, c, g, or t
tcagtacagatcgtcacgaccggtgctcgatttagacagtatatatccgcgggggtgggtccaggaggcagaactcgtgggtgtctcaccatggcctggatccctctacttcctcccctcctcactctctgcacgaggctctgacggcctctatganctgaccacacgcctacccgtggtntcagttcgcccaggaccaggacgccaggtactccacngtctcgtaggaangtgacctatcgaccaaagctaattagttacttagtcgtaacagacgaaagagtaccaaccggtccncggtacccttgtagttacgagtagagtttacgaaaacgaaanacctaggtagacggacgacccgttacggaggtccttccgaggaccgtacttcttcgccgttggcctcgacgtcgaacgacgacgttaanacggttctacggacaacgtacgacgtacgacggtacgccgaagacggtaagaacggtacggacgtntaagttactttacgtaactggttaacacgttcgaacgcaaaccgaactaaaccgtaacgtaagtttaccggcccggttttagggacggtaccgggaacgtaacggtccgacggttaaccggcgttaaccgtaggacccaccggtacgaaccgcccggtacgccccgttaaccgg

SEQ ID NO: 156879 - DNA, 762 bp, Homo sapiens
  misc_feature: GYAE6OF01EU5WT.35.15.B04.1.454.CMB.1.raw
tcagtacagatcgtcacgaccggtgctcgatttagacagtatatatccgcgggggtgggtccaggaggcagaactcgtgggtgtctcaccatcggcctggactcctctacttcctccctcctcactctctcgacacgacgctcgtggacggtcctcctatgacgtctacgacacgacgtccacccgtcggtctctacgtaccgtcccaggaacacgacggcgacggactccactcgctcgtagacgatcggcacgttacgactaacgactaacttaactttactttaacgttacggtacgacgacgaagtaacgtacgacggaccgacgtaccgttcgttagttacgtacgtagtaagtaacggttaacgtaaacgtacgtaacgtacggtaacggtaaccgtaccgtacggtacggtacgtacgtacggtacggttacgttacgtttcgttcgtcgtacctcgtacgcggaaaaaaaaacggtcgtaacgtacgtacgtacgtaccgtacgtacgtacggtacgacggtacgacggtacgagaacgagtacgacgtacgttagtacttacgttactacgtacgtaacgtcgtaacgtaacgaacctaaccgaacgttaaccgtaaacggtttacggttacccgggttacgggtacgggaccggtaaccggtaccgtacggtaccgtacggtacccggtaccggtacgtaccgtaaccgtaacccgtacggttacccgttcccggccccgtacggttacccg

SEQ ID NO: 156880 - DNA, 741 bp, Homo sapiens
  misc_feature: GYAE6OF01C41QV.35.15.B04.1.454.CMB.1.raw
tcagtacagatcgtcacgaccggtgctcgatttagacagtatatatccgcggggggggtccaggaggcagaactctgggtgtctcaccatggcctggatccctctacttcctccccctctcactctctgcacaggctctggacggtccctcctatgacgctaggaccacgacgccctacccgttcgggtgtacacggtccgtacccccgagggaccacggaccggacctaaggactaccaccgtggctcgtagggacatcgactagtacgaaccaaagctaaattacttacttagtacgtaccatcgaagatacgacggaccgtaacggaccttagtagttgatagtaacttaagtaagaaacgacaacggtggaacggccggtacctaggaacggtcctacccgtaggtaggtaaccttgtttaccgtccggttaggtccctaccacggaccgtaacggaaccggaactaaacggtgtaaccggtacgtacggtacctaagtacggtacgggtaggaccgtaacggagacgaaggaacgaccggagtcgtacgtaacgttacttaagtacgactagacgactaaccgaacaaccaacgtaacttacggttacggttaccgttacgggtttacgggaacgggaaccggtagaacccgtcggtaacccggtccggtaccggtacggaccgtaacgggaccctaaccggtcccgaccccggtaccccggttcgtaaaccccgg

SEQ ID NO: 156881 - DNA, 619 bp, Homo sapiens
  misc_feature: GYAE6OF01A93EL.35.15.B04.1.454.CMB.1.raw
  modified_base (213)..(213): a, c, t, g, unknown or other
  misc_feature (213)..(213): n is a, c, g, or t
  modified_base (376)..(376): a, c, t, g, unknown or other
  misc_feature (376)..(376): n is a, c, g, or t
tcagtacagatcgtcacgaccggtgctcgatttagacagtatatatccgtgtcaggtgcagctggtggagtctgggggaggcttggtcaagcctggagggtccctgagactgtcttgtgcagcctctggattcaccttcagagactatttcatcgacctggatccgccagactccgagggaggactggagtgggtctcacacatcagcagtcnggcaactccatgtactacgcagactcgtgtggaaggccgtactactaccgtagtttttagggaccaacgaccgtaagggttcgcttaggtctcgtagaacaagttagaaacgacgtaccgtggaagtaggtacggaacggacgaccggtcctaatctattacngtacgacgaagtacgtcgtagtacggttggtcggtgttacggttggttcggtacgttacggtacgtaacgggtcgttagtggtacggtcggtacggggaccgaaggtaaccgacgggtactccgtcctcctcgacgccgttcacccggtacggtccgacgttccggtccttcccgcggccgccctgacctcggacgtcgcctcccgacggcggacgccgtacggccgtcggtcggtcgtccgg

SEQ ID NO: 156882 - DNA, 681 bp, Homo sapiens
  misc_feature: GYAE6OF01DMGB0.35.15.B04.1.454.CMB.1.raw
  modified_base (255)..(255): a, c, t, g, unknown or other
  misc_feature (255)..(255): n is a, c, g, or t
  modified_base (390)..(390): a, c, t, g, unknown or other
  misc_feature (390)..(390): n is a, c, g, or t
tcagtacagatcgtcacgaccggtgctcgatttagacagtatatatccgcggggctggggagcctagctgtgctgtgggtccaggaggcagaactctgggtgtctcaccatggccctggactccctctacttcctccccctcctcactcctctgcacaggctctgaggcctcctatgagctacgactacacgcccacccgtggtgtacagttcgccccaggacacgaccgccaggactccgacctgctcgtggantgctatcgaaccaagactaatacttacttaagttacggaaccagtaccgaaagtaacgtcgaacggacccgacggtcccctagtattgatagaatagtaaactaagctagtgagacgccctagacgtactcgagngcgtatcgtgtcgctcgtacgctacgaaggtacaaacgagttccaacgttaccgaactaacgtcggtaacggtgaccgtccggaacggacagggaacggaacgtacggtacgtagttaacgtttaagttcgttaacgtacgtaaagttccgaaccggaaaccaaacccttaaaccggaaaaccctaccttaaacgggttccccgggtttaaccggtttaacgggttaccggggaacccgggttaaacgggacccgtttaaaaacggccggttaaccccgggtaaacccggg

SEQ ID NO: 156883 - DNA, 711 bp, Homo sapiens
  misc_feature: GYAE6OF01BC9FP.35.15.B04.1.454.CMB.1.raw
  modified_base (220)..(220): a, c, t, g, unknown or other
  misc_feature (220)..(220): n is a, c, g, or t
  modified_base (249)..(249): a, c, t, g, unknown or other
  misc_feature (249)..(249): n is a, c, g, or t
  modified_base (309)..(309): a, c, t, g, unknown or other
  misc_feature (309)..(309): n is a, c, g, or t
tcagtacagatcgtcacgaccggtgctcgatttagacagtatatatccgtgtcaggtgcagctggtggagtctgggggaggcttggtcaagcctggagggtccctgagactgtcttgtgcagcctctggattcaccttcagagactatttcatgacctggatcccgccagacctccagggtaagggactgggagtcgggtctcacgacatcagcagtacnggcaactcccatgtacctacgcagactcngtgaacggccgattccaactagttttacggacaaccgtccgtaagggtcgctgtacttcncgactaaaactgaacgacgtccgtgtaaggacggtacggaacggacgtaccggacctacgtcttaactttacgtgtacgtagaacggtcgttcgtagttagggtggtacggtgttcggttaggttcggacgttaccggtacgttacggacggttagtacgggtacgtacggtcggggaccgtaacgggtaacccgacggttaccgtacccgttcgtcccgtacgtacgtacccttaccccgaaccggaaccggggtcccctaaccggttccccgttcccgttaccccccggtcgggtccccgtaccccgttcgcccgttaccggcggttaacccgcccgtacccggtccggtcgggggaccctacgggtaaccggcccgggtcccggtcgggtcgtcccggg

SEQ ID NO: 156884 - DNA, 700 bp, Homo sapiens
  misc_feature: GYAE6OF01EW1Q1.35.15.B04.1.454.CMB.1.raw
  modified_base (561)..(561): a, c, t, g, unknown or other
  misc_feature (561)..(561): n is a, c, g, or t
  modified_base (622)..(622): a, c, t, g, unknown or other
  misc_feature (622)..(622): n is a, c, g, or t
tcagtacagatcgtcacgaccggtgctcgatttagacagtatatatccgtgtcaggtgcagctggtggagtctggggggaggcttgggtcaagcctggagggtccctgagactgtcttgtgcagcctctggattcaccttcagagacttatttcatgacctgggactccgccagactccgaggggaagggctgggaggtgggtctcacacatcagcagtactggacaactcccatacgtactacgcacgactcgtgtaggaagggcctattccaaccgttagttttaacgggacctaacggaccgtaacggggttcgtcgttaggtacttcgtagaccaaacgtagtaaacgacgtcgtaggtacggacgtacgggacggaaccgaccggtacctatacttaacgttacgtcggtagacgtaaggtacgtcgttaggtaggtggggtcggtcgttaggtttgggttcggtacggttaccggtacgtaccggtaggttagtcggacggttcggtacggggaccgtaacgggacccgtacggtaccgccggtaccttccgacncgtcccttacgacccggacggtcctacgtcccgttccctcccggtcgtcccgtcccggtcncccgtacggacggtacccgctccccggtcgggcgggacccgtcggcccgggtcccggccgggtccggtcggtcccggg

SEQ ID NO: 156885 - DNA, 666 bp, Homo sapiens
  misc_feature: GYAE6OF01B8RSI.35.15.B04.1.454.CMB.1.raw
  modified_base (477)..(477): a, c, t, g, unknown or other
  misc_feature (477)..(477): n is a, c, g, or t
  modified_base (501)..(501): a, c, t, g, unknown or other
  misc_feature (501)..(501): n is a, c, g, or t
tcagtacagatcgtcacgaccggtgctcgatttagacagtatatatccgcgggggtgggtccaggaggcagaactctgggtgtctcaccatggcctggatccctctacttcctccccctcctcactctctgcacaggctctgaggcctcctatgagctgacacacgcccacccgtcggtgtcaggtcgtccccgaggacgacggaccggccgaggactaccacctgctacgtggagatgctagttcgaaccaagacctaaattaacttaacttagttcgtaaccgagacaagaacgtccgacggaccgtaccggtccctagtatacgagtgtaattagtaactaaacgactacgtcggaacgaccggtacccgtaggaacgggtactacccgtaggacggtactattccgtcgcggtacctacgacgtcgtacgggacggaaccaacgtcgtacgtacgttcgaactagacgtaggnggtacgtcgaaggataaggaacgngagtacgtagtaagttatacgttcgtacgtaatcgacgtaccgaacgtaacccaaagtaacgtaacgtcggttaccgtgggttacggacggaccggtacgaacggtaccgtaccggtaacgtcggtagaccgaccgcccgtaagcccgtcccgtcccggtaaccg

SEQ ID NO: 156886 - DNA, 904 bp, Homo sapiens
  misc_feature: GYAE6OF01BMDKJ.35.15.B04.1.454.CMB.1.raw
tcagtacagatcgtcacgaccggtgctcgatttagacagtatatatccgcgggggggtccaggaggcagaactctgggtgtctcaccatggcctggatccctctacttcctccccctcctcactctctgcacaggctctggacggtccttacctagtgacgtctacgacacgaccgccctacccgttcggttcgtcgtacgtcccgtaccccgaggacgaccggacccggcgtaaggacctccgaccgttcgccgttacgtaggtacgtacgtcgtaccgtagttaaccggaaccaaaacgacttaaattacgtttaacgttttaccggttacggtaaccaacgtaacgtaacggtaacggtaccgaaccggcccgtaacccggtccccgttaaggttacgttagtagttacggtaagtttaaggttaaaaccgtaaacgtaccgtaacggttaagggtaccggaaccccgggtacccgtacgggtaacggtacccgttacccggtaggacggttcgttaaccgtttcgtaccgggttaccgtcccggtaccgtaacggtcccggtaaacggaacgtaaaccgtagtaccgttacccgtacgttaccgtaacgtacgcggttaaggtcggtaccgaacgggacggaacgtaacgggacggtacggtacgtagtttaacgtaagtttacgaacgttagaacctaacgtacaaccggaacaaaccgacctaaaccggttaaaacttacccgggtttacccggtaccggggttttaagggaccgggaaccgggttaccggaaaccggttaccgtcggggtacccgttaaccggttcccggtaaggaacccccgtacccggaccgttacccgggtacccttccccccgggtcgtttaaccgtcccccg

SEQ ID NO: 156887 - DNA, 738 bp, Homo sapiens
  misc_feature: GYAE6OF01E0MSW.35.15.B04.1.454.CMB.1.raw
  modified_base (184)..(184): a, c, t, g, unknown or other
  misc_feature (184)..(184): n is a, c, g, or t
tcagtacagatcgtcacgaccggtgctcgatttagacagtatatatccgcgggggggtccaggaggcagaactctgggtgtctcaccatggcctggatccctctaccttcctcccccctctcactctctgcacgaggctcgtgacggtcctcctatgacgctgacacacgccctacccgtggtntcgacgtccgtaccccgaggaccacggaccggacccgaggtactcccgtaccgtgtaccttcggtaggacgtattccgacgttacgttaccggaaaccgtaaagtacctaatttacgtttaaccgtttaggttaccgaacgtagacgaagtaaccgtcgaccggccgtacccggtccgtagtttagtacgtgtagtacgtaagttaaagaacacgtacgtaggacgaccgtccgtacggtacggtacctaccgagacgtcgttactccgtgcgtaccctacgcgtaccggacgaacgaccgtaacgtcgtactaccggttacaccgtgtacggtaaggtccggtaaccgccggtaggaacgaacggtaggaacgcgtagttattacgtttaacgtctagtaaccgtacgactaccgacaaaccaccgtaaaccgttaatacccgggttatacccgggttagggtccggaccgggtaaacgcgtacggtccgtacgtaccgttcggacgtcgaacccggtaccggcgtaccccctccgggtcccctggtcccccg

SEQ ID NO: 156888 - DNA, 894 bp, Homo sapiens
  misc_feature: GYAE6OF01ANQUS.35.15.B04.1.454.CMB.1.raw
  modified_base (873)..(873): a, c, t, g, unknown or other
  misc_feature (873)..(873): n is a, c, g, or t
tcagtacagatcgtcacgaccggtgctcgatttagacagtatatatccgtgtcaggtgcagctggtggagtcgtgggggaggcttggtcaagcctggagggtccctgagtactgtcttgtgcagcctgtggattccaccttcagatacttatttcatgacctgactccgcagcctaccgagggaaggtctgggagtcggtccacacacgactcgaagcctaaggtaccgtaggacctaaacgtcccgtaattcgtaacgtaccgccgtaagtaccgtcgtggtacggaacgggtaccgttacgttaccgtactttaaaggtttttaaccgggaaacctaacggtacccggttaaacggggttccgtacgttagttaaccttcggtacgtaaacgtaacgtaccgttaaacgcggtaccgttaagggaacgtaacgggtaccggaacggaccgtaaccggactaacttacgtacgtttacgtcgggtaacacgtaagttacggtagtttcgggtaaggttcgggtagttacgggtaggtttacggtacggttaaccgttacccgggttaacggtaacgggttaggttaacggtaccggggttccggttaccggggtacggggtaaaccgtacgggtaaacccggtacggttcccggtaacgtcccgtttaccgtaccgtaccggtttacccgtacccgggtaacgtacccggtaccgtaaccggtttcccccgggtccctttccccgggaccgttccccggtaccccggttccggtacccggttacggaccccgggaacccgttcccgggtcccggttaaccggggtacccgggacccggtacccgggttacgtcccccggggtttaacccggnggggtacccccgttcccgggg

SEQ ID NO: 156889 - DNA, 791 bp, Homo sapiens
  misc_feature: GYAE6OF01AEQJJ.35.15.B04.1.454.CMB.1.raw
tcagtacagatcgtcacgaccggtgctcgatttagacagtatatatccgcggggcctggggagcctagctgtgctgtgggtccaggaggcagaactctgggtgtctcaccatggcctggatccctctacttctcccctcctcacttctctgcacaggctctgaggcctcctatcgagctgacacacgcccaccctcggtctcgacgtccgtccccgaggaccacggtacggccaggtactccaccgtcgaccgttcgtagggagactcggcagttcgaccaaagctaaattagtactttagtggaccagcaaggtaacgtcacggccgaaggtaccctggtaacttgatgtactagtaaactaaacgactaaccgtaggacgtacgtccctacggaagggtactcccgtaggacgtcgtacgtttccgtacgttccggacctacccgtacgtaccgtaccggtaaccggggtaacctaaccggtaccggttaaccgttaaccggttacgtaaacccggtacgttacggtaacggtaacgggacgttacccggaacgggaaccgtaacgggaaaggtaaccgggtaacggtacggtttaacgtaacgttttaaacgttaccggttaccggttaacgtaacgtacttaaaccggtacgaaaccgtaaaacccgtaaacccttaaaaccggtaacgttaccgggtttaccccgggttaagggttttaccggggaacccgggggttaacgggaaaccccgggacggttacccgggttaaccggttaaccccgggg

SEQ ID NO: 156890 - DNA, 704 bp, Homo sapiens
  misc_feature: GYAE6OF01B8J5V.35.15.B04.1.454.CMB.1.raw
  modified_base (681)..(681): a, c, t, g, unknown or other
  misc_feature (681)..(681): n is a, c, g, or t
tcagtacagatcgtcacgaccggtgctcgatttagacagtatatatccgcgggggtgggtccaggaggcagaactctgggtgtctcaccatggcctggatccctctacttctccccctcctcactctctgcacaggctctgacggcctcctatgagctgacacacgcccacccgttggtcgtcaagtccgtaccccgaggacaggacggacgaaggtacttacccgtgctcgtgggagtatcggctattcgaccaaaagtccaaattattaacttaagtttcggtaaccagacgaagaagtccgacggccaacggccccttgtaattagacgtagtattagtaataaagactaacgtgacgacggtccctacgagggtactccgtagacgtcgtaacttcgtcgtacggacctaccgagtaccgtacggaacgggaactaaccgtacggttcctaacggttacaccgtatacgaggtacggtacgtaaccggaggtaacgaaggtaaacggacggtacgtacgtaagtaagtttaactacgttagtaactaagacgtaacgacgtaacgaccgtaaacctaagaacgtaccgtaccgggttaggttacgggaacgggtacgaaccgaacggtccgtacggttacccggtcgaccgttacgaaccgttacccgcggtacccnccccggttcccgccggttacccg

SEQ ID NO: 156891 - DNA, 717 bp, Homo sapiens
  misc_feature: GYAE6OF01ENNFN.35.15.B04.1.454.CMB.1.raw
  modified_base (231)..(231): a, c, t, g, unknown or other
  misc_feature (231)..(231): n is a, c, g, or t
  modified_base (566)..(566): a, c, t, g, unknown or other
  misc_feature (566)..(566): n is a, c, g, or t
  modified_base (638)..(638): a, c, t, g, unknown or other
  misc_feature (638)..(638): n is a, c, g, or t
  modified_base (648)..(648): a, c, t, g, unknown or other
  misc_feature (648)..(648): n is a, c, g, or t
tcagtacagatcgtcacgaccggtgctcgatttagacagtatatatccgcgggggtgggtccaggaggcagaactctgggtgtctcaccatggcctggatcctctacttctccccctctcactctctgcacaggctctggacggccttcctagtgagctagacacacgccctacccgtcggtgtcacggtctccccgaggacacgccggcaggatccacctgctgaggtanatgctatcgaccaagactaattactacttagtcgtaccagacagtacgtcacggccaccgtcctgtactgatcgtatagtaactaacgtacgtatacggacggtaccggtaccctagggtacggtacccttacccgggtaggtaaccgtacgtttacgtttcccgttacggtaccggaccttacccggacggttcccgaacgggtaacggaaaccgttacgacgttaccgttaacggtacgaccgtagtttacggaacgggttacggaccgttacggacggtaacgaagggtaacggacggtaggtcgttacttaagtttactacgttacgtaanaaccgtgaacgtaacaaccgggtaaccaacgtaacgtacgttaccggtacggtacgtacggggaccgggaanacccggtacnccggtacgtacccggttcggaccggttacccgaaccggcggtacccgtcccggtccgttcccgtaccgg

SEQ ID NO: 156892 - DNA, 764 bp, Homo sapiens
  misc_feature: GYAE6OF01CY9KD.35.15.B04.1.454.CMB.1.raw
tcagtacagatcgtcacgaccggtgctcgatttagacagtatatatccggcggggggggtccaggaggcagaactctgggtgtctcaccatggcctggatccctctacttctcccctctcactctctgcacaggctctgacggcctcctatgggacgctgacacgacgccctaccgtcggtctcgtagtccgtacccgaggacacggacggccgaggactccgacgtcgctcgagacgtagtcgactagttcgaacaaacgtactaaagttacttacgtttagtacgtaccgagacgtaaggtaacgtacgaccggtaccgtaccggtaccttagttacgttacgagttagtaacgttaacgtaaacgtaacgtacgtaacggtacgacggtaccgtaccgtacggtacggtaccgtaccggtagacgtaccgttacgttcgtcgtcgtacctacgaccgtacgtaacggtaacgaaccgtaacgtacgtaacgtacgtacgtacgtacgtacggtacggtacggacgtaaccggacggtaacgaaaggtaaccggtacggtacgtaacgttacgttaacgtttacgttacgtacgtaacctaagtacgaacgtaacctaaccgtaacgtaaccgtaacgttaacggttaccggtacggttacgggaccgggaccggtacggtaacgtacggtaccgtaccggtaccggtaccgtacgtacccgaacggtccggtaccgttcccgcccgttcccgtccgtcccg

SEQ ID NO: 156893 - DNA, 753 bp, Homo sapiens
  misc_feature: GYAE6OF01DDV2P.35.15.B04.1.454.CMB.1.raw
tcagtacagatcgtcacgaccggtgctcgatttagacagtatatatccgtgtcaggtgcagctggtggagtcgtgggggaggcttggtcaagcctggagggtccctgagactgtcttgtgcagcctctggattcaccttcagagacttattcatgacctggactccgaccacgactccgaagggaagggacgttaggaggtgggtcctacacacatcagactagtacgtcggacactcccagtacgtacctacgcctaagtaccttcgtgtaggaaacgggtcctacttacgtaaccttaaggttttaacggaacctaacggtaccggtaacggttaccgtcgttacgtacttcgtacggaacaagttacgaacgcgtaccgaggacgtagtacgaacggaccgacgtactacgttactacgttacgtagagtacgtaaggtcgtacgttaggtgggttaggtcggtacgttagttacggggttagtaccggttacggtaacgtacggtacggtaggtacgggtacggtcggtacgggacgttacgggaacgtaacgggtccctacggtcctaacctcgtaccggtacctaccccgtaacggacccgggttacctaccggttcccgttaccccgtccccggtaaccgtcccgttcccgcgttaccccgtaccggccggacccgtacccgtcccggttacgggaccgggtacctaccgggtaccggccccggtccggtcggacccgttccgggg

SEQ ID NO: 156894 - DNA, 665 bp, Homo sapiens
  misc_feature: GYAE6OF01D92V3.35.15.B04.1.454.CMB.1.raw
tcagtacagatcgtcacgaccggtgctcgatttagacagtatatatccgtgtcaggtgcagctggtggagtctgggggaggcttggtcaagcctggagggtccctgagactgtcttgtgcagcctctggattcaccttcagagactatttcatgacctggatccgcagactccgagggaaggactggagtgggtctcacacatcagcagtactggcaactcccatcgtactacgcagactctgtagaacggccgtatcacctagtttttaggacaacgcaacggttcgctgtatctgactaaagtgaacagcctagagtagtacgaggtacacggccagtctaattactgtagacgaagtagtcgtgtaaggttggtaggtacgtaggttgttacggtaccgttacggtaaccgtacggtacggttacgtgggtacgttcggtacggggacccgaaacgggtaccgaacggtaccgtacccgttcgttacccgtcgtacgtacccgttacccgaacccggtaaccgggtcccgtacgtttaccccgggttccctttcccccggtcggccccgtcccgtacgccctaccgacgggtacgacccgtacccgtcgggtccgggaccgtaaccgaccggtcccggtacccggtcgggtccgtacccggg

SEQ ID NO: 156895 - DNA, 1156 bp, Homo sapiens
  misc_feature: GYAE6OF01BTGFL.35.15.B04.1.454.CMB.1.raw
tcagtacagatcgtcacgaccggtgctcgatttagacagtatatatccgtgtcaggtgcagctggtggagtctgggggaggcttggtcaagcctggagggtccctgagactgttcttgtgcagcctctggtatcaccttcagagactatttcatcgtactggactcccgaccagactccgaagggaaggcgtggaggtcgggtctacacactactcgagcagtactggactaactccctatacgtacctacgaccgtagtacctcgttacgtacggaaccgggtacctaacgttacccgtaaccgtttaacgggttttttaaacggaaccggtaaaccccggttaaccgggttaaccggggtttaccggttaccgtttacggtttaaccttcccggttaacggttaaccgtaaaaacggtaaccggtaaaccggtaacccgggttacccgtttaaggggtaaaccggttaaaccggggttacccgggtaaaaccgggtaacccggttaacccccgggtaacccgtttaaccgtttaacccgggtttaaaccgtttttaacccggtttaacgggtaaccggtttaaaccggtaaaacgggttaccggtttaaccggtttaggggttaaacggggttttcgggggttacccgggtttaacggttttacgggggttttacggtttaccgggggttaacccgtttaaccccgggggtttaaaaccgggttaaacccggggttttaaaccccggggtttaaaggggttaacccgggggttaaacccgggtttaccgggggttaaaccgggggtaaaccccggggttaaaccgggggtaaccccggttaaacccgggttaaccccggttaacccccgggttttcccgttaacccggtaaccgttaccccgggttacccgttaacccccggtaacccgggtacccgggttaaccccccggttaccggtttacccccggtttacccccggttaccccccgggttaccggggtccccccgttacccggttaccccgggtcccgttaacccgggtaaaccggtcccgggtaaccggtaccccgggtttacccggggggtacgggtaaccccgtcggggtaaccccgttacccccgggggtacgttaccccgggtcggttaccccgg

SEQ ID NO: 156896 - DNA, 803 bp, Homo sapiens
  misc_feature: GYAE6OF01B7FHX.35.15.B04.1.454.CMB.1.raw
tcagtacagatcgtcacgaccggtgctcgatttagacagtatatatccgtgtcaggtgcagctggtggagtctggggggaggcttggtcaagcctggagggtccctgagactgtcttgtgcagcctctggattcaccttcagagacttatttcatgacctggactccgccagactccgaaggggaagggactgggaggtgggtctcacacatcagcagtactggcaactcccatcgtaactacgacagacctcgtaggtaggaacgggccgtaacttacctaaccttaagtttttaacggggaaccgaaacggtacccggtaaggggtttccgcttagtttactcgtagaacaaaacgtgaaaccgtacgacctaggaacggtaggtaccggaacgggtaaccaccgggacctacgttaccttaagtttacgtggtacgaacgtaaagtacgttcgttaggtacggttgggtcggtcggttaggttttggttacgggaccgtttaacgggtaacgttaacgggtacgggttacgtacggggtacggttcgggtacggggtaacccgtaaacggggaaccgtaaccgggttacccgaccccgggtttctcccgtaccggtacgtccccgttaacccgaacccgggtaaccgggtaccccttaccgggttccccgggttccccgttccccgtccgggccccgttcccgtcgacccgtccggaccgggtaccgtcccgtcccggtcgggtaacgggggcctaaccgggcccgggtaccccgggtcccggtcgggtcccgttccggg

SEQ ID NO: 156897 - DNA, 683 bp, Homo sapiens
  misc_feature: GYAE6OF01AJSK3.35.15.B04.1.454.CMB.1.raw
  modified_base (178)..(178): a, c, t, g, unknown or other
  misc_feature (178)..(178): n is a, c, g, or t
  modified_base (200)..(200): a, c, t, g, unknown or other
  misc_feature (200)..(200): n is a, c, g, or t
  modified_base (528)..(528): a, c, t, g, unknown or other
  misc_feature (528)..(528): n is a, c, g, or t
tcagtacagatcgtcacgaccggtgctcgatttagacagtatatatccgcggggtgggtccaggaggcagaactctgggtgtctcaccatggcctgatccctctacttctcccctctcactctctgcacaggctctgaggccctcctatcgagtctgacacagacccaccctcgggtntccacgtcgtaccccgaggacnggtaaccggccaggtactccacctgacttcgtacgagagtcgcgtacttggaccaaaagcctaatacgttaacttacgttcgtaccaggactaacgaagctacggccgaaccgccccgttagttacttgacgttgacgttagaagttaaacgactactacgaacggtaccgtaccgtggaacgtccgtaaccgtacgaacggtctaacgttcctacgtacggtcctaccgacgtcgtaacccgaggtaaccaaacggtcttacccgagttacccgaacttcaaccggtacggtacgaaaccggtgaacgacgacgaacggacgtaacngtagtacttaacggtctagaaccttagacgaactactaacgaaacctaccctaaagaacgttaccgccggtttacgtcggacggttacgaaacgtccgtacgtacggcccgttaactcggtaccacgtacggaaccccggtaacctccccgtacg

SEQ ID NO: 156898 - DNA, 811 bp, Homo sapiens
  misc_feature: GYAE6OF01B0TH2.35.15.B04.1.454.CMB.1.raw
  modified_base (83)..(83): a, c, t, g, unknown or other
  misc_feature (83)..(83): n is a, c, g, or t
  modified_base (90)..(90): a, c, t, g, unknown or other
  misc_feature (90)..(90): n is a, c, g, or t
  modified_base (425)..(425): a, c, t, g, unknown or other
  misc_feature (425)..(425): n is a, c, g, or t
tcagtacagatcgtcacgaccggtgctcgatttagacagtatatatccggcgggggtgggtccaggaggcagaactctgggtntctcacntggcctggactccctctacttcctccccctcctcactctctgacagagtctcgtaggccgtccctaccgtatggacgtctacgaaccacgtaccgccctacccgttcggtgtaccgcggttcccgacccgaggtacgtcgggaaccggcgtaagtactccgactctacgtacggaggacctagtcgacctacgtaacgaaccgtaagtaccttaagttaaccttagtttacgtacgtacagaactaggtacgacgaccggtaccgaccgtccgtagtatcgtatagagtagtaaagactacgtagtacgacggtcgacgagtaccgtccgtacgntcgtattaccgtcgttggaccgtcctacgtagtaccggtaacggaaccgtaacgtacgtggttaaccgtacgtacgtacgtacgtacgggtacgtaccggacgtacgtaacggacggaaacggtaacgcggtttaaggtacctaagttttaacgtacccgtttaagtagtaacctacggtacgaactaacccgtaaccgtaaaaccctcggttaaacggttacccgttacgggttaccggtttaaccggggacggaccggtaaaccgggttacgtcccgggttttaaccggccggtttaaacccgggacggtttaaaccggaccgaacccggggtttccccgaaccggtttcccccccggttaaagggtcccctttaaaccccggg

SEQ ID NO: 156899 - DNA, 650 bp, Homo sapiens
  misc_feature: GYAE6OF01AH79Z.35.15.B04.1.454.CMB.1.raw
  modified_base (177)..(177): a, c, t, g, unknown or other
  misc_feature (177)..(177): n is a, c, g, or t
  modified_base (220)..(220): a, c, t, g, unknown or other
  misc_feature (220)..(220): n is a, c, g, or t
  modified_base (634)..(634): a, c, t, g, unknown or other
  misc_feature (634)..(634): n is a, c, g, or t
tcagtacagatcgtcacgaccggtgctcgatttagacagtatatatccgcgggggtgggtccaggaggcagaactctgggtgtctcaccatggcctggatccctctacttctccccctcctcactctctgcacaggctctgaggcctcctatgagctgacacagcccaccctcggtntcagtcgtcccaggacagacggccaggatcacctgctctgganatgctattgaccaaagcaatatacttattggtaccagcagaagtcaggccaggcccctagtattgatgtatgtaataaacgacaccgtagacgacggcccgtacgagggtactcccgtagacgtacgtaactttctcgtcggcctacccaggaccttacggacgggaacctaacgtacgtaccgtaacgttacgaaccacgttaccgagggtcggaacggtaccgtaacgggacaacgggaacgtaccgacggtactagtaacttaagttacttacgtactaaacgtcgaacgtacgaacgtaacctaaaccaaacgttaactaccggttacccggtaggtttacgggacgggtaacggaaccgaacgtcgtacggacccgttacgtacggtaccgacgtacccgaaggtcccncccggtcccgtaccgg

SEQ ID NO: 156900 - DNA, 670 bp, Homo sapiens
  misc_feature: GYAE6OF01DSH40.35.15.B04.1.454.CMB.1.raw
  modified_base (499)..(499): a, c, t, g, unknown or other
  misc_feature (499)..(499): n is a, c, g, or t
  modified_base (546)..(546): a, c, t, g, unknown or other
  misc_feature (546)..(546): n is a, c, g, or t
  modified_base (553)..(553): a, c, t, g, unknown or other
  misc_feature (553)..(553): n is a, c, g, or t
  modified_base (603)..(603): a, c, t, g, unknown or other
  misc_feature (603)..(603): n is a, c, g, or t
tcagtacagatcgtcacgaccggtgctcgatttagacagtatatatccgcgggggtgggtccaggaggcagaactctgggtgtctcaccatggcctggactccctctacttcctccccctcctcactctctcgcacaggctctgacggcctcctatgagctgacacacgccacctcggtgtcagtccgtcccgaggaccacgaccggcacggactcgaccgtgccgtcgtaggagcttcgactacgttacgaaccaaagactaaactttactaactttacgttacggtaacgacgacgaaggtaacgtcgaaccggccgaccggtccttaggttattcggtaagtacgtacgttaaggtaactaaacgacctacggaggaacgccggtaccctacggtacggtaccttccgagtacgtccgttacttccgtcgtacggtcctacgcgtactacggaggaaccaacggtcgttaacgacgttacaacgtactgtaacggngtaacgcgagaacgagacgacggtagtactagtacttacttcactanacaacgnaacgaccgtaacaaccgtaacgtacgttcggtaccgtaggtcgggaacgnggaaacctcggtacctacggtcccacgtacgtaccgacgacccgggatcccgttccgacccgttacg

SEQ ID NO: 156901 - DNA, 792 bp, Homo sapiens
  misc_feature: GYAE6OF01BJBC1.35.15.B04.1.454.CMB.1.raw
tcagtacagatcgtcacgaccggtgctcgatttagacagtatatatccgcgggggtgggtccaggaggcagaactctgggtgtctcaccatggcctggatccctctacttctccccctcctcactctctgcacaggctcgtgacggcctctatgagctgacacacgcccacccgtcggtgtcacgttccgtaccccaggaccacggaccggccgaggtactccaccgtgcgtcgtggaagtacgtcgactacgttcgaacccaaaaggtcctaaaattacgttaacgtttaacgttacggtaacccagacgtaacggaaagttccgacgggcccgaaccggtcccctagttacgttaggtacgtagtagttacgtaaaacgtaaaagaccgtacgtagggaaccggtaccgggtaccccttaggggaccggtaaccttccggaggacgtaccgttactttccgtcggtccgtacgtaccgcgttacgaccggtaaaggacctaaaccgtacgttccgttacggtacgtaacctacgtacggtacggtaacggtcgtaaccgacggtaacggtaacgaacggaacgtacggttactaacggttattttaacgttacgttcgtaacgtaacgccgtaagacgtaaccgtaaccgtaaacctaacggttaacgttaccggtccgggttaggtttccgggaaaccgggtaacggttacccggaaggttccggaccgtacccggtaccgttaggacccgttacggaccgtaccggcccgttcccgccccggttaccg

SEQ ID NO: 156902 - DNA, 864 bp, Homo sapiens
  misc_feature: GYAE6OF01C38KC.35.15.B04.1.454.CMB.1.raw
  modified_base (104)..(104): a, c, t, g, unknown or other
  misc_feature (104)..(104): n is a, c, g, or t
  modified_base (190)..(190): a, c, t, g, unknown or other
  misc_feature (190)..(190): n is a, c, g, or t
  modified_base (726)..(726): a, c, t, g, unknown or other
  misc_feature (726)..(726): n is a, c, g, or t
tcagtacagatcgtcacgaccggtgctcgatttagacagtatatatccggcgggggggtccaggaggcagaactctgggtgtctcaccatggcctggatccctntacttctccccctctcactctctgcacaggctcgtaggacggcctcctatgacgctacgacaccgacgacccctaccccgtgggtntcccgtaggttcccggtacccccgaaggaacacgggtacccggacccgaagggtaaccttccgaaccgttcggtcgtaccgtagggactacgttgacgttaacgttccgaaaccgtaaaaggaccttaaagtttacttaacctttaacggtttacgaacccaacggtagaaacgttaacggtaccggaacggacccgtaacgggtccccctttaaggttaacgtacggaagttaagttaagttaacgttaaacgttaaaaaccgaccgtaaggttacggaaccgggtacccgggtaacccgttacgggaaacgggttaccccgtacccgtaggaaccgttccggtaacgttaccgttccgggtaaccgtcccgtaacgcgtttaccggaccggaaacgggtaactacccgaaggttaccgtaacggttaaccgacgtacgtaacggaggttaccggtacgacgtaacgggaaagaacggacgtaaaggtccggtataacgtttactacgtaacttcgtaacaacgttgaaccgaanaacgaccccgtaaataccacggttacttcggtagtaaccgggtacgtacggaaccgtacgtcggtacccgacggttaccgtaccggtaccgaacccggtacgtaccggtcccgttcccccgtcgtacccggtttaccg

SEQ ID NO: 156903 - DNA, 695 bp, Homo sapiens
  misc_feature: GYAE6OF01BR2OX.35.15.B04.1.454.CMB.1.raw
  modified_base (239)..(239): a, c, t, g, unknown or other
  misc_feature (239)..(239): n is a, c, g, or t
  modified_base (314)..(314): a, c, t, g, unknown or other
  misc_feature (314)..(314): n is a, c, g, or t
tcagtacagatcgtcacgaccggtgctcgatttagacagtatatatccgtgtcaggtgcagctggtggagtctggggggaggcttggtcaagcctggagggtccctgagactgtcttgtgcagcctctggattcaccttcagagactatttcatgacctggactccgccagactccgagggaaggactgggagtgggtctcacacatcagcagtactggcaactcccatcgtactacgnacgactctgtagaacggcatccactagttttaggacaacgcgtaagggttcgctgtactctgactaaatcgaacncgtccgtacgagacggtacgaaggacgaccggacctactctattactggtacgacaagtaggttcttaggttaggttggtacgggtattacggtttggttacgggtacgttacgggttaccgtaacggtacgggttagtacgggtacggtcgggtacggggtaccgaacgggtaccgaacggtcccgtaccgttccttacccgtactacggtaccttacccgaaccggtacccgggtaccctacgttccccggttccccttacccccgcggtcccctaccccgttccctaacccgaacggtacccgtacccacccggttccgggaccggggtcccaccggtaccggtccccgggacccggtcggtcccgtccgggtacccg

SEQ ID NO: 156904 - DNA, 633 bp, Homo sapiens
  misc_feature: GYAE6OF01BVMDM.35.15.B04.1.454.CMB.1.raw
  modified_base (264)..(264): a, c, t, g, unknown or other
  misc_feature (264)..(264): n is a, c, g, or t
  modified_base (398)..(398): a, c, t, g, unknown or other
  misc_feature (398)..(398): n is a, c, g, or t
tcagtacagatcgtcacgaccggtgctcgatttagacagtatatatccgcgggggtgggtccaggaggcagaactctgggtgtctcaccatggcctggactccctctacttcctcccctctcactctctgacacgaggtctctagacggcccttacctatgagcctagaccacacgcccctaccccgttgggtagtcctaggttcccgaccccgaagggacacgggaccggccgaaggtactccaccgtgcgtacggtggaagngttcgacctagttacgaaccaaagtactaattattacgtttagtacggaccagacagaacgtcgacgccgacggtcctagtagttgatagtagtagaacaacgactagagaacgacgtccgaggcgtctaccgngcggtatctcgcgtacgtcctcgacgtcaacggacgacaacgtacgtacgtacgtacgacgtacgtgacgggtcgacggtacgaaggacgaaagacgggagacggttatacgttaattacgttacagtaactagacacgactaaacgaccaacaacgtaacgtcgtccggtagtcgggaccgagacgtcgacgtcgtccgacgtacgcgaaccgcgacgtctccggtcccgtacg

SEQ ID NO: 156905 - DNA, 748 bp, Homo sapiens
  misc_feature: GYAE6OF01C7TKL.35.15.B04.1.454.CMB.1.raw
  modified_base (86)..(86): a, c, t, g, unknown or other
  misc_feature (86)..(86): n is a, c, g, or t
  modified_base (112)..(112): a, c, t, g, unknown or other
  misc_feature (112)..(112): n is a, c, g, or t
  modified_base (136)..(136): a, c, t, g, unknown or other
  misc_feature (136)..(136): n is a, c, g, or t
  modified_base (166)..(166): a, c, t, g, unknown or other
  misc_feature (166)..(166): n is a, c, g, or t
  modified_base (170)..(170): a, c, t, g, unknown or other
  misc_feature (170)..(170): n is a, c, g, or t
  modified_base (267)..(267): a, c, t, g, unknown or other
  misc_feature (267)..(267): n is a, c, g, or t
  modified_base (492)..(492): a, c, t, g, unknown or other
  misc_feature (492)..(492): n is a, c, g, or t
  modified_base (524)..(524): a, c, t, g, unknown or other
  misc_feature (524)..(524): n is a, c, g, or t
  modified_base (560)..(560): a, c, t, g, unknown or other
  misc_feature (560)..(560): n is a, c, g, or t
  modified_base (588)..(588): a, c, t, g, unknown or other
  misc_feature (588)..(588): n is a, c, g, or t
  modified_base (596)..(596): a, c, t, g, unknown or other
  misc_feature (596)..(596): n is a, c, g, or t
  modified_base (680)..(680): a, c, t, g, unknown or other
  misc_feature (680)..(680): n is a, c, g, or t
  modified_base (695)..(695): a, c, t, g, unknown or other
  misc_feature (695)..(695): n is a, c, g, or t
tcagtacagatcgtcacgaccggtgctcgatttagacagtatatatccgcgggggctgtgggtccaggaggcagaactctggggtntctcaccagtcggcctggactccctntacttcctcccctctcactctcgngcacgacggctcgtgacggcccttactagngacncgtacgaaccacgacgtacccctacccggtggtcgttacgacggttcccggacccgaagggaacaccgggaccggccgtaaggtacctccgtaccgnggtccgttaccggaaggaacgttgtcgaacttacgacggaaaccgaaagtactaattacttacggttaaggtccggaacaggaactaacggtacgccggaaccgtccgtaacccggtaccgtaagttagttaacgagttagtaacgtaattaaagaaccgtgtaccgaagaccggacgtccgtaaggcgtaccgtacgaggctacgtattccgcggtacgacctnacgacgtacggaaaggctaggcttacgacgtnacgtagtcgaggtcgtacacggaacgagtaaacggngagtcgaattacggttaatacgtaatanaacgtaancggaacgtaccaaacggaacctaaacctacgggtaaactttccgggactttaccggggacgggtaacggaacgacgttaccggngttaaaccccgggtnaacccggttaacgaccggtaacccgtaaccgtcccggtacccggttacccccg

SEQ ID NO: 156906 - DNA, 752 bp, Homo sapiens
  misc_feature: GYAE6OF01ACM0W.35.15.B04.1.454.CMB.1.raw
  modified_base (163)..(163): a, c, t, g, unknown or other
  misc_feature (163)..(163): n is a, c, g, or t
  modified_base (176)..(176): a, c, t, g, unknown or other
  misc_feature (176)..(176): n is a, c, g, or t
  modified_base (730)..(730): a, c, t, g, unknown or other
  misc_feature (730)..(730): n is a, c, g, or t
tcagtacagatcgtcacgaccggtgctcgatttagacagtatatatccgcgggggtgggtccaggaggcagaactctgggtgtctcaccatggcctggatccctctacttcctcccctcctcactctctgcacaggctctgacggcctctatgagctgacacngccacccgtggtntcagtcgtaccccgaggacagtaccggcctaggatccaccgtggctcgtggagtagtcgcgtaagttcgaacccaaagtacaatttaacttaaccgttagttaccggaaccagactaaggaacgtccgacggcctaacggccccgttgtattcggagtagtatagtaaactaaacgtacacgtaacggaccggtaccggacccgttagaaccgggtacctacccgtacggacggtcgtactttccgtacgtcggtaacccgtccgaacggtcgttaccggaacgggtaactaaccgtacggtaccggtaaccgttacgaaccacgttaccggagggtaccgtacgggtaccccgaagggtaaccgagggtaaaggtaacccggtgggtaccgttaggttaactttaccgtaacgttacgtaacctaacgtacgaacgtaccgaactaacccgaaactaaccgttacggtacctaccgggttggttacgggaccggtacgtaaccggtacacgttaccggtacccgtactaccggtacgaccccgacggtaaccnccccgttcccgcccggtacccg

SEQ ID NO: 156907 - DNA, 852 bp, Homo sapiens
  misc_feature: GYAE6OF01AZL5P.35.15.B04.1.454.CMB.1.raw
  modified_base (102)..(102): a, c, t, g, unknown or other
  misc_feature (102)..(102): n is a, c, g, or t
  modified_base (149)..(149): a, c, t, g, unknown or other
  misc_feature (149)..(149): n is a, c, g, or t
tcagtacagatcgtcacgaccggtgctcgatttagacagtatatatccgcggggggtccaggaggcagaactctgggtgtctcaccatggcctggatccctntacttctccccctctcactctctgcacagctctgacgcctctatganctgacactacgccaccgtggtatcagtccgaccccaggaccagaccggcctaaggactccaccgtgcctacgtaggagatcgactagttacgaacctaaagcctaatagttacttagtcggtaccagtacagaacgtcgaacggaccgacggtacccttagttattagagtacgtattaaggtaaacgtaaacgaccgtagtacggaacggtaccgtacccgtacggtaacggtaccttaccgtagaacggtacgttaacgtttccgtacggttacgacccgttaaccgacgttaccgtaaacggaaccgggtaaaccgtaaaccgtaacggtacccggttaaacggtttaaccgaacccgtaagttacccggtaaagggttaccgggtaacccgttacccgggaacggtaacggaaaacgggaaaccgggttaacccggagggttaaccctaagttaaaccgtttaacgtttaacccggtaagttaaaccgtaaacgttaaccgaacgttaacccggaaacgtaaacccctaaaccggtaaaccgttaacccgttaacgggttacccccggtttagggtaacccggggaaccgggttacccggaaacgaccggttaccggtacgtaaacccggtttcgaacgtacccgaacccggtaaccggtaccggtacccgtccccggtaaccccgtggttaacccccg

SEQ ID NO: 156908 - DNA, 734 bp, Homo sapiens
  misc_feature: GYAE6OF01BH4LL.35.15.B04.1.454.CMB.1.raw
  modified_base (329)..(329): a, c, t, g, unknown or other
  misc_feature (329)..(329): n is a, c, g, or t
tcagtacagatcgtcacgaccggtgctcgatttagacagtatatatccgcggggggggtccaggaggcagaactctgggtgtctcaccatggcctggatccctctacttcctccccctcctcactctctgcacaggctcgtgacgtccctctatgagctaggaaccacacgaccctccgtcggtcgtaacgtcggttaccgtccccggaaaggacgacggaccggtaccgaaggtaactcccaccgttgccgttgagggatacgtgactacgtagaaccgtaaagactaaagttactaacgtttgtacggtaccagtacgaaggtaacncggaacgaccgtaccggtaccttagtacgtagtagtaggtacgtaaagttaaacgtaacgaaccttacggaaggacggtaccgtaaccggtacgacggtaacctcgggtatacggtcctacgttctcggacgtccgagtacgtccgtaagaaccggtactaacgtttcgaaccgttgtaaccgtacgtagtactaggcggttaccacgtacggaagaagaggaacgtgaattgttaactgtactaccgtaagtcgtacagtacgtaacaaccgaattacggtaactccgggtaccgttagtaccgggtcgacgggaaccctcggtaccggtttacgggaccctttaagacccggtacctaaccgggacccgtcctaacccggccccgttacggtccccggttacc

SEQ ID NO: 156909 - DNA, 677 bp, Homo sapiens
  misc_feature: GYAE6OF01A0KWX.35.15.B04.1.454.CMB.1.raw
  modified_base (225)..(225): a, c, t, g, unknown or other
  misc_feature (225)..(225): n is a, c, g, or t
tcagtacagatcgtcacgaccggtgctcgatttagacagtatatatccgcgggggtgggtccaggaggcagaactctgggtgtctcaccatggcctggatccctctacttctccccctcctcactctctgcacaggctctgaggcctcctatgagctgacacagccaccccttcggtgtcagtcgtccccaggacagaccggccaggatccacctgctctggagntgctattcgcctaaagctaaattaacttacttagttacggtaccagcaagaagtaccgaggaccacggccccttgtagttcgatgtatagtaagaaagacacgtaggacgaccgcctacgaggtacctccgtagacgactattcctcgtcgtacctcgacgtctacgaacggaacaacgtacgtacgtaccgttacgaaccctataccgtaggtcggtaccgaaccgtaggaccgtaaagaacgacggtacggcttaacgtagtttaaccttcggtactacgtactaccgaagacgaaaccgtaacccgaaacctaacgtaacgttacccggttccggtttaaggttccgggacgggtaaaccggaacggtaacctccggtaccgtaccggttaccgtacggtacccgtaacggaccccaacggtccccggtcccgtcccccgggttaccgg

SEQ ID NO: 156910 - DNA, 737 bp, Homo sapiens
  misc_feature: GYAE6OF01AHQOU.35.15.B04.1.454.CMB.1.raw
  modified_base (495)..(495): a, c, t, g, unknown or other
  misc_feature (495)..(495): n is a, c, g, or t
tcagtacagatcgtcacgaccggtgctcgatttagacagtatatagtccggcggggggggtccaggaggcagaactctgggtgtctcaccatggcctggatccctctacttcctcccccctctcactctctgcacaggctctgacggcctcctatgagcctgaaccacacgccctaccccgtggtcgtaccgtaggtccgtacccccgaagggaccacggacccggtaccgaggtactccgaccgttgaccgtcgtagggagatcgctaattcggaaccaagactaagttattacgttagttacggtaccagacgaagacgtcgaaccggccgaccggtcctgtagttgatagtatagtaaataacgacagtacggacgtaccgccgtacggacgggtacctcgaggcgtaccgtacgtttctacggtcgtaccgtacgacgtaccgtaacggaacggaaacctacgtacgtcgtaccgtactacgtacgtacgnggtacggacgtacaggaacgtaaggaacggagtacgggtattacgtaactttagtaccgttaacgaacgtacgtacgaacgaaaccgaacctaacccggtaactaaaccggtcgtttacccggttacggttacgggttacgggacggtaaccggaacggtacgtcccgttacccggaccgtacgtaaccggaccaacccggttacccggaccgtccccgtcccgtccccggtcgttaccccg

SEQ ID NO: 156911 - DNA, 157 bp, Homo sapiens
  misc_feature: GYAE6OF02IVLJQ.35.15.B04.1.454.CMB.1.raw
  modified_base (156)..(157): a, c, t, g, unknown or other
  misc_feature (156)..(157): n is a, c, g, or t
tcagtacagatcgtcacgaccggtgctcgatttagacagtatatatccgcggggaggtgtgtcacaagatttgggctctgggcacagcggccctgggctgcctggtcaaggactactttcacgatctgtactgagcgggctggcaaggcgcatagnn

SEQ ID NO: 156912 - DNA, 488 bp, Homo sapiens
  misc_feature: GYAE6OF02IPROW.35.15.B04.1.454.CMB.1.raw
  modified_base (422)..(422): a, c, t, g, unknown or other
  misc_feature (422)..(422): n is a, c, g, or t
tcagtacagatcgtcacgaccggtgctcgatttagacagtatatatccgcggggggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaagcaatatacttattggtaccagcagaagtcaggccaggcccctgtattgatgatgtataaagacactgagaggccctcagggatccctgagcgattctctggctccagctcagggacaacagtcacgtttgaccatcagtggagtccaggcagaagacgaggctgattattactgtcaatcagcagacaccaanaatagtcccgtgtttgcggaggaccaagctagaccgtcaggtcacgccaaggctcgcccctggtcc

SEQ ID NO: 156913 - DNA, 170 bp, Homo sapiens
  misc_feature: GYAE6OF02GAY5R.35.15.B04.1.454.CMB.1.raw
  modified_base (158)..(170): a, c, t, g, unknown or other
  misc_feature (158)..(170): n is a, c, g, or t
tcagtacagatcgtcacgaccggtgctcgatttagacagtatatatccgcggggaggtgtgtcacaagatttgggctctgggcacgagcggccctgggctgcctggtcaaggactacttccacgatctgtactgagcgggctcggcaaggcgcatagnnnnnnnnnnnnn

SEQ ID NO: 156914 - DNA, 156 bp, Homo sapiens
  misc_feature: GYAE6OF02JCLXN.35.15.B04.1.454.CMB.1.raw
  modified_base (153)..(156): a, c, t, g, unknown or other
  misc_feature (153)..(156): n is a, c, g, or t
tcagtacagatcgtcacgaccggtgctcgatttagacagtatatatccgcggggaggtgtgtcacaagatttggctctggcacagcggccctgggctgcctggtcaaggactacttccacgatctgtactgagcggctggcaaggcgcatagnnnn

SEQ ID NO: 156915 - DNA, 157 bp, Homo sapiens; identical to SEQ ID NO: 156697
  misc_feature: GYAE6OF02I20RB.35.15.B04.1.454.CMB.1.raw
  modified_base (156)..(157): a, c, t, g, unknown or other
  misc_feature (156)..(157): n is a, c, g, or t

SEQ ID NO: 156916 - DNA, 513 bp, Homo sapiens
  misc_feature: GYAE6OF02IXO8U.35.15.B04.1.454.CMB.1.raw
tcagtacagatcgtcacgaccggtgctcgatttagacagtatatatccgtgtcaggtgcagctggtggagtctgggggaggcttggtcaagcctggagggtccctgagactgtcttgtgcagcctctggattcaccttcagagactatttcatgacctggatccgccagactccagggaagggactggagtgggtctcacacatcagcagtactggcaatcccatgtactacgcagactctgtgaagggccgattcaccattttagggacaacgccaagggttcgctgtatctgcaaatgaacagcctgagagtcgaggacacggccatctattactgtgcaagagtctgtagtggtggcagttgttggctacggtactacgacggtatggacgtctggggccaagggaccaaggtcaccgtctcctcagcttccacagggcccatcgtcttcccctgccgccctgctccgaggacgcacctcgtggggccacgacgcggcccgtgggctcgg

SEQ ID NO: 156917 - DNA, 479 bp, Homo sapiens
  misc_feature: GYAE6OF02JM8AP.35.15.B04.1.454.CMB.1.raw
  modified_base (245)..(245): a, c, t, g, unknown or other
  misc_feature (245)..(245): n is a, c, g, or t
  modified_base (465)..(465): a, c, t, g, unknown or other
  misc_feature (465)..(465): n is a, c, g, or t
  modified_base (473)..(474): a, c, t, g, unknown or other
  misc_feature (473)..(474): n is a, c, g, or t
tcagtacagatcgtcacgaccggtgctcgatttagacagtatatatccgcggggtgggtccaggaggcagaactctgggtgtctcaccatggcctggatccctctacttctcccctcctcactctctgcacaggctctgaggcctcctatgagctgacacacgccaccctcggtgtcagtcgtcccacggacagacggccgaggatacacctcgctcgtggagatgcattgacaacgacaataantacttaagtttaggttaccgacgacgagaagtacgacggaccgacggacccgtacgtagttagtagtagagtagtaataaagaacactagagacgaccgtacgacggacgtacctacgagacgactctctcgcgtcacgactcgacggacgaacgacgtacgtacgtacgtacactacgagtaggtacgtacgacggacgacgaacggaacgagacgtanatatatanngtacg

SEQ ID NO: 156918 - DNA, 156 bp, Homo sapiens; identical to SEQ ID NO: 156702
  misc_feature: GYAE6OF02GUYSR.35.15.B04.1.454.CMB.1.raw
  modified_base (156)..(156): a, c, t, g, unknown or other
  misc_feature (156)..(156): n is a, c, g, or t

SEQ ID NO: 156919 - DNA, 520 bp, Homo sapiens
  misc_feature: GYAE6OF02I6RIX.35.15.B04.1.454.CMB.1.raw
tcagtacagatcgtcacgaccggtgctcgatttagacagtatatatccgtgtcaggtgcagctggtggagtctgggggaggcttggtcaagcctggagggtccctgagactgtcttgtgcagcctctggattcaccttcagagactatttcatgacctggatccgccagactccagggaagggactggagtgggtctcacacatcagcagtactggcaatcccatgtactacgcagactctgtgaagggccgattcaccattttagggacaacgccaagggttcgctgtatctgcaaatgaacagcctgagagtcgaggacacggccatctattactgtgcaagagtctgtagtggtggcagttgttggctacggtactacgacggtatggacgtcgtggggccaagggaccaaggtcaccgtctcctcagcttccaccaagggcccatcgtctcccctggccgccctgcctccgaggcgccacctcgtcgggggcacgacggccggccctgggcctcgg

SEQ ID NO: 156920 - DNA, 210 bp, Homo sapiens
  misc_feature: GYAE6OF02JISPY.35.15.B04.1.454.CMB.1.raw
  modified_base (210)..(210): a, c, t, g, unknown or other
  misc_feature (210)..(210): n is a, c, g, or t
tcagtacagatcgtcacgaccggtgctcgatttagacagtatatatccgcggggaccaaggtcaccgtctcctcagcttccaccaagggcccatcggtcttcccctggcgccctgctccaggagcacctctgggggcacagcggccctgggctgcctggtcaaggactacttccacgatctgtactgagcgggctggcaaggcgcatagn

SEQ ID NO: 156921 - DNA, 498 bp, Homo sapiens
  misc_feature: GYAE6OF02IOVY3.35.15.B04.1.454.CMB.1.raw
tcagtacagatcgtcacgaccggtgctcgatttagacagtatatatccgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaagcaatatacttattggtaccagcagaagtcaggccaggcccctgtattgatgatgtataaagacactgagaggccctcagggatccctgagcgattctctggctcagctcaggacaacagtcacgttgaccatcagtggagtccaggcagaagacgaggctgattattactgtacaatcagcagacacaacaatacgtccgtgtttggacggagggaaccaaggctagaccgtccgtagtcgacgcccaaggctccgccccgtcgg

SEQ ID NO: 156922 - DNA, 549 bp, Homo sapiens
  misc_feature: GYAE6OF02H4JZ5.35.15.B04.1.454.CMB.1.raw
  modified_base (321)..(321): a, c, t, g, unknown or other
  misc_feature (321)..(321): n is a, c, g, or t
  modified_base (433)..(433): a, c, t, g, unknown or other
  misc_feature (433)..(433): n is a, c, g, or t
tcagtacagatcgtcacgaccggtgctcgatttagacagtatatatccgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaagcaatatacttattggtaccagcagaagtcaggccaggcccctgtattgatgatgtataaagcactgagaggccctagagggactccgngagacgattctcgtgctccagctcgaggacacagtacacgttcgacatcgagtggacgtcaggcaagagacgaggctagattacttatgtactatcagacacgacaaccaanaactacgtaccgttgttacggacgggacgggtaacccgaggtaccgtacggacccggtttacgtacggtccgaacggaccccgtaacggtcctaccccggaccccgttaccccggg

SEQ ID NO: 156923 - DNA, 711 bp, Homo sapiens
  misc_feature: GYAE6OF02JTPXC.35.15.B04.1.454.CMB.1.raw
  modified_base (382)..(382): a, c, t, g, unknown or other
  misc_feature (382)..(382): n is a, c, g, or t
  modified_base (634)..(634): a, c, t, g, unknown or other
  misc_feature (634)..(634): n is a, c, g, or t
tcagtacagatcgtcacgaccggtgctcgatttagacagtatatatcgcggggtgggtccgaggaggcagaactctggtgtctcaccatggcctggatccctcctacttctcccctccctcactcctctcgcacacggctctgacggccctccttagtagcgttaaccgggaccgaccgaccgtacccgtaccccggttacccggttccgtacggtaccgtaccggaaccccggaaccggaaccgacggaccggaccgaccggtaacccgtacgtaccgaccgaggtagactagcaattagacctaaagtacgtaactatacttattagtaccagacagacgtctacggacctaggacctgtatacgtagtacgcagtaacngagtccggtacctacgttacgtacgtacgtaccgtaccgtacgtacgtacgtacgtaccgtcctacgtacgtaccgtacgtacgtacgtacgtacgtacgacgtacgaccgacgtacgtacgacgtacgtacgtacgtccgtaccgtacttacgacgacgcaagtaacgtacgtacgtacgtactacgtacgtacgtaacgtaccgaacgtaacgtaaccgtaaccggacgtacgtaaccgtacgtaccggnctgacggttcctaggtacccggtaccggtaccggtaccggtacccgtacccgtaccggtacccgtaccggtaccccg

SEQ ID NO: 156924 - DNA, 505 bp, Homo sapiens
  misc_feature: GYAE6OF02FWNYU.35.15.B04.1.454.CMB.1.raw
tcagtacagatcgtcacgaccggtgctcgatttagacagtatatatccgcgggggggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaagcaatatacttattggtaccagcagaagtcaggccaggcccctgtattgatgatgtataaagacactgagaggccctcagggatccctgagcgattctctggctccagctcagggacaacagtcacgttgaccatcagtggagtccaggcaggaagacgaggctgattattactgtacaatcagcagacaaccaacaatacgtcccgtgttcggcggagggaccaaggctacgaccgtccgtaggtcacgcccgaaggctccgccccgtggtccc

SEQ ID NO: 156925 - DNA, 491 bp, Homo sapiens
  misc_feature: GYAE6OF02GCLVS.35.15.B04.1.454.CMB.1.raw
  modified_base (425)..(425): a, c, t, g, unknown or other
  misc_feature (425)..(425): n is a, c, g, or t
tcagtacagatcgtcacgaccggtgctcgatttagacagtatatatccgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaagcaatatacttattggtaccagcagaagtcaggccaggcccctgtattgatgatgtataaagacactgagaggccctcagggatccctgagcgattctctggctccagctcagggacaacagtcacgttgaccatcagtggagtccaggcagaagacgaggctgattattactgtcaatcagcagacaccaanaatagtccgtgtttggcggaggaccaagctgaccgtcctaggtcaggcccaaggctcgcccctcgg

SEQ ID NO: 156926 - DNA, 516 bp, Homo sapiens
  misc_feature: GYAE6OF02HGUPQ.35.15.B04.1.454.CMB.1.raw
  modified_base (419)..(419): a, c, t, g, unknown or other
  misc_feature (419)..(419): n is a, c, g, or t
  modified_base (424)..(424): a, c, t, g, unknown or other
  misc_feature (424)..(424): n is a, c, g, or t
  modified_base (455)..(455): a, c, t, g, unknown or other
  misc_feature (455)..(455): n is a, c, g, or t
tcagtacagatcgtcacgaccggtgctcgatttagacagtatatatccgtgtcaggtgcagctggtggagtctgggggaggcttggtcaagcctggagggcccctgagactgtcttgtgcagcctctggattcaccttcagagactatttcatgacctggatccgccagactccagggaagggactggagtgggtctcacacatcagcagtactggcaatcccatgtactacgcagactctgtgaaggccgattcaccattttagggacaacgccaagggttcgctgtatctgcaaatgaacagcctgagagtcgaggacacggccatctattactgtgcaagagtctgtagtggtggcagttgtggctaggtactacgacggtatggacgtctggggccaagggccaaggtcaccgtntcctnagcttccaccgaggcccagtcgtcttccccnggccgccctgcctccgaggacgtcaccgtcgtggggcacgacggccggccctgggcctcgg

SEQ ID NO: 156927 - DNA, 486 bp, Homo sapiens
  misc_feature: GYAE6OF02HK5FB.35.15.B04.1.454.CMB.1.raw
  modified_base (307)..(307): a, c, t, g, unknown or other
  misc_feature (307)..(307): n is a, c, g, or t
tcagtacagatcgtcacgaccggtgctcgatttagacagtatatatccgcggggggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaagcaatatacttattggtaccagcagaagtcaggccaggcccctgtattgatgatgtataaagacactgagaggccctnagggatccctgagcgattctctggctccagctcagggacaacagtcacgtttgaccatcagtggagtccaggcagaagacgaggctagtattattactgtcaatcagcagacacaacaatcgtaccgtgttcggcgaggacagctgaccgtcaggtcacgccagctacgccccgtgtcc

SEQ ID NO: 156928 - DNA, 484 bp, Homo sapiens
  misc_feature: GYAE6OF02H2Z7A.35.15.B04.1.454.CMB.1.raw
  modified_base (353)..(353): a, c, t, g, unknown or other
  misc_feature (353)..(353): n is a, c, g, or t
tcagtacagatcgtcacgaccggtgctcgatttagacagtatatatccgcgggggcctggggagcctagctgtgctgtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaagcaatatacttattggtaccagcagaagtcaggccaggaccctgtattgatgatgtaataaagacactgagaggccctgagggactccctgagcgattcnctggctccagctcgagggacaacagtcacgttgaccatcagtggagtcagcagaagacgaggctgattattactgtacaatcagcagacaccaaacatacgtccgtgttggcggaggacacgtctgtaccg

SEQ ID NO: 156929 - DNA, 515 bp, Homo sapiens
  misc_feature: GYAE6OF02I5ZKA.35.15.B04.1.454.CMB.1.raw
  modified_base (307)..(307): a, c, t, g, unknown or other
  misc_feature (307)..(307): n is a, c, g, or t
  modified_base (431)..(431): a, c, t, g, unknown or other
  misc_feature (431)..(431): n is a, c, g, or t
tcagtacagatcgtcacgaccggtgctcgatttagacagtatatatccgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaagcaatatacttattggtaccagcagaatcaggccagcccctgtattgatgatgtataaagacactgagagccctnagggatccctgagcgattctctgctcagctacgagggacaacgagtcacgttgaccatcagtggacgtcgaggacaggaagacgaggctagattattactgtactaatcagcaagaccaccaanaatacgtaccgtgttcggacggaggaccaaggcctaggacccgtaccgtaggtccacgcccgaaggcctacgcccccgtaccgg

SEQ ID NO: 156930 - DNA, 543 bp, Homo sapiens
  misc_feature: GYAE6OF02JDSRM.35.15.B04.1.454.CMB.1.raw
tcagtacagatcgtcacgaccggtgctcgatttagacagtatatatccgtgtcaggtgcagctggtggagtctgggggaggcttggtcaagcctggagggtccctgagactgtcttgtgcagcctctggattcaccttcagagactatttcatgacctggatccgccagactccagggaagggactggagtgggtctcacacatcagcagtactggcaatcccatgtactacgcagactctgtgaagggccgattcaccattttagggacaacgccaagggttcgctgtatctgcaaatgaacagcctgagagtcgaggacacggccatctattactgtgcaagagtctgtagtggtggcagttgtggctacggtactacggacggtatggacgtcgtggggccaagggaccaaggtccaccgtctcctcacgcttccaccgaacgggcccagtccggtccttccccgtggcccgtcccgtgcctccgacgggacgccacccgttccgtgggggccacgacggccggcccgtggggcctccgg

SEQ ID NO: 156931 - DNA, 488 bp, Homo sapiens
  misc_feature: GYAE6OF02J1QDO.35.15.B04.1.454.CMB.1.raw
tcagtacagatcgtcacgaccggtgctcgatttagacagtatatatccgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaagcaatatacttattggtaccagcagaagtcaggccaggcccctgtattgatgatgtataaagacactgagaggccctcgagggatcccgtgagcgattctactggctccagctcagggacaacagtcacgttcgaccatcagtggagtccaggcagaagacgaggctgattatactgtacaatcagcagacacaacaatagtccgtgttggcgaggccaagctgaccgtctaggtcacgccaggctcgccctcgg

SEQ ID NO: 156932 - DNA, 489 bp, Homo sapiens
  misc_feature: GYAE6OF02FW4QL.35.15.B04.1.454.CMB.1.raw
  modified_base (470)..(470): a, c, t, g, unknown or other
  misc_feature (470)..(470): n is a, c, g, or t
tcagtacagatcgtcacgaccggtgctcgatttagacagtatatatccgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaagcaatatacttattggtaccagcagaagtcaggccaggcccctgtattgatgatgtataaagacactgagaggccctcgagggatccctgagcgattctctggctccagctcagggacaacagtcacgttgaccatcagtggagtccaggcagaagacgaggctgattattactgtacaatcagcagacaaccaacaatagtcccgtgttggcggaggacaagctgaccgtctaggcncgccaggctcgcccctcgg

SEQ ID NO: 156933 - DNA, 214 bp, Homo sapiens; identical to SEQ ID NO: 156726
  misc_feature: GYAE6OF02IHNY4.35.15.B04.1.454.CMB.1.raw
  modified_base (211)..(214): a, c, t, g, unknown or other
  misc_feature (211)..(214): n is a, c, g, or t

SEQ ID NO: 156934 - DNA, 576 bp, Homo sapiens
  misc_feature: GYAE6OF02IG9L1.35.15.B04.1.454.CMB.1.raw
tcagtacagatcgtcacgaccggtgctcgatttagacagtatatatccgcgggggtgggtccaggaggcagaactctgggtgtctcaccatggcctggatccctctacttctcccctcctcactctctgcacaggctctgaggcctcctatgagctgacacagccaccctcggtgtcagtcgtccccaggacagacggccaggatcacctgctctggagatgcattgaccaaagcaatatacttattggtaccagcagaagtcaggccaggccctgtattgatgatgtataaagacactgagaggccctagagggatcccgtgagcgattctctggctccagctcgaaggacaacagtcacgttgaccatcagtgagtccgagcagaagacgaggctagacttattactgtacaaagtcaacgacaagaaccaacccaaactaaacgtacgttacccgttaggttttacggacgggaacgggtaacccaaaggtacctacgggtaacccgttaccgttaacgggtacctaccggaacccgaaacgggtcccttacccggaccccccgtttaccggg

SEQ ID NO: 156935 - DNA, 529 bp, Homo sapiens
  misc_feature: GYAE6OF02JY6EN.35.15.B04.1.454.CMB.1.raw
  modified_base (386)..(386): a, c, t, g, unknown or other
  misc_feature (386)..(386): n is a, c, g, or t
  modified_base (425)..(425): a, c, t, g, unknown or other
  misc_feature (425)..(425): n is a, c, g, or t
  modified_base (448)..(448): a, c, t, g, unknown or other
  misc_feature (448)..(448): n is a, c, g, or t
  modified_base (468)..(468): a, c, t, g, unknown or other
  misc_feature (468)..(468): n is a, c, g, or t
tcagtacagatcgtcacgaccggtgctcgatttagacagtatatatccgcgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattgccaaagcaaatatactttattggtaccagcaagaagtcaggccaggcccctgtattgatgatgtaataaagacactgagacggccctagagggactccctgaagcggtaattctcgtgccttcagtctcgaaggacaacgagtccgacgttgaccatnagtggactcaggcaggaacgacgagctagattatacgtntacaatcagcaacgacaccaaanaatacgtccgtgttaccggnggacggaaccgagctacggtaccgtcgtaggtccacggcccgaagccgtccgccccgtcgg

SEQ ID NO: 156936 - DNA, 541 bp, Homo sapiens
  misc_feature: GYAE6OF02GTT4I.35.15.B04.1.454.CMB.1.raw
  modified_base (300)..(300): a, c, t, g, unknown or other
  misc_feature (300)..(300): n is a, c, g, or t
  modified_base (333)..(333): a, c, t, g, unknown or other
  misc_feature (333)..(333): n is a, c, g, or t
tcagtacagatcgtcacgaccggtgctcgatttagacagtatatatccgcgggggtgggtccgaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaagcaatatacttattggtaccagcagagtcaggcaggcccctgtattgatgatgtataaagacactganagggccctacgagggactcccgtgagcgattcntggctccgagctcagggacaacgagcagttgaccaatcagtcggatccgaggacaggaacacggaggactaggattaattacgtagtactaacttcaagcagtacgaaccaaacgaactagtacccgtgtttacggcgaagggtacctaaggaccgtcgaccgtaccgtacggtacacggtacccacgtacgtacgcccccgttacgg

SEQ ID NO: 156937 - DNA, 511 bp, Homo sapiens
  misc_feature: GYAE6OF02GOGEQ.35.15.B04.1.454.CMB.1.raw
  modified_base (314)..(314): a, c, t, g, unknown or other
  misc_feature (314)..(314): n is a, c, g, or t
  modified_base (334)..(334): a, c, t, g, unknown or other
  misc_feature (334)..(334): n is a, c, g, or t
tcagtacagatcgtcacgaccggtgctcgatttagacagtatatatccgcgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaagcaatatacttattggtaccagcagaagtcaggccaggcccctgtattgatgatgtataaagacaactgagaggccctnagggatccctgagcgattcnctggctccagctcagggacaacagtcacgttgaccatcagtggagtccaggcagaagacgaggctgattatactgtcaatcagcagacaccaaacaatagtcccgtgtttacggcggtagggaaccaaggccgttagacccgttccgtacggtccaacggtcccaaggcctacccgg

SEQ ID NO: 156938 - DNA, 503 bp, Homo sapiens
  misc_feature: GYAE6OF02HX2T4.35.15.B04.1.454.CMB.1.raw
  modified_base (318)..(318): a, c, t, g, unknown or other
  misc_feature (318)..(318): n is a, c, g, or t
  modified_base (428)..(428): a, c, t, g, unknown or other
  misc_feature (428)..(428): n is a, c, g, or t
tcagtacagatcgtcacgaccggtgctcgatttagacagtatatatccgcgggggggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaagcaatatacttattggtaccagcagaagtcaggccaggcccctgtattgatgatgtataaagacactgagacggcctcagggatcccngacgcgattctctggctccagctcgagggacaacagtcacgttcgaccatcagtggagtccgaggacagaagacgagctagattattactgtacaatcagcagacacaanaatacgtccgtgttcggcggaggacagtctcgaccgtccgtaggtcacgaccgaagcctcggcccccgtgtaccc

SEQ ID NO: 156939 - DNA, 505 bp, Homo sapiens
  misc_feature: GYAE6OF02GRH75.35.15.B04.1.454.CMB.1.raw
tcagtacagatcgtcacgaccggtgctcgatttagacagtatatatccgcgggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctggagatgcattgccaaagcaatatacttattggtaccagcagaagtcaggccaggcccctgtattgatgatgtaataaagacactgagaggccctgagggactccctgacgcgattctctggctccagctacgagggacaacagtcacgttgaccatcagtggagtccaggcagaagacgaggctagattagttactagtacaatcagcagaccaccaaacaatagtaccgtgttacggacggaggaccgaagctcgaccgtctaggtcacgccaggctcgcccctcg

SEQ ID NO: 156940 - DNA, 683 bp, Homo sapiens
  misc_feature: GYAE6OF02I64BI.35.15.B04.1.454.CMB.1.raw
tcagtacagatcgtcacgaccggtgctcgatttagacagtatatatccgcgggggggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaagcaatatacttattggtaccagcagaagtcaggccacggcccctgtattgatgatgtaataaagacactgagacggccctcgagggactcccgtgagcgtattctcgtcggcctccgagtccgtacgaacggggaacaaaccgacggttaccgtaacggtttacgaaccctaagtacccgaaggttacgggaacgttacccggagggtaccgaaagggtaaacggaaccggtagggacgttaggttaacgtttaactttaaccgtacgttaactaaacgttacgaacggaccgaacgaacccaaacctaaacgtaaagttaccggttacccggtttgggtttacggggaccgggtacggggtaaccgtacggtaccgtcggtaacccggttaccgtaacggtaccgtacgacccggaacggtcccgtacccggtcccccgttaccggtacccg

SEQ ID NO: 156941 - DNA, 488 bp, Homo sapiens
  misc_feature: GYAE6OF02IUPRH.35.15.B04.1.454.CMB.1.raw
  modified_base (331)..(331): a, c, t, g, unknown or other
  misc_feature (331)..(331): n is a, c, g, or t
  modified_base (448)..(448): a, c, t, g, unknown or other
  misc_feature (448)..(448): n is a, c, g, or t
tcagtacagatcgtcacgaccggtgctcgatttagacagtatatatccgcggggcctggggagcctagctgtgctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaagcaatatacttattggtaccagcagaagtcaggccaggcccctgtattgatgatgtataaagacactgagaggccctnagggatccctgagcgattctctggctccagctcagggacaacagtcacgttgaccatcagtggagtccaggcagaagacgaggctagattattactgtacaatcagcagacaccaanaatacgtccgtgttggcggaggaccaaggctgtaacccgg

SEQ ID NO: 156942 - DNA, 693 bp, Homo sapiens
  misc_feature: GYAE6OF02GGJ3G.35.15.B04.1.454.CMB.1.raw
  modified_base (190)..(190): a, c, t, g, unknown or other
  misc_feature (190)..(190): n is a, c, g, or t
  modified_base (454)..(454): a, c, t, g, unknown or other
  misc_feature (454)..(454): n is a, c, g, or t
tcagtacagatcgtcacgaccggtgctcgatttagacagtatataacccggtcggggggtccgaaggaggcagaaacttcgtcgggtgtcgtaccaaccagtaggcccctgggattcccctctactttcctcccccttcctcactctctgcgacacggctctgacggccctcctaatgagtctgacaacngcccaccctccggtcgtcagttgtccccaggacgaagacggcccaaggtatccaccgtgcgtcctgggacatggctagttcgacccaaaagctaaatactacgttaactacggtaaccaacgcgacgaaaggtcaccggccgaggccccctgtattcgatggatgtataaaagacaagtcgagaggccctacacgggatcccctggtacgcgtagttcctcgtggggcctccgagctactagggaacaactagtccaacgtttnaacctatccaaggtggacgtcgaaggcttaagaacgtacgtagtctgtattaattactgtactaagtccaagtcgaacggacaaccaaactaacgtttaacgtcccggttaggtttacgggaacgggttacgggaaccgtaaacggtaccgtaacgggtaaacccttcggttaagggtccctaaagggcccctaaacgggtaccttccggtaccccccgttcgggtacccttaacccgg

SEQ ID NO: 156943 - DNA, 604 bp, Homo sapiens
  misc_feature: GYAE6OF02GO3PG.35.15.B04.1.454.CMB.1.raw
tcagtacagatcgtcacgaccggtgctcgatttagacagtatatatccgcggggggtccaggaggcagaactctgggtgtctcaccatggcctggatccctctacttctccccctcctcactctctgcacaggctctgaggcctcctatgagctgacacagtcaccctcggtgtcagtgtccccaggacagacggccaggatcacctgctctggagatgcattgccaaagcaatatacttattggtaccagcagaagtcaggccaggcccctgtattgatgatgtataaagacactgagaggccctcagggatccctgagcgattctctggctccagctcgagggactagtcggtcacctttgatcatcacgtggggcccaggtggaggatggaggtctggaacttatttatttgttagttacaaactaaacgtacctaaagttagtaatttaagttttttcgttagggttcgtttacggggtcgggtaagggtacccttaaggtttacggtaaccgttaggtttacccgtaacgggttaccgtaacggtaccccgtaacggggtccttacccgggtccccccgtttcgggtacccttacccgg

SEQ ID NO: 156944 - DNA, 529 bp, Homo sapiens
  misc_feature: GYAE6OF02FVLW4.35.15.B04.1.454.CMB.1.raw
  modified_base (486)..(486): a, c, t, g, unknown or other
  misc_feature (486)..(486): n is a, c, g, or t
tcagtacagatcgtcacgaccggtgctcgatttagacagtatatatccgtgtcaggtgcagctggtggagtctgggggaggcttggtcaagcctggagggtccctgagactgtcttgtgcagcctctggattcaccttcagagactatttcatgacctggatccgccagactccagggaagggactggagtgggtctcacacatcagcagtactggcaatcccatgtactacgcagactctgtgaagggccgattcaccattttagggacaacgccaagggttcgctgtatctgcaaatgaacagcctgagagtcgaggacacggccatctattactgtgcaagagtctgtagtggtggcagttgttggctacggtactacggacggtatgggacgtcgtggggccgaagggacaaggtccaccgtctcctcagctaccaccgaggcccagtccgtccttccccgtgccgccctgcctccgaggcnccgaccctcgtcggggcacgacggccggcccgtgggcctccgg

SEQ ID NO: 156945 - DNA, 532 bp, Homo sapiens
  misc_feature: GYAE6OF02GINN4.35.15.B04.1.454.CMB.1.raw
tcagtacagatcgtcacgaccggtgctcgatttagacagtatatatccgtgtcaggtgcagctggtggagtctgggggaggcttggtcaagcctggagggtccctgagactgtcttgtgcagcctctggattcaccttcagagactatttcatgacctggatccgccagactccagggaagggactggagtgggtctcacacatcagcagtactggcaatcccatgtactacgcagactctgtgaagggccgattcaccattttagggacaacgccaaagggttcgctgtatctgcaaatgaacagcctgagagtcgaggacacggccatctattactgtgcaagagtctgtagtggtggcagttgttggctacggtactacgacggtatggacgtcgtggggccaagggaccaaggtcaccgtctcctcagcttccaccgaacgggcccagtcggtccttcccccgtggccgccctgcctccgaggacgccaccgtcgtcgggggccacgacgccggcccgtgggctccgg

SEQ ID NO: 156946 - DNA, 538 bp, Homo sapiens
  misc_feature: GYAE6OF02GWPZY.35.15.B04.1.454.CMB.1.raw
tcagtacagatcgtcacgaccggtgctcgatttagacagtatatatccgtgtcaggtgcagctggtggagtctgggggaggcttggtcaagcctggagggtccctgagactgtcttgtgcagcctctggattcaccttcagagactatttcatgacctggatccgccagactccagggaagggactggagtgggtctcacacatcagcagtactggcaatcccatgtactacgcagactctgtgaagggccgattcaccattttagggacaacgccaagggttcgctgtatctgcaaatgaacagcctgagagtcgaggacacggccatctattactgtgcaagagtctgtagtggtggcagttgttggctacggtactacgacggtatggacgtcgtgggccaagggaccaaggtcaccgtctcctcacgccttccaccgaacgggcccagtccggtccttcccctcggcgcccctgcctccgacggacgccaacccgtccgtcggggcaccgacggccggcccgtcgggcctccgg

SEQ ID NO: 156947 - DNA, 528 bp, Homo sapiens
  misc_feature: GYAE6OF02IFBS1.35.15.B04.1.454.CMB.1.raw
  modified_base (333)..(333): a, c, t, g, unknown or other
  misc_feature (333)..(333): n is a, c, g, or t
tcagtacagatcgtcacgaccggtgctcgatttagacagtatatatccgcgggggggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaagcaatatacttattggtaccagcagaagtcaggccaggcccctgtattgatgatgtaataaagacactgagaggccctcagggactccccgtgagcgattctntggctccagctcgagggacaacgtgtaccacgttcacctatacaggtggacgtaccaggcaggaagacgaggctagatttattactgtacaatcagacagacaccaacaattcgtaccgttgttcggacggaggaccgaagtcgtacgtaccgtcgtacggtccacggaccgaacgccgtcgcccccgtgtaccc

SEQ ID NO: 156948 - DNA, 519 bp, Homo sapiens
  misc_feature: GYAE6OF02FQ72B.35.15.B04.1.454.CMB.1.raw
  modified_base (477)..(477): a, c, t, g, unknown or other
  misc_feature (477)..(477): n is a, c, g, or t
tcagtacagatcgtcacgaccggtgctcgatttagacagtatatatccgtgtcaggtgcagctggtggagtctgggggaggcttggtcaagcctggagggtccctgagactgtcttgtgcagcctctggattcaccttcagagactatttcatgacctggatccgccagactccagggaagggactggagtgggtctcacacatcagcagtactggcaatcccatgtactacgcagactctgtgaagggccgattcaccatttttagggacaacgccaagggttcgctgtatctgcaaatgaacagcctgagagtcgaggacacggccatctattactgtgcaagagtctgtagtggtggcagttgttggctacggtactacgacggtatggacgtctggggccaagggacaaggtcacgtctcctcagcctcaccaagggcccagtccggtcttccccgtgccgccctgcctccgnggacgccacctccgagacgcacgacgccggccctgggtcccg

SEQ ID NO: 156949 - DNA, 576 bp, Homo sapiens
  misc_feature: GYAE6OF02GYSUE.35.15.B04.1.454.CMB.1.raw
tcagtacagatcgtcacgaccggtgctcgatttagacagtatatatccgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaagcaatatacttattggtaccagcagaagtcaggccaggcccctgtattgatgatgtataaagacactgagaggccctcgagggactcccgtgacgcgtattctcgtggctccagcctcgaaggacaacagtcacgttgacctatcagtggacgtccgaggacaaggaagacggaggctagatttatactgtacaatcagcagaccaaccaaactaaatacgttacccgttggtttacgggaccgggtaagggaacccgtaaggaccgttacggacccgttacccgtagggtacccaacggaccccgtaaacgggtcccgttacccggtccccccgttaaccggg

SEQ ID NO: 156950 - DNA, 492 bp, Homo sapiens
  misc_feature: GYAE6OF02IGLQ9.35.15.B04.1.454.CMB.1.raw
  modified_base (362)..(362): a, c, t, g, unknown or other
  misc_feature (362)..(362): n is a, c, g, or t
tcagtacagatcgtcacgaccggtgctcgatttagacagtatatatccgcgggggggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaagcaatatacttattggtaccagcagaagtcaggccaggccccctgtattgatgattggtataaagacactgagaggccctcagggactccctgagcgattctctggctccagctcagggacacagtcacgttnaccatcagtggagtccaggcagaagcgaggctgattattactgtacatcagcagaccaacaacaatcgtcgtgttggaggaggacagctacgaccgtctagcacggcccaggcctaccgcccctgtaccc

SEQ ID NO: 156951 - DNA, 543 bp, Homo sapiens
  misc_feature: GYAE6OF02IY6X5.35.15.B04.1.454.CMB.1.raw
tcagtacagatcgtcacgaccggtgctcgatttagacagtatatatccgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaagcaatatacttattggtaccagcagaagtcagccaggcccctgtattgatgatgtataaagacactgagaggccctcgagggatccctgacgcgattctcgtgcctccgacgctacgacgggacaacgagtcacgttgacctatacagtggagtccaggcaagaagacgaggctagattattacgtagtcaatacgagtcaagaccaaccaactaatacgttacccgttggtttacggcggaacgggtaccaaggtccgtcggtacccgtccgtaggtctacggacccaaggcctaccgcccccgttacgg

SEQ ID NO: 156952 - DNA, 506 bp, Homo sapiens
  misc_feature: GYAE6OF02GASRQ.35.15.B04.1.454.CMB.1.raw
  modified_base (312)..(312): a, c, t, g, unknown or other
  misc_feature (312)..(312): n is a, c, g, or t
  modified_base (409)..(409): a, c, t, g, unknown or other
  misc_feature (409)..(409): n is a, c, g, or t
tcagtacagatcgtcacgaccggtgctcgatttagacagtatatatccgcgggggtgggtccaggaggcagaactctgggtgtctcaccatggcctggatccctctacttctccccctcctcactctctgcacaggctctggggcctcctatgagctgacacagccaccctcggtgtcagtgtccccaggacagacggccaggatcacctgctctggagatgcattgaccaaagcaatatacttattggtaccagcagaagtcaggccaggcccctgtattgatgatgtataaagacactgagacggccctnagggactccctgagcgattctctggctcagctcgaggacaacagtcgacgttgaccatcagtggagtccaggcagaagacgagctagattattactntacaatcagacagacaacaacaatacgtccgtgttcggcggtacggacacgctacgaccgtcgtacggcacgccgaaggcctacgccccgtgtaccc

SEQ ID NO: 156953 - DNA, 548 bp, Homo sapiens
  misc_feature: GYAE6OF02JB941.35.15.B04.1.454.CMB.1.raw
tcagtacagatcgtcacgaccggtgctcgatttagacagtatatatccgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacgccaggatcacctgctctggagatgcattgccaaagcaatatacttattggtaccagcagaagtcaggccaggcccctgtattgatgatgtataaagacactgagaggccctcagggactcccgtgagcgattctctggctaccagctcgagggacaacagtcacgttgaccatcagtggacgtcaggacgagaagacgaggctagtattattactgtacaatcagtacagaaccaaccaaactaacgtacgtcccggttagtttcgggacgggtagggaaccgaacggcgtacggaccggttccgtaaggtaccgacggacccgtaagggcctccggcccccgttaccggg

SEQ ID NO: 156954 - DNA, 517 bp, Homo sapiens
  misc_feature: GYAE6OF02IP96W.35.15.B04.1.454.CMB.1.raw
  modified_base (435)..(435): a, c, t, g, unknown or other
  misc_feature (435)..(435): n is a, c, g, or t
tcagtacagatcgtcacgaccggtgctcgatttagacagtatatatccgcggggggggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaagcaatatacttattggtaccagcagaagtcaggccaggcccctgtattgatgatagtataaagacactggagaggccctcgagggactcccgtgagcgtattctctggcctccagctcgaggacacagtcacgtcgacatcgagtggacgtcgaggcagaagacgaggctagtattattactgtacatcagcaagacaccaanaactacgtccgtagttggacgggaggaccaaggcgtacgaccgtctacggtacacgacccgaggcctccggcccctggtacc

SEQ ID NO: 156955 - DNA, 214 bp, Homo sapiens; identical to SEQ ID NO: 156726
  misc_feature: GYAE6OF02FO4UX.35.15.B04.1.454.CMB.1.raw
  modified_base (211)..(214): a, c, t, g, unknown or other
  misc_feature (211)..(214): n is a, c, g, or t

SEQ ID NO: 156956 - DNA, 564 bp, Homo sapiens
  misc_feature: GYAE6OF02HZ2I3.35.15.B04.1.454.CMB.1.raw
  modified_base (339)..(339): a, c, t, g, unknown or other
  misc_feature (339)..(339): n is a, c, g, or t
tcagtacagatcgtcacgaccggtgctcgatttagacagtatatatccgtgtcaggtgcagctggtggagtctgggggaggcttggtcaagcctggagggtccctgagactgtcttgtgcagcctctggattcaccttcagagactatttcatgacctggatccgccagactccagggaagggactggagtgggtctcacacatcagcagtactggcaatcccatgtactacgcagactctgtgaagggccgattcaccattttagggacaacgccaagggttcgctgtatctgacaaatgaacagcctgagagtcgagacacggccatctatactgtncaagagtctgtagtggtgcagttgttggctacgtactacgacgtatgacgtcgtgggtacgaaggactaaggtcgaccgtctcctcacgcttaccgaccgaacggccctacgttccggttcccttacccgcggtaccgtcccgtcgcccttccggaacggaccgccgtacccgtccgtcgggggacctacggaccggcccgggtacccgtcggggtcctaccggg

SEQ ID NO: 156957 - DNA, 510 bp, Homo sapiens
  misc_feature: GYAE6OF02IQVMZ.35.15.B04.1.454.CMB.1.raw
  modified_base (470)..(470): a, c, t, g, unknown or other
  misc_feature (470)..(470): n is a, c, g, or t
  modified_base (475)..(475): a, c, t, g, unknown or other
  misc_feature (475)..(475): n is a, c, g, or t
  modified_base (488)..(488): a, c, t, g, unknown or other
  misc_feature (488)..(488): n is a, c, g, or t
tcagtacagatcgtcacgaccggtgctcgatttagacagtatatatccgtgtcaggtgcagctggtggagtctgggggaggcttggtcaagcctggagggtccctgagactgtcttgtgcagcctctggattcaccttcagagactatttcatgacctggatccgccagactccagggaagggactggagtgggtctcacacatcagcagtactggcaatcccatgtactacgcagactctgtgaagggccgattcaccattttagggacaacgccaagggttcgctgtatctgcaaatgaacagcctgagagtcgaggacacggccatctattactgtgcaagagtctgtagtggtggctagttgttggctacggtactacgacggtatggacgtgtggggccaagggaccaaggtcaccgtctcctcagcttccacacggcccatcgtctccctgcgccctgctccgnggacncacctcgtgggcncgacgccggccctgggcctcgg

SEQ ID NO: 156958 - DNA, 657 bp, Homo sapiens
  misc_feature: GYAE6OF02H7VGL.35.15.B04.1.454.CMB.1.raw
tcagtacagatcgtcacgaccggtgctcgatttagacagtatatatccgcgggggtgggtccaggaggcagaactctgggtgtctcaccatggcctggatccctctacttctcccctcctcactctctgcacaggatctgagcctcctatgagctgacacacgccaccctcggtgtcagtcgtcccaggacagacggccaggatcacctgctctggagatgcattcgaccaaagcaatatacttatggtaccagcaagaagtcacggccacgcccctgtattgatgatagtaataaagacactgaacgacggccctacgagggtactccgtaggagacgtacttctcgtggcctccgacgacgtcgaacgggaacaacgtacgtacgtacgttacgaacctaacgtcgaacggttacgggaacgtaccgaacgggacgaaacgggaaacggaacggagggtacctaaggtaactttaagttaacgttacgtaaccttaaacgacgtaacgactaaacgaaccctaaacctaaacgtaacgtaacggttcccggttaggtttacgggacggtaacgggaaccgtaaggtccgtacggtaacccggttacgtacggtacgaaccggaccgaacgggtcctaccccgtccccgttaccgg

SEQ ID NO: 156959 - DNA, 548 bp, Homo sapiens
  misc_feature: GYAE6OF02H1BF9.35.15.B04.1.454.CMB.1.raw
tcagtacagatcgtcacgaccggtgctcgatttagacagtatatatccgcgggggggtccaggaggcagaactctgggtgtctcaccatggcctggatccctctacttctccccctctcactctctgcacaggctctgaggcctcctatgagctgacacagccaccctcggtgtcagtcgtccccaggacagacggccaggatcacctgctctggagatgcattgaccaaagcaatatacttattggtaccagcagaagtcaggccaggcccctgtacttgatgatgtaataaagacactgagacggccctcgagggactcccgtgacgcgaattctctggctccagctacgagggactaacgagtcacgttacgaccatcagtggagtccgaggcaagaagacgaggctagtattagttactagtacaatcagacacgaaccaaccaactaactacgttccgttgttcggacggtagggaaccacggctacggtaccgtacgtacggacgtacgacccgtagtccgtaccgtcccccgtggtacccg

SEQ ID NO: 156960 - DNA, 584 bp, Homo sapiens
  misc_feature: GYAE6OF02F1BNH.35.15.B04.1.454.CMB.1.raw
tcagtacagatcgtcacgaccggtgctcgatttagacagtatatatccgtgtcaggtgcagctggtggagtctgggggaggcttggtcaagcctggagggtccctgagactgtcttgtgcagcctctggattcaccttcagagactatttcatgacctggatccgccagactccagggaagggactggagtgggtctcacacatcagcagtactggcaatcccatgtactacgcagactctgtgaaggccgattcacctattttagggacaacgccaagggttcgctgtatctgacaatgaacagcctgagagtcgaggacacggccatctattactgtgcaagagtctgtagtggtgcgtagttgttaggctacggtactacggacggtatgggacgtcgtggggaccgaagggaccgaaggtccaaccgttctccgtcgacgtccttaccaccgaacgggtacccacgtccgggttcctcccccgtcggcccgtcccgtcgcctaccgtaggacctccgacccgttccggtcggggggaccaccggacggtcccgggaccccggtcggggtacccgtccggg

SEQ ID NO: 156961 - DNA, 520 bp, Homo sapiens
  misc_feature: GYAE6OF02GM7CB.35.15.B04.1.454.CMB.1.raw
tcagtacagatcgtcacgaccggtgctcgatttagacagtatatatccgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaagcaatatacttattggtaccagcagaagtcaggccaggcccctgtattgatgatgtaataaagacactgagacggccctagagggactcccgtgacgcgtattctcgtggctccagctgaggacaacagtcctacgtgaccatcgaggtggacgtccaggcaagaacgacgaggctagtatttattactgtacaatcgagcacgaacaccaaatatacgtccgttgttggcggacggacgagctacgtaccgtcgtacggcacggaccgaggtcctccgccctccgg

SEQ ID NO: 156962 - DNA, 751 bp, Homo sapiens
  misc_feature: GYAE6OF02G84NU.35.15.B04.1.454.CMB.1.raw
tcagtacagatcgtcacgaccggtgctcgatttagacagtatatatccgcgggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctggagatgcattcgaccaaagcaatatacttattaggtaccagcagaagtcaggccaggccctgtattgatgatgtataaagacactgagacggcctgagggactccgtgacgcgtacttctacgtcggctccgacgtcctacgaacgggaaccaaacgtacgtaccgtaacggtttacggaaccctaacgttccgaagggttacgggtaaccggttacccggaagggaaccgtaaagggaaaaccggtaaccgggaaagggttaccgttaagggttaaacttttaaacgtttaacccgtttaggttaaccgtaaactttaccggaaacgttacccggaaacgtaaacccaaacccgtaaaacgtaaaaccgtttaccgggttaaccccggtttaggggtttaaccggggaccgggtaacggggtaacccgtaacgggtaccttacgggtaaccccggttaccggttaacggggtaccctaccgggtaacccccggaacgggtccccggtacccggtaccccccggttacccggg

SEQ ID NO: 156963 - DNA, 543 bp, Homo sapiens
  misc_feature: GYAE6OF02IE0AQ.35.15.B04.1.454.CMB.1.raw
tcagtacagatcgtcacgaccggtgctcgatttagacagtatatatccgcgggctgggagcctagctgtgctgtgggtccaggaggcagaactctgggtgtctcaccatggcctggatcctctacttctcccctcctcactctctgcacaggctctgaggcctcctatgagctgacacagccaccctcggtgtcagtcgtccccaggacagacggccaggatcacctgctctggagatgcattgccaagcaatatacttatggtacagcagaagtcaggccaggcccctgtacttgatgatgtaataagacactgagacggccctcgaggactccgtagagcgtattctcgtggctccgagctcgagggacaaacgtgtactacgttacgaccatcgacggtggagttacccgaggtccagagtaggacggaggctagatttatacgtagtactaatcacgtacagaaccaaccaacgtaagttaccggttaccccgttaggtttccgggaccggtaccgggaacctacggaccgttaccggg

SEQ ID NO: 156964 - DNA, 508 bp, Homo sapiens
  misc_feature: GYAE6OF02GGTM6.35.15.B04.1.454.CMB.1.raw
tcagtacagatcgtcacgaccggtgctcgatttagacagtatatatccgcgggggggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaagcaatatacttattggtaccagcagaagtcaggccaggcccctgtattgatgatgtataaagacactgagaggccctgagggactcccgtgagcgattctcgtggctccagctcgagggacaacagtcacgttgaccatcagtggagtccaggcagaagacgaggctgattattactgtacaatcagcagacaacaacaatacgtccgtgttcggcggacgggaccaaggctacgtaccgtcctaggtcacggcccgaggcctcgcccccgtgtaccg

SEQ ID NO: 156965 - DNA, 640 bp, Homo sapiens
  misc_feature: GYAE6OF02H1LZS.35.15.B04.1.454.CMB.1.raw
  modified_base (220)..(220): a, c, t, g, unknown or other
  misc_feature (220)..(220): n is a, c, g, or t
tcagtacagatcgtcacgaccggtgctcgatttagacagtatatatccgcgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgganatgcattgaccaaagcaatatacttattggtaccagcagaagtcaggccaggccctgtattgatgatagtaataaagacactgagacgccctgagggactcccgtagacgcgtattctcgtggcctcagctcgaggacaacgagtaccacgttacgaccaatcgaaggtcggacgtaccgaggacgaaggaaggacggaaggctaggtaatttagttacgtagtactaataccgagaccaacgaaaccaacccgtaaaactaacgttaaccgtacccgggtttaggttttacgggtacggggtaacgggtaaccgaaacggtcccgttaacggtacccggtacccgttaacgggttacccgaaccggtacccccggttaaacgggtccccgttaccccggtcccccccggtttacccggg

SEQ ID NO: 156966 - DNA, 608 bp, Homo sapiens
  misc_feature: GYAE6OF02IEWIJ.35.15.B04.1.454.CMB.1.raw
  modified_base (294)..(294): a, c, t, g, unknown or other
  misc_feature (294)..(294): n is a, c, g, or t
tcagtacagatcgtcacgaccggtgctcgatttagacagtatatatccgtgtcaggtgcagctggtggagtcgtgggggaggcttggtcaagcctggagggtccctgagactgtcttgtgcagcctctggattcaccttcagagactatttcatgacctggatccgccagactccgagggaggactggagtgggtctcacacatcagcagtactggcaatccatgtactacgcagactctgtgaaggccgagtcacctattttaggactaacgccaaggttcgctgtatctganaaatgaacagcctagagacgtcgaggacacggcactctaatactagtgacgaagagtctagtagtggtggcgtagttgtgtcgtacggtactaacggacgttagtaggtacgtcggtcgggacgaacgggtaaccgaacggtcgtaccgttacctccgtacgtcgtacccttaccgaaccggaacgggacccctagttaccggtcccgttaccccgcggtacccgcccgtacgcccgtaccgaacggaccggtacccaccgttccggtcggggacctaccggaccggtacccggtccgtcccgggactcccggg

SEQ ID NO: 156967 - DNA, 635 bp, Homo sapiens
  misc_feature: GYAE6OF02HWK1H.35.15.B04.1.454.CMB.1.raw
  modified_base (332)..(332): a, c, t, g, unknown or other
  misc_feature (332)..(332): n is a, c, g, or t
tcagtacagatcgtcacgaccggtgctcgatttagacagtatatatccgcgggggtgggtccaggaggcagaactctgggtgtctcaccatggcctggatccctctacttcctccccctcctcactctctgcacaggctctgaggcctcctatgagctgacacagcccaccctcggtgtcagtcgtccccaggacagacggccaggatcactgctctggagatgcattgccaaagcaatatacttattggtaccagcagaagtcaggccaggccctgtacttgatgatagtaataaagcactgagcgacctgagggactcctgagcgattcncgtggccttcgacgcctacgaacggaacaaacgtcgtacgtacgttacgaaccactacgaggtggaacgtccgaaggacgaaggaaacggacgacgggtactaggtaatttaacttagtacggtacaagtaccgagaccgaagaaccaacctaaacgtaaacttaccggtacccgtttaggtttacggggacgggtaacgggaccgtaaacggtaccggtacgggtaaccccggttaccgtaacggttacgaacccggtacccggtaaaccgggtcccgtacccgggtaccccccgttccggg

SEQ ID NO: 156968 - DNA, 538 bp, Homo sapiens
  misc_feature: GYAE6OF02JC02W.35.15.B04.1.454.CMB.1.raw
  modified_base (341)..(341): a, c, t, g, unknown or other
  misc_feature (341)..(341): n is a, c, g, or t
tcagtacagatcgtcacgaccggtgctcgatttagacagtatatatccgtgtcaggtgcagctggtggagtctgggggaggcttggtcaagcctggagggtccctgagactgtcttgtgcagcctctggattcaccttcagagactatttcatgacctggatccgccagactccagggaagggactggagtgggtctcacacatcagcagtactggtaatcccatgtactacgcagactctgtgaagggccgattcaccatttttagggacaacgccaagggttcgctgtatctgcaaatgaacagcctgagagtcgaggacacggccatctattactgtnacaagagtctgtagtggtggcagttgttggcttacggtactacgacggtatggacgtctggggccaagggaccaaggtcaccgtctcctcagctccaccaacggcccatccggtccttcccccgtggcccgcccgtcgcctccgacggacgccaccgtcgtcggggaccacgacgccggcccgtgggcctggtcccg

SEQ ID NO: 156969 - DNA, 681 bp, Homo sapiens
  misc_feature: GYAE6OF02IFIEO.35.15.B04.1.454.CMB.1.raw
  modified_base (216)..(216): a, c, t, g, unknown or other
  misc_feature (216)..(216): n is a, c, g, or t
  modified_base (327)..(327): a, c, t, g, unknown or other
  misc_feature (327)..(327): n is a, c, g, or t
  modified_base (470)..(470): a, c, t, g, unknown or other
  misc_feature (470)..(470): n is a, c, g, or t
tcagtacagatcgtcacgaccggtgctcgatttagacagtatatatccgcgggggtgggtccaggaggcagaactctgggtgtctcaccatggcctggatccctctacttctcccctcctcactctctgcacaggctctgaggcctcctatgagctgacacagccaccctcggtgtcagtcgtccccaggacaggacggccaggatcacctgctcnggagatgcattgaccaaagcaatatacttatggtaccagacagaagtcaggcacggccctgtattgatgatgtaataaagcacgtgacgacggccctagacggtactccgngaacgcgtaattcgtctggcctacgacgtctacgaacgggaaccaacgtacgtactacgttacgaacccagtaccgaggtggacgttaccgagggacgaaacggaacggaacggagggacttacggtaatttaagtttaaccnggttaacctaaagttaccgaagtaccgaacgaaacctaacccaaaacgtaaccgttaacgttaccccgggttggttttaccgggaccgggaaccgggtaaccgtaacggtaccggttaccggtaaccccgttaccggtttaacgggtacccgtaaccggaaccccggtaaacgggtccccgttaccccggtacccccccggttaacccggg

SEQ ID NO: 156970 - DNA, 716 bp, Homo sapiens
  misc_feature: GYAE6OF02JZNDH.35.15.B04.1.454.CMB.1.raw
  modified_base (128)..(128): a, c, t, g, unknown or other
  misc_feature (128)..(128): n is a, c, g, or t
tcagtacagatcgtcacgaccggtgctcgatttagacagtatatatccgtgtcaggtgcagctggtggagtctgggggaggcgttggtcaagcctggagggtccctggagactgtcttgtgcagcctntggatttccaccttcagagtacttatttcgattgaccttggactcccgccagacctccgaaggggaacgggactgggagtcgggtctgacacgatcagcagtacctggcaaactcccaatcgtaaccacgtacagtacttctggtacgaacgggccgtacgttaccgaacctaagtttttacggggaactaaaccggtacccgtaaaggggtttccgacgttacggttaactccgttaggacctaaaaaggttcgaaacgaggtaccctaggtaaacggagtaccggagggtaacaccgggacctacgtacttaactttacgtggttacgtacaaggtacttacgttagtaggttcgggtacgtgtagggtttggtttcggcgttaacggttacgtacgggacggttaaggtggtaaccggttcggtacggggtaccgaacgggttacgacggtacgtaaccgtctccgtacgcgttccgtaccgacgtacggccacgtccgtacccgtccgtcggcctccacgtccacggcggaccctgacccgttcgtcgggccgtacgccgtccgggtccgtaccggcgtcccgg

SEQ ID NO: 156971 - DNA, 825 bp, Homo sapiens
  misc_feature: GYAE6OF02GR3RY.35.15.B04.1.454.CMB.1.raw
tcagtacagatcgtcacgaccggtgctcgatttagacagtatatatccgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaagcaatatacttattggtaccagcagaagtcaggccaggcccctgtattgatgatgtaataaagacactgagacggccctacgagggatcccgtgacgcgtattctctggcctccgacgtctacgaacggggtaaccaacgacggttaccgtaacggtttacggaaaccctaacgttaccgtaacgggttacggggtaacggttaccccgaaagggggaaccgaaacggggaaaaacgggtaaaccgggtaaccggggtaaccgtttaacgggttaaaagtttttaaaccgttttaaaccgttaggtttaaacccgtaaaacgtttaccgaaacgggttaccgaaaacggtaaacccgaaaaccccgtaaaaaccgttaaaaccgttaaaccgggttttaaccccgggtttagggttttttaacccggggacggggttaaaccggggtaaaccccggtaaacgggttaacccggttaaccgggtaacccccggtttaacccggtttaaccggggttaacccgaaccgggttaaaccccccggaacgggttaccccggtttaccccgggtacccccccccgttttaccccgggg

SEQ ID NO: 156972 - DNA, 532 bp, Homo sapiens
  misc_feature: GYAE6OF02G86JJ.35.15.B04.1.454.CMB.1.raw
tcagtacagatcgtcacgaccggtgctcgatttagacagtatatatccgtgtcaggtgcagctggtggagtctgggggaggcttggtcaagcctggagggtccctgagactgtcttgtgcagcctctggattcaccttcagagactatttcatgacctggatccgccagactccagggaagggactggagtgggtctcacacatcagcagtactggcaatcccatgtactacgcagactctgtgaagggccgattcaccattttagggacaacgccaaagggttcgctgtatctgcaaatgaacagcctgagagtcgaggacacggccatctattactgtgcaagagtctgtagtggtggcagttgtggctacggtactacggacggtatggacgtcgtggggccaagggaccaagggtcaccgtctcctcagcttccacaacgggcccagtccggtcttcccccgtgccgccctcgctcccgaggacgccacctcgtcgggggccacggagccgggccctgggtcctccgg

SEQ ID NO: 156973 - DNA, 162 bp, Homo sapiens
  misc_feature: GYAE6OF02I728I.35.15.B04.1.454.CMB.1.raw
  modified_base (157)..(162): a, c, t, g, unknown or other
  misc_feature (157)..(162): n is a, c, g, or t
tcagtacagatcgtcacgaccggtgctcgatttagacagtatatatccgcgggggaggtgtgtcacaagatttgggctctgggcacagcggccctgggctgcctggtcaaggactacttccacgatctgtactgagcgggctggcaaggcgcatagnnnnnn

SEQ ID NO: 156974 - DNA, 595 bp, Homo sapiens
  misc_feature: GYAE6OF02HW9RA.35.15.B04.1.454.CMB.1.raw
tcagtacagatcgtcacgaccggtgctcgatttagacagtatatatccgtgtcaggtgcagctggtggagtctgggggaggcttggtcaagcctggagggtccctgagactgtcttgtgcagcctctggattcaccttcagagactatttcatgacctggatccgccagactccagggaaggactggagtgggtctcacacatcagcagtactggcaactcccatgtactacgcagactctgtgaagggccgattcactattttaggactaacgccaaggttcgctgtatctgacaatgaacagcctgagagtcgagacacggcatctattactgtgacaagtagtctgtagtgggtggcgtagtttgttggcgtacggtacgtaacggtacggtagtggacgtcggtcggggacgaacgggtaccgaacggtccaccgtctcccgtcacgtccttcccgaacccgaacggccctacgttccggtcccgttcccccgcggtcccgcccgtacgtccctcccggaacggaccgtccgtacccgtccggtcggggaccaccggaccggcccgggtacccgtcggggcctacccgggg

SEQ ID NO: 156975 - DNA, 635 bp, Homo sapiens
  misc_feature: GYAE6OF02JZAMG.35.15.B04.1.454.CMB.1.raw
  modified_base (173)..(173): a, c, t, g, unknown or other
  misc_feature (173)..(173): n is a, c, g, or t
  modified_base (317)..(317): a, c, t, g, unknown or other
  misc_feature (317)..(317): n is a, c, g, or t
  modified_base (368)..(368): a, c, t, g, unknown or other
  misc_feature (368)..(368): n is a, c, g, or t
  modified_base (384)..(384): a, c, t, g, unknown or other
  misc_feature (384)..(384): n is a, c, g, or t
  modified_base (461)..(461): a, c, t, g, unknown or other
  misc_feature (461)..(461): n is a, c, g, or t
tcagtacagatcgtcacgaccggtgctcgatttagacagtatatatcgcggggtgggtccgaggaggcgagaacgtctgggtgtctcaccatggcctggatcctctacttctccctcctcactctctgcacagctctgacggctcctatgagctgacacagccaccctcggtntccaggtctccccaggacagaccggccaggtactccaccgtgctcctggacgattcgaccagttcgacccgaaagcaatactacttaattggtaaccagtacagtaacgtcacggaccaggcccctagactttggatcggattntactaaagccagtgagacggcctagaacggctaccgtgagcgtatccgttnacggtcctacgacgtntacgagggtaacaacgttacgacgttacgacaacttcaaggtcgacgtacgagacaggaacgtacggagcgttaggnttaacgttacgcgtactaatcgtaacgagtaaccgaacgtaacccaaagtaaccgtaggtaacccggtttggtttaaaccgcggggaacggtttaaacggacggttaccaccgggtacgttaccgtaagggtccaacgtacccggaacgttcggttcccgaccccgttaaccgg

SEQ ID NO: 156976 - DNA, 729 bp, Homo sapiens
  misc_feature: GYAE6OF02HLRA2.35.15.B04.1.454.CMB.1.raw
tcagtacagatcgtcacgaccggtgctcgatttagacagtatatatccgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaagcaatatacttattggtaccagcagaagtcaggccaggcccctgtacttgatgatgtaataaagacactgaagacggccctgagggactcccgtgacgcgtattctcgtggcctccagctcgaagggaccaacgacgtacacgttcgaacctagtacgaggttacgggacgttacccgaagggaccgtaacgggaaaggtaaccggaagggtaccgttaggttaaacgttttaacgtttacgttaggttaccctaaagttaccgtaacggaccgtaacggaaacccgtaaacccgtaaaacgtaaaaccgtttaacggttacccccgggttttaagggtttttaccggggaaccggggtaaaccggggtaacccggtaaaagggtcccgttaaccgggtaaccccgggttaacccgttaacggggtaccgtaaacccgggtaccccggtaaaccggggtccccgttacccgggtacccccccggtttaaccccgggg

SEQ ID NO: 156977 - DNA, 561 bp, Homo sapiens
  misc_feature: GYAE6OF02F8NV6.35.15.B04.1.454.CMB.1.raw
  modified_base (323)..(323): a, c, t, g, unknown or other
  misc_feature (323)..(323): n is a, c, g, or t
tcagtacagatcgtcacgaccggtgctcgatttagacagtatatatccgcgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattgaccaaagcaatatacttattggtaccagcagaagtcaggccaggcccctgtattgatgatgtataaagacactgagaggccctcgaggactcccngagcgattctcgtggctccagctcgagggacaacgagtcacgttcgaccatcgagtggagtccgaggacaaggaacgacggacggtctagtatttacttacgtacgtacaattccgaagccgaagaccaaccaactaaactacgttcccgttggttacggcgggacggacctaacggcgttcggacccgttaccgtacggtccgacggacccgaaggcccttaccggccccctaccgg

SEQ ID NO: 156978 - DNA, 524 bp, Homo sapiens
  misc_feature: GYAE6OF02GY36S.35.15.B04.1.454.CMB.1.raw
tcagtacagatcgtcacgaccggtgctcgatttagacagtatatatccgtgtcaggtgcagctggtggagtctgggggaggcttggtcaagcctggagggtccctgagactgtcttgtgcagcctctggattcaccttcagagactatttcatgacctggatccgccagactccagggaagggactggagtgggtctcacacatcagcagtactggcaatcccatgtactacgcagactctgtgaagggccgattcaccattttaggacaacgccaagggttcgctgtatctgcaaatgaacagcctgagagtcgaggacacggccatctattactgtgcaagagtctgtagtggtggcagttgtggctacggtactacgacggtatggacgtcgtggggccaagggaccaaggtcaccgtctcctcacgcttaccaccgaggcccatccgtcctccccgtgccgccctgcctccgaggacgctaccgtcggcgggccacgacggccggtcccgtgggcctcgg

SEQ ID NO: 156979 - DNA, 536 bp, Homo sapiens
  misc_feature: GYAE6OF02FLS4B.35.15.B04.1.454.CMB.1.raw
tcagtacagatcgtcacgaccggtgctcgatttagacagtatatatccgtgtcaggtgcagctggtggagtctgggggaggcttggtcaagcctggagggtccctgagactgtcttgtgcagcctctggattcaccttcagagactatttcatgacctggatccgccagactccagggaagggactggagtgggtctcacacatcagcagtactggcaatcccatgtactacgcagactctgtgaaggccgattcaccattttagggacaacgccaagggttcgctgtatctgcaaatgaacagcctgagagtcgaggacacggccatctattactgtgcaagagtctgtagtggtggcagttgttggctacggtactacgacggtatggacgtcgtggggccaagggaccaaggtcaccgtctcctcacgctccaccaagggcccacgtccgtccttcccctcggccgccccgtgcctccgacggacgccgtacccgtcgtcgggggccacgacggccggcccgtgggcctccgg

SEQ ID NO: 156980 - DNA, 692 bp, Homo sapiens
  misc_feature: GYAE6OF02F63RC.35.15.B04.1.454.CMB.1.raw
  modified_base (324)..(324): a, c, t, g, unknown or other
  misc_feature (324)..(324): n is a, c, g, or t
tcagtacagatcgtcacgaccggtgctcgatttagacagtatatacccgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaagcaatatacttattggtaccagcagaagtcaggccaggcccctgtatgatgatgtataaagacactgagacggccctagagggactcccgngaacgcgtacttcgtctcgggcctccaagtctacgaacgggaacaacgtacggtctaccggttacgaccctaagtccgaagggttcggacggttacccgaacggggcaaacgggaaacggtaaccgggaacggaccggttagtaaatttttaacgtttaacctcggttaactaaccgttacgaacgtacgaacgaaacccaaccgtaaacctaaaggttaaccgttaccccgggtttaggttttacggggaccgggtaacgggaaccctaacgggtccttaaccgggtacccgttacccggttaacggttacccgaacggaccccgttaaaggcccgttacccggtccccccggtacggttacccccg

SEQ ID NO: 156981 - DNA, 615 bp, Homo sapiens
  misc_feature: GYAE6OF02JY0AS.35.15.B04.1.454.CMB.1.raw
tcagtacagatcgtcacgaccggtgctcgatttagacagtatatatccgcgggggtgggtccaggaggcagaactctgggtgtctcaccatggcctggatccctctacttctcccctcctcactctctgcacaggctctgaggcctcctatgagctgacacagcccaccctcggtgtcagtgtccccaggacagacggccaggatcacctgctctggagatgcattgccaaagcaatatacttattggtacagcagaagtcaggcaggccctgtatgatgatgtaataagactactagacgacggaccctgacgggtactcccgagtacgcgtactcgtcgtggcctccgagccgttacgagggaaccaacgtacgtactacggttacaccgtactcgaagtcggacgttcgacggacaaggaacgtaacggaggtacgtagtaagttacttacgtacgtacgaagtcgaacagtaacgaacaccgtaaaactaacgtaccggttacccgtaggtttacggacggtaagggtaacccaagggtcctaaccggacccgttacgtaccggtacgaaccgtacccggaaggccgttacccggacccccgttaaccggg

SEQ ID NO: 156982 - DNA, 684 bp, Homo sapiens
  misc_feature: GYAE6OF02HJ31X.35.15.B04.1.454.CMB.1.raw
tcagtacagatcgtcacgaccggtgctcgatttagacagtatatatccgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaagcaatatacttattggtaccagcagaagtcaggccacggccctgtattgatgatgtataaagacactgagagccctcgagggactcccgtgacgcgtattctcgtggacctccagtcctacgaacggaccaactacggtactacggtttacaaccgtaatcgaacggttgggacgtaccgacggacgtaaggaacggacgaaggtcgtagtaacttttaagttaacgttcgtacgtaaagtccaacgtaccgtaacgaaacccaaccctaaacgtaaacgttaaccggttacccgggtttagggttttaccggggaccggggtaaccggggaacccgtaaacgggtacccgttaacggggtaaccccggtttaccggtttaacggggtacccgaaccggtaccccggaaacccgggtcccgtttaccccggtacccccccggttacccgggg

SEQ ID NO: 156983 - DNA, 609 bp, Homo sapiens
  misc_feature: GYAE6OF02IWK9E.35.15.B04.1.454.CMB.1.raw
tcagtacagatcgtcacgaccggtgctcgatttagacagtatatatccgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaagacaatatacttattggtaccagcagaacgtcacggccaggcccctgtattgatgattgtaataaagacacgtgagacggcccttcgacgggtactcccgtgacggtacgtattcctcgtcggtccttccgagtcctacgaaggggaaccaacgtacgtccgtaacggttcgaacctatccgtaaggtggacgtacgaggacaaggaacgacgaggctagtattacttacgtgtacatacagacagaaccaacgaactaagtacggtccgttaggttacgggacggtacgggaccgtaaggtacctacggtacccgttaccggtaacggttacgaaccggacccgtaacggtcccgtacccggtcccccgttacgg

SEQ ID NO: 156984 - DNA, 662 bp, Homo sapiens
  misc_feature: GYAE6OF02G57JO.35.15.B04.1.454.CMB.1.raw
  modified_base (257)..(257): a, c, t, g, unknown or other
  misc_feature (257)..(257): n is a, c, g, or t
  modified_base (303)..(303): a, c, t, g, unknown or other
  misc_feature (303)..(303): n is a, c, g, or t
  modified_base (347)..(347): a, c, t, g, unknown or other
  misc_feature (347)..(347): n is a, c, g, or t
  modified_base (447)..(447): a, c, t, g, unknown or other
  misc_feature (447)..(447): n is a, c, g, or t
tcagtacagatcgtcacgaccggtgctcgatttagacagtatatatccgcgggggtccaggaggcagaactctgggtgtctcaccatggcctggatccctctacttcctccccctcctcactctctgcacaggctctgaggcctcctatcgagctgacacagcccaccctcggtgtcagtctccccaggacagacgccaggatcacctgctctggagatgcattgaccaaagtcaatatacttattaggtacctagnacgaatcgagccagcccctgtacttgatcgatgtataaagactacngagacggacctcgaacgggattaccccagacgacgtactctcgngtcctctacggcttacgacgggaacaaccgagtcctaacgtttacgacctaatccgtaagccggtagtacccgaagggaccaaggtaacggaaaccgggnggtaaccgtagttaactttaagttaaccgttcgtaactaactacgtacgaactaaccgaacctaaaccaacgtaaacgttaccgttaccggttacggttacgggtaccgggacggtaacccgaacggttaccgtaccgtaacccggtaaccgttacggtaaccgtaaccgtaacccggtaacgttcccgacccggttacccccgtacccggtacc

SEQ ID NO: 156985 - DNA, 545 bp, Homo sapiens
  misc_feature: GYAE6OF02ILS1J.35.15.B04.1.454.CMB.1.raw
  modified_base (336)..(336): a, c, t, g, unknown or other
  misc_feature (336)..(336): n is a, c, g, or t
  modified_base (508)..(508): a, c, t, g, unknown or other
  misc_feature (508)..(508): n is a, c, g, or t
tcagtacagatcgtcacgaccggtgctcgatttagacagtatatatccgcgggggggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattcgaccaaagcaatatacttattggtaccagcagaagtcaggccaggccctgtattgatgatggtaataaagacactagacgaggccctagagggactccgtagagcgattcntcggctcagctcgagggacaacagtcgacgttcgaccatcgaggtggacgtcgaggacaggaagacgaggcttagattactatcgtacatcagcagaccaacaactaagtacgtcccgttaggttcggacggacgggaaccagtccgtacgacccgttaccgtacggtaccncggacccaaggtcctacccgtcccccgtacggtaccg

SEQ ID NO: 156986 - DNA, 600 bp, Homo sapiens
  misc_feature: GYAE6OF02HD8R9.35.15.B04.1.454.CMB.1.raw
  modified_base (220)..(220): a, c, t, g, unknown or other
  misc_feature (220)..(220): n is a, c, g, or t
tcagtacagatcgtcacgaccggtgctcgatttagacagtatatatccgcgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgganatgcattgccaaagcaatatacttattggtaccagcagaagtcaggccaggcccctgtattgatgatgtaataaagacactgagacggccctcgaggggactcccgtgagcgtacttctcgtggcctccgacgctcgacgggacaaacgacgtacacgttcgacctatccgaggtggacgtccgaaggcaaggaagacggaggtctaggtattacttacgtagtcaagttcacgacgtacgaacaaccaactaaactacggtcccgttggtttcgggacgggtaacgggtaccgaacgggtacctacgggtaccccggtacggtaacggttccggaaccggtaccccgaaggtcccgtacccggtccccccgttaccggg

SEQ ID NO: 156987 - DNA, 568 bp, Homo sapiens
  misc_feature: GYAE6OF02GSMRG.35.15.B04.1.454.CMB.1.raw
  modified_base (343)..(343): a, c, t, g, unknown or other
  misc_feature (343)..(343): n is a, c, g, or t
  modified_base (509)..(509): a, c, t, g, unknown or other
  misc_feature (509)..(509): n is a, c, g, or t
tcagtacagatcgtcacgaccggtgctcgatttagacagtatatatccgtgtcaggtgcagctggtggagtctgggggaggcttggtcaagcctggagggtccctgagactgtcttgtgcagcctctggattcaccttcagagactatttcatgacctggatccgccagactccagggaaggactggagtgggtctcacacatcagcagtactggcaatcccatgtactacgcagactctgtgaaggccgattcacctattttagggacaacgcctaagggtcgctgtatctgcaatgaacagcctgagagtcgaggacacggccatctattactgtgcaagngtctgtagtggtagctagttgtggctacggtactacggtaacggtatgggacgttcgtggggaccgaagggaccaaggtcaccgtctcctcagccttccaccgaacggtccctacgtccggttccttccccgtaggcccgtaccctcgtcctacccgacgggaccnccgtacccgtcggtcggggacccacggtacggcccggtcccgtaccgggtcctcccggg

SEQ ID NO: 156988 - DNA, 781 bp, Homo sapiens
  misc_feature: GYAE6OF02IROZ2.35.15.B04.1.454.CMB.1.raw
tcagtacagatcgtcacgaccggtgctcgatttagacagtatatatccgcgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattgaccaaagcaatatacttattggtaccagcagaagtcacggccacggcccctgtatttgagtgattagtaataaagacaactgagaacggcccctagagggtactcccgtagacgtcgtattcgtcgtcggcctccgtaggtcctacgaacggggaaccaaacgtacgtacctaacggtttacgaaacccgtacgttaccgagggttacgggtaacggttacccgaaaggggaccgaaacgggaaaccggaaccgggtaacgggtacgttacgggttaaactttttaaacgtttaacgtttacgtaacgtaacgttaaccgaacggaacctaaacggaaaccgtaacccgtaaaacgtaaacgtttaacccggttaacccgggtttacggggtttttaccggggacccggggtaaaccggggtaacccgaagggttaaccccggtacgggttaaacccccggttaccggttaaccgggttaaccccgtaccgggtaaacccccgggtaaacggttccccgggttacccccggtaccccccggttttaacccggg

SEQ ID NO: 156989 - DNA, 504 bp, Homo sapiens
  misc_feature: GYAE6OF02GDI6L.35.15.B04.1.454.CMB.1.raw
  modified_base (310)..(310): a, c, t, g, unknown or other
  misc_feature (310)..(310): n is a, c, g, or t
  modified_base (405)..(405): a, c, t, g, unknown or other
  misc_feature (405)..(405): n is a, c, g, or t
tcagtacagatcgtcacgaccggtgctcgatttagacagtatatatccgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaagcaatatacttattggtaccagcagaagtcaggccaggcccctgtattgatgatgtataaagacactgagaggccctnagggatccctgagcgattctctcggctcagctcagggacaacagtcacgttgaccatcgagtggacgtcagcagaagcgagctagattattactntacaatcagcagacaacaacaatacgtccgtgttcggcggaggaccaagctcggaccgtcgtacggtcacggacccgaaggcctaccgccccttaccgg

SEQ ID NO: 156990 - DNA, 538 bp, Homo sapiens
  misc_feature: GYAE6OF02GQ8G1.35.15.B04.1.454.CMB.1.raw
tcagtacagatcgtcacgaccggtgctcgatttagacagtatatatccgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaagcaatatacttattgtaccagcagaagtcaggccaggcccctgtattgatgatgtaataaagacactagagaggccctacgagggtactcccgtgacgcgattctctggctcagctcgaaggacaactagtcacgttcgaccatcagtggacgtcaggcaaggaagacgaggcgtagatttagttactgtactaatcagcaagaccaaccaataactacgtccgtagttacggacgggacggaccgaaggtctacggtaccgtacgtacggtaccacggacccgaggcctccggtccccgtaccgg

SEQ ID NO: 156991 - DNA, 631 bp, Homo sapiens
  misc_feature: GYAE6OF02GQ501.35.15.B04.1.454.CMB.1.raw
  modified_base (221)..(221): a, c, t, g, unknown or other
  misc_feature (221)..(221): n is a, c, g, or t
  modified_base (486)..(486): a, c, t, g, unknown or other
  misc_feature (486)..(486): n is a, c, g, or t
tcagtacagatcgtcacgaccggtgctcgatttagacagtatatatccgcgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctcgtgganatgctattcgaccaaagcaatattacttattcggtaccagcagaagtcaggccacggccctgtattgatgatagtaataaagacatgagacggccctcgaggactcccgtagacgtcgtattctcgtcggtctcccgagccgttacgaacggggaccaaacgacgtacctaacggttacgaaccctaagtcgaaggtggtaacgtccgaggacgaagaacgacggtaggctagttaatttacttacgtagtacaactcaacgganaacgaaccaaccgtaaaccaacgttaccggttaccggttagggtttacgggaccgggtaacggtaacccgaaggtccgtaccggtacccgttacggttacgaccggttacggacccgtaacggtccttcccggccccgttaccgg

SEQ ID NO: 156992 - DNA, 591 bp, Homo sapiens
  misc_feature: GYAE6OF02GBTCX.35.15.B04.1.454.CMB.1.raw
tcagtacagatcgtcacgaccggtgctcgatttagacagtatatatccgcgggggggtccaggaggcagaactctgggtgtctcaccatggcctggatccctctacttctccccctcctcactctctgcacaggctctgaggcctcctatgagctgacacagcccaccctcggtgtcagtcgtcccccaggacaggacggccaggatcacctgctctggagatgcattgaccaaagcaatatacttattggtaccagcaagaagtcaggccacggcccctgtattgatgatagtaataaaagactactagagacggccctagagggactcccgtagagcgtattcgtcgtggctccagctcgaacgggacaaaccgtagtacctacgttacgacctagtcaaggtcggacggtccgggagaaggaacggacggacggctagtattacgttactgtacaagtcagacagaccaacaacagttacgtcccgttggttacgggacggacggacaaggtccgtaacggacccgttaccgaggtaccgaccgacccgaagggtcccgtacccggtccccgttcgggtacctacccg

SEQ ID NO: 156993 - DNA, 625 bp, Homo sapiens
  misc_feature: GYAE6OF02HMCKT.35.15.B04.1.454.CMB.1.raw
tcagtacagatcgtcacgaccggtgctcgatttagacagtatatatccgcgggggctgtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctctggagatgctattcgaccaaagcaatatacttattggtaccagcagaagtcaggccaggcccctagtactgatgatagtaataagacacgtgaggacggaccctacgaacggtactcccgtagacggacgtacttcgtactcggtctaccgtagcgttacgaacgggtacaaacgacgttacgtacgttacgaccaagtcgtaggtacggacgtaccgaggacgtaaggacgtaacggtacgcgtagtaacttattacgttagtacctaagtcgaacgtacgaacgtacctaaccaaacgtagttaccgttaccggttaggttacgggaccgggtaagggacccaacggtacgtaccgtaccgttacgtacggtaccgtaccggaacccgtacggtccgtaccccgg

SEQ ID NO: 156994 - DNA, 775 bp, Homo sapiens
  misc_feature: GYAE6OF02JB59Y.35.15.B04.1.454.CMB.1.raw
tcagtacagatcgtcacgaccggtgctcgatttagacagtatatatccgtgtcaggtgcagctggtggagtcgtgggggaggcttggtcaagcctggagggtccctgagactgtcttgtgcagcctctggattcacttcagagtactatttcgatgacctggatccgccagactccgagggaaggctgggagtgggtctcgacacatcagcagtactggacaatccgatgtaactcgacagtactctgtagaagggaccgtattccaacctagttttacggacaacgccgaaggttcgcttagtatctgactaatgaacagcctagagagtcgaaggacgaccgacgactctaacttacgtgttacgacgtaaacggtagttaccgtaggtttaaggttacggtcggtaccgttaaggtttcggtttcgggtaaccgtttaacgggttaacgttaaccggtacgggttagttacggggtaacgttacgggtacggggtaaccggtaaagggtaacccgtaaacggggttacctaacccgggttccttacccggtaccgtaccggttaccgttaaccccgaaacccggtaaccggggaaccccgttaccggttaacccggttccccggtttaccccggtccgggtacccggttcccccgttcggtacccgtttacccggaacccgggttactacccggtaacccggttccgggtacgggggtaccccgacggtaccgggaccccggggtacccgtttcggggaccccgttaccggg

SEQ ID NO: 156995 - DNA, 701 bp, Homo sapiens
  misc_feature: GYAE6OF02IIWE8.35.15.B04.1.454.CMB.1.raw
tcagtacagatcgtcacgaccggtgctcgatttagacagtatatatccgcgggggtgggtccaggaggcagaactctgggtgtctcaccatggcctggatccctctacttctcccccctcctcactctctgcacaggctctgaggcctcctatgagctgacacacgcccaccctcggtgtcagtcgtccccaggacaggaccggccaggatccacctgctcgtggagatgctattcgaccaaagacaattacttaactttattacggtaccagacaagaacgtcgaacggccacggtcccctagtattgagtgagttagtaataaacgactacgtggagacgccctgacgggactccgtagacgacgtattcctcgtcggtcctccgagtcctcggaacgggaaccaacgtacgtaccgtaccggttacgtaccgtactacggggggggggggatacgggtacgtaccgacggacgaacggaacggacggaacggtacgttacgtatttaagttaccgttagtaactaatacgacgacaaccgaaccaacctaaacctaacgttaaccggtttccggttacgggttacgggtacggggtaaccgggtaaccggtaacggtaccgtaccggtacccggttacccgttaacggtaccgtaaccggacccggaaccggtacccgtccccggtccccgtacccgg

SEQ ID NO: 156996 - DNA, 801 bp, Homo sapiens
  misc_feature: GYAE6OF02G7SA5.35.15.B04.1.454.CMB.1.raw
tcagtacagatcgtcacgaccggtgctcgatttagacagtatatatccgcgggggtgggtccaggaggcagaactctgggtgtctcaccatggcctggatccctctacttctccccctcctcactctctgcacaggctctgaggcctcctatggagctgacacagccaccctcggtgtcagtgtccccaggacagacggccaggatcacctgctctggagatgctattgaccaaagcaatattacttattggtaccagtacagaacgtcgaggccacggtcccctgtattgatgatgtaataaacgacaagtggagacggccctacgagggtacctcccgtaggacgtcggtaactttccgtacgttacggaccttacccggacgtccgttacgaacggggaaaccaaaccgaacggttaccgtaccggtttacgaacccgtacgttaccgtaagggttcgggtaacgtacccggaagggacccgaaagggaaacgggtacgggaacggtaccgttaggttaattttaacgtttacgttaacggttaacctaaacgttaccgtaacggaaccgtaaaccggaaacccaaaccccgtaaaaaccgtaaacgtttaaccccggggtttacccggtttacggggttttaccggggaaccgggggtaacccggggttaacccggtaaacgggtaccgttaaccgggtaaccccggttttacccgggtaccgggttaacccggacccgggtaacccccgttaacgggggtccccgttaccccgggttcccccccggttaacccggg

SEQ ID NO: 156997 - DNA, 620 bp, Homo sapiens
  misc_feature: GYAE6OF02HDH21.35.15.B04.1.454.CMB.1.raw
  modified_base (200)..(200): a, c, t, g, unknown or other
  misc_feature (200)..(200): n is a, c, g, or t
  modified_base (252)..(252): a, c, t, g, unknown or other
  misc_feature (252)..(252): n is a, c, g, or t
tcagtacagatcgtcacgaccggtgctcgatttagacagtatatatccgcgggggcctggggagcctagctgtgctgtgggtccaggaggcagaactctgggtgtctcaccatggcctggatccctctacttctccccctcctcactctctgcacaggctctgagcctcctatgacgctgacactagcccacccgtggtntcagtcgtccccaggacacggaccggcctaggactcaccgtgctcgtggganatgcattcgaccaaagcaatactacttattaggtaccagacagtaagtcgacggaccaggtaccctgtattcggatcgatagtaataaagactatagaagacggcctagacgggtactcccgtaggagaccgtattctcgtaggtcctacgacgtcgtacgtacgggaacacgtagtcgtaacgttcgactacgtacgtaacggttcggacgtacgacggacaacggaacgacgggtaggaccgtagttaacgtttacgttaacttacggttacaaacgttcgaacgtacgaacgtaccaaacctaacgtactaacggtcccgttaggttacggacgggtacggaaccgtacgcggtacgtaacccgg

SEQ ID NO: 156998 - DNA, 630 bp, Homo sapiens
  misc_feature: GYAE6OF02IDRS6.35.15.B04.1.454.CMB.1.raw
  modified_base (234)..(234): a, c, t, g, unknown or other
  misc_feature (234)..(234): n is a, c, g, or t
  modified_base (240)..(240): a, c, t, g, unknown or other
  misc_feature (240)..(240): n is a, c, g, or t
  modified_base (282)..(282): a, c, t, g, unknown or other
  misc_feature (282)..(282): n is a, c, g, or t
  modified_base (300)..(300): a, c, t, g, unknown or other
  misc_feature (300)..(300): n is a, c, g, or t
tcagtacagatcgtcacgaccggtgctcgatttagacagtatatatccgtgtcaggtgcagctggtggagtctgggggaggcttggtcaagcctggagggtccctgagactgtcttgtgcagcctctggattcaccttcagagactatttcatgacctggatccgcagactccgagggaaggactggagtcgggtctcacacatcagcagtactggcaaatccatgtactacgnagactntgtgaagggcctatcactatttaggaacaacgcgtaaggtcnctgtatactgtacaaatnaacagctgagagtcgagacacggcatctatactgtcacaagtacgtctgtagtggtgacgtagttggttacgtcgtaacgtacgttaacggacggttagtcggtaacgtcgtaggggaccgtaaagggaaccgttaaggacctaaccgtcgtacctagtcgtacctttaaccgacccgaaacgggtccctacgttacccggtaccctttccccggcgtacccggtccctcggtcccgtaccggtaacgggacccgtaccgtaacccgttccgggtaacgggcctaaccggtaccgggtacccggtacccggtccgggtacccgttccggg

SEQ ID NO: 156999 - DNA, 646 bp, Homo sapiens
  misc_feature: GYAE6OF02JO6IP.35.15.B04.1.454.CMB.1.raw
  modified_base (217)..(217): a, c, t, g, unknown or other
  misc_feature (217)..(217): n is a, c, g, or t
  modified_base (222)..(222): a, c, t, g, unknown or other
  misc_feature (222)..(222): n is a, c, g, or t
  modified_base (282)..(282): a, c, t, g, unknown or other
  misc_feature (282)..(282): n is a, c, g, or t
  modified_base (339)..(339): a, c, t, g, unknown or other
  misc_feature (339)..(339): n is a, c, g, or t
tcagtacagatcgtcacgaccggtgctcgatttagacagtatatatccgcgggggtgggtccaggaggcagaactctgggtgtctcaccatggcctggatccctctacttctccccctcctcactctctgcacaggctctgaggcctctatgagctgacacagccacccttcggtgtcagtgtccccaggacagacggccaaggatccacctgctcnggganatgctattcgaccaaagctaaatatacttatgtaccagcagtaatcgaggccacgccctntattcgattagattagaataaagacactaggacgacggcctagacgggtactcccgnggagacgtattctacgtcggtctcccgagtctacgaagggactaaccgacgttaccgaggttacgaaccctataccgtaaggttcggaccgttacgaacggtaccgaaaggtaacggaccggaggtacgttagtaacgtttaccgttaagtacgtaccaagtaccgtacgagaacgtaacccgaaccgtaaatacgtacggttaccgttacgggttaggacggtaacgggaactcggtacctcggttaacccggtaccgttaggtcgtaaccgaccgaacgggccctttacccggcccccgtaccgg

SEQ ID NO: 157000 - DNA, 534 bp, Homo sapiens
  misc_feature: GYAE6OF02FU6S7.35.15.B04.1.454.CMB.1.raw
  modified_base (309)..(309): a, c, t, g, unknown or other
  misc_feature (309)..(309): n is a, c, g, or t
tcagtacagatcgtcacgaccggtgctcgatttagacagtatatatccgcgggggggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaagcaatatacttattggtaccagcagaagtcaggccaggcccctgtacttgatgatgtataaagacactgagaggccctnagggatccctgagcggattctctggcctccgagctcagggacaacgagtcgacgtttgaccatccgaggtggacgtccgaggcagaagacgaggctgatttattactgtcaatcagcaagaccaacaacaatacgtcccgtgtttcggacggtacgggacaaggtcctaggacccgttcgtacggtacacgtcccgaaggtcctaccgtcccccgtcgtaccccg

SEQ ID NO: 157001 - DNA, 550 bp, Homo sapiens
  misc_feature: GYAE6OF02ITUB5.35.15.B04.1.454.CMB.1.raw
  modified_base (327)..(327): a, c, t, g, unknown or other
  misc_feature (327)..(327): n is a, c, g, or t
tcagtacagatcgtcacgaccggtgctcgatttagacagtatatatccgcgggggtgggtccaggaggcagaactctggggtgtctcaccatggcctggatccctctacttctccccctcctcactctctgcacaggctctgaggcctcctatgagctgacacagccaccctcggtgtcagtgtccccaggacagacgccaggatcacctgctcgtggagatgcattgaccaaagcaatatacttattggtaccagcagaagtcaggccaggcccctggtattgatgatagtataaagacactgagagccctacagggatcccgtgngacgatctcgtggctccgagccgtacacgggacacgacgtcacgttgaccatcacgtggagtccgaggcaggaacgacggagcgtagtacttattactcgtactaatcgaagacacgtaacaccaaacaatacgtcccgtggttcggacggtaacgggaccgaaggtcctacggaccgttccgtaggtcgacgcccgaacgtccgtacgtcccccggtaccgg

SEQ ID NO: 157002 - DNA, 762 bp, Homo sapiens
  misc_feature: GYAE6OF02JK2E2.35.15.B04.1.454.CMB.1.raw
tcagtacagatcgtcacgaccggtgctcgatttagacagtatatatccgcgggggggtccaggaggcagaactctgggtgtctcaccatggcctggatcccgctacttctccccctcctcactctctgcacaggctctgaggcctcctatgagctgacacagccaccctcggtgtcagtcgtccccaggacagacggccaggatccacctgctctggagatgcacttgaccaaagcaatatacttattcggtaccagtcagaagtcaggccaggcccctgtactgactgatagtactaaagacacgtaggaagacggtcccgttacgacgggacttccccgtaggacgaccggtaatttcctacgtcggtcctaccgtagtccgtacgtaacgggaactaacgtaacgtaccgtaacggttacgtaaccgtacgtaccgtaacgggttacgggtacgttacccggaagggtccaaacgggtaaagacccgggtaaggaccggttagtaaactttacggtttaaccttacgtaccgtaacttacggaaccgttacgaaaccgtaaccgaaacccaaacgttaaaccgttaccggtttaacccggttcggtttacgggacccgggggtaacggtaacccggaacgggttaacccggtaacgggttaacccccggttaccggttaacgggttaccgtaaacccgggtacccctaaaacggttacccggttacccccggtacccccgttaccccggttaaccccgg

SEQ ID NO: 157003 - DNA, 778 bp, Homo sapiens
  misc_feature: GYAE6OF02I8QIQ.35.15.B04.1.454.CMB.1.raw
  modified_base (220)..(220): a, c, t, g, unknown or other
  misc_feature (220)..(220): n is a, c, g, or t
  modified_base (304)..(304): a, c, t, g, unknown or other
  misc_feature (304)..(304): n is a, c, g, or t
  modified_base (340)..(340): a, c, t, g, unknown or other
  misc_feature (340)..(340): n is a, c, g, or t
tcagtacagatcgtcacgaccggtgctcgatttagacagtatatatccgcgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgganatgcattgaccaaagcaatactacttattcggtaccagacgagaacgtcgacggccgacggccccgtgtactgatgatagtaanaaagactacgtgaagacgtccgtagaggtactccgngacgcgtattcgacgtcgacctcgtagtccgtacgacgggaccaacgtacgtactaccggttacaacctacgtacgaggtaccggtagtacccggtagggaacccgaaaggaaacccggtacgggtaacgggttacctaacggttaacgttttaaccgttaacgttacgtaaccgtaaacgtaaccgttaaacggaacccgtaaaccggaaaccctaaacccgtaaaacgttaaaacccggtttacccggtttaaccccgggttaaggggttttacccggggacccggggtaaacggggtaacccgtaaaacgggttcccgttaaccgggttaaaccccggttacccggttaacgggttaccccggttaaacccggggtaaccccggtaacccgggttacccgggtttacccccgtacccccccgggtttaacccggg

SEQ ID NO: 157004 - DNA, 722 bp, Homo sapiens
  misc_feature: GYAE6OF02JJATP.35.15.B04.1.454.CMB.1.raw
tcagtacagatcgtcacgaccggtgctcgatttagacagtatatatccgcgggggtgggtccgaggaggcagaactctgggtgtctcaccatggcctggatcctctacttctcccctcctcactctctgcacaggctctgaggcctcctatgagctgacacagccaccctcggtgtcagtcgtccccaggacagacggccaggatcacctgctcgtggagatgctagttgaccaaagcaagtactacttattggtaccagctagaatcaggccaaggcccctgtacttgatgatgtaataaagccaacgtgacgaggcccttagaacgggactcccgtagacgcggtaacttccgttctacgggccttaccgacgcttacgaacggggaccaaaccgtaggttcccgaacggtttccgaacctacgtacgaacggtacgggtacgtacccgtaggaaccgaacggaaacgggacggaacggtacgtaggtaatttacgttaactggtaacctaatacgaacgtaccgtaacgaacctaaacctaaaccgtaaacgttaacggttacccgttacgggttttacgggaccgggttaacggggtaacccgtaaaccgggtacgttaaccgggtaccccggttaaccggtttaacggtaccccggttaacgggaaccccgttaaacgggtccccgttacccgggtacccccccgtttaacccgggg

SEQ ID NO: 157005 - DNA, 763 bp, Homo sapiens
  misc_feature: GYAE6OF02H90DZ.35.15.B04.1.454.CMB.1.raw
  modified_base (211)..(211): a, c, t, g, unknown or other
  misc_feature (211)..(211): n is a, c, g, or t
tcagtacagatcgtcacgaccggtgctcgatttagacagtatatatccgcgggggtgggtccaggaggcagaactctgggtgtctcaccatggcctggatccctctacttcctccccctcctcactctctgcacaggctctgaggcccttcctatgagctgacacagcccaccctcggtgtcagtcgtccccaggacagacggccaggacncacctgctctggagatgctattcgaccaaagcaatatactttattacggtacagacaagaagtcgaggccgacggtccctgtacttgatgattagtaataaagactactggacgacggtccacgaacgggactcccgagacgtcgtactttctcgtcggtctaccgagtacctcggaacggaacaaccgtacggtactaaccggttacgacctaagtcccgaagggttacggacgtaccggtaggacgaacggaaaggtacgggacggtacgttagtaactttaacgtttaacgtacgtaactaacgttaccgaacggaccaaaccggaaccctaaacccgtaaaacgtaaccgtttaaaccgggttaccccggttttaaggggttttaccggggaaccgggggttaaaccgggtaacccgggtaaacggttaccccgggttaacggtaaccccccgggtttaaccgggttaacccggggtaccgtaaacccgggtacccccggttaaacgggtccccggttaccccccgggtcccccgtttaaccccgggg

SEQ ID NO: 157006 - DNA, 561 bp, Homo sapiens
  misc_feature: GYAE6OF02FSG4L.35.15.B04.1.454.CMB.1.raw
tcagtacagatcgtcacgaccggtgctcgatttagacagtatatatccgcgggggcctggggagcctagctgtgctgtgggtccaggaggcagaactctgggtgtctcaccatggcctggatccctctacttctccccctcctcactctctgcacaggctctgaggcctcctatgagctgacacagccaccctggtgtccagtgtccccaggacaggacggccaggatccacctgctctggacgatgcattgccaaagcaatatacttattggtaccagcaagagtcaggccaggcccctgtattcgatgatgtaataagacactagagagccctcgagggactcccgtgacgcgtattctctcggctccagctcgacgggacaacgagtacacgttagacctagtcagtgggacgtaccgacggcgaggaacggaacggaggacgtggtaagttacgtttacgtgtacaacgtcagcaacgacaaccgaactaacgtaacgttacccgttacggttttacgggaccggtacgggaaccgaacgaccgtacgtaaccccgg

SEQ ID NO: 157007 - DNA, 596 bp, Homo sapiens
  misc_feature: GYAE6OF02G18OP.35.15.B04.1.454.CMB.1.raw
tcagtacagatcgtcacgaccggtgctcgatttagacagtatatatccgcgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattgaccaaagcaatatacttattggtaccagcagaacgtcaggccacggccctgtattgatgatgtaataaagacactgagacggccctacgacgggtatcccgtagacgcgtacttctcgtcgacctccgagtccgtacgagggaaccaacgacgtacctaacgttcgaccctaagtacgtaggtagggacgttaccgaaggtaccgaaggtaaacgacggaaggtacgtaggtaactttagttacgtagtacaatctagcaaacgaccaaccaaagtaactacggtccgtaggttggacggtagaccggaagcctacggaccgtcgtacggaccgtacggaccgtaacggcctaccggtccccgtccgg

SEQ ID NO: 157008 - DNA, 701 bp, Homo sapiens
  misc_feature: GYAE6OF02HVE2Y.35.15.B04.1.454.CMB.1.raw
  modified_base (157)..(157): a, c, t, g, unknown or other
  misc_feature (157)..(157): n is a, c, g, or t
  modified_base (253)..(253): a, c, t, g, unknown or other
  misc_feature (253)..(253): n is a, c, g, or t
tcagtacagatcgtcacgaccggtgctcgatttagacagtatatatccgcgggggcctggggagcctagctgtgctgtgggtccaggaggcagaactctgggtgtctcaccatggcctggatccctctacttcctccccctcctcactctctgcacnggctctgagcctcctatgagctgacacagcccctacccgtggtgccaggtcgtacccccaggacaggaccggccgaggactccacgtggccttcgnggagattcgactagttgaccaaagacaatattacttattcggtaccagacaagtaacgtacgacggaccgacggtaccctaggttacttagatgagtagtaaataaagactagtagaagtacggcctacggacggtactaccgagacgtcgtatttccgtcgtcgtacctaccgagtctacggaacggtaacaactacgtaccgttacggtaccgtaacgtacgttacgacggtacggtacgtaccggaaggcgaaacggaacggacggtacggtacgttagttaaacgtttaacgtttacgtaacccgtacgtaaacttaccgaacgtacgaaccgtaaccgtaaaccgtaaacttaaacccggttaacggtttacccggttagggtttaccgggaccgggggtaaccggtaaccgttaaccggttacggttccggtaaaccccggg

SEQ ID NO: 157009 - DNA, 698 bp, Homo sapiens
  misc_feature: GYAE6OF02JVH86.35.15.B04.1.454.CMB.1.raw
tcagtacagatcgtcacgaccggtgctcgatttagacagtatatatccgcgggggtgggtccaggaggcagaactctgggtgtctcaccatggcctggatccctctacttctcccctcctcactctctgcacaggctctgaggcctcctatgagctgacacacgccaccctcggtcgtcagtcgtccccaggacagacggccaggatccacctgctcgtggacatgcattgaccaaagcaaatatacttattacggtaccagacaagaagtcacggccacggcccctagtacttgatagatagtaactaaagactactggaacgacggccctcggaggactccgtggacgcgtacttcgtcgtacggcctaccgacgtctacggaacggtaacctaaaccgtacgtaccgtaacgttccgtaaccgtactacgtaaaggttcggacgtaccgaaggacgaaggaaacggtacggacgtacgtaggttaattacgttaacgtactactaacgttcgaacgtaaccgaacgttaacccaaacgaaaccgtaaccgtaccgggttaccctttacggggtacgggtaaacggaccgggtaaaccgtaccggtaacgttaccggtaacccggttacgttaaccccggtaggacccgtaaacccggtaaccggcccgttaccccggtcccccggttaacccggg

SEQ ID NO: 157010 - DNA, 611 bp, Homo sapiens
  misc_feature: GYAE6OF02GAHGD.35.15.B04.1.454.CMB.1.raw
  modified_base (342)..(342): a, c, t, g, unknown or other
  misc_feature (342)..(342): n is a, c, g, or t
tcagtacagatcgtcacgaccggtgctcgatttagacagtatatatccgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaagcaatatacttattggtaccagcagaagtcaggccaggcccctgtcttggtcatgttcgaggacgacaagcgacccgtccgggatccctgagagacttctcgtggctccngctcgagggtactatcggtcacgttgactcatcaacgtcgggacccagggtcggaggtagtcggacggctaggtaactttaagtttagtttggtttacgttacaaaaccgtaaagttacctaaagttagtaattttaagttttttcgtttgggttggttaccggcgggtaagggtaccgtaaggtttgacgttcggtaccgtaggtacctacgacccgtaagggtccttaccggtcccccgtacggttccctacgttccgttaccccgg

SEQ ID NO: 157011 - DNA, 590 bp, Homo sapiens
  misc_feature: GYAE6OF02JCIY7.35.15.B04.1.454.CMB.1.raw
  modified_base (324)..(324): a, c, t, g, unknown or other
  misc_feature (324)..(324): n is a, c, g, or t
  modified_base (449)..(449): a, c, t, g, unknown or other
  misc_feature (449)..(449): n is a, c, g, or t
tcagtacagatcgtcacgaccggtgctcgatttagacagtatatatccgcgggggggtccaggaggcagaactctgggtgtctcaccatggcctggatccctctacttctccccctcctcactctctgcacaggctctgagcctcctatgagctgacacagccaccctcggtgtcagtcgtccccaggacagacgccaggatcacctgctctggagatgcattgaccaaagcaatatacttattggtaccagcagaagtcaggccaggcccctaggtattcggatgatgtaataaagacactgagacgcctcgagggctcccgngagcgtattctcgtcggctccgagctacgaagggtaacaacgtagtacgtacgttacgacctaattccgaaggtcggaacgttaccgaaggacgaaggaaacgcggtaaggctagtaattatacngtacaatcgagacacgaacaaccgaataactacggttaccgtaggtttacggaccgggtacggaaccgtaaggtcggtacgacccggttacgtacggtacgaacgacccgtacggtacgtcccggtaccccgtggtaaccc

SEQ ID NO: 157012 - DNA, 687 bp, Homo sapiens
  misc_feature: GYAE6OF02GXA3P.35.15.B04.1.454.CMB.1.raw
tcagtacagatcgtcacgaccggtgctcgatttagacagtatatatccgcgggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctcgtgggagatgcattcgaccaaagcaatatacttattggtaaccagcaagaagtacgacggccacggcccctgtattgatgatagtaataaagacacgtgagacgccctgacgggactcccgtgacgtcgtacttctcgtgtcctcacgtcgtacgaacggaacaacgacgtccgtacgttacgacctatcgtaggtacggtacgtccgaggacgaaggaacggaacggacgggtacttaggtaactttaacgttactacggtactaacgtacgaacggtaccgaaacgaccgaaacctaaaccgttaaacgttaccggtttacccggttagggtttaccggggaccgggtaacggggtaacccgtaacggtccgttaaccgggtaaccccggttaccggttaacgggtacccgtaacccgggtacccggaaagggtcccccggttaccccggtaccccccggtttaccggg

SEQ ID NO: 157013 - DNA, 539 bp, Homo sapiens
  misc_feature: GYAE6OF02GW7I3.35.15.B04.1.454.CMB.1.raw
  modified_base (455)..(455): a, c, t, g, unknown or other
  misc_feature (455)..(455): n is a, c, g, or t
  modified_base (534)..(534): a, c, t, g, unknown or other
  misc_feature (534)..(534): n is a, c, g, or t
tcagtacagatcgtcacgaccggtgctcgatttagacagtatatatccgtgtcaggtgcagctggtggagtctgggggaggcttggtcaagcctggagggtccctgagactgtcttgtgcagcctctggattcaccttcaatatgtatagcatgacctgggtccgccaggctcctgggaaggggctggagtgggtctcatctattggaagtagtgttgtttatacatattatggagacgcggtgggggccattcaccatctccagagacaacgccaagaacgcagtatttctgcaaatgaacagcctgcgagacgagacacggctgtgtattactgtgcgagagtgagggcaggtccggtcccccgggtttagtggacgtcgtgggcgacgagggaccacgggtcaccgtctcctcacgcctccaccgacgggcccacgtccggtcttcccccgngcccaccctcctccaacgacgccacctcgtcggggcacgcgcgcccgtggctcgccgtggcacggctaccgtccacgtntaccg

SEQ ID NO: 157014 - DNA, 676 bp, Homo sapiens
  misc_feature: GYAE6OF02JLA5M.35.15.B04.1.454.CMB.1.raw
tcagtacagatcgtcacgaccggtgctcgatttagacagtatatatccgcgggggtgggtccaggaggcagaactctgggtgtctcaccatggcctggatccctctacttctccccctcctcactctctgcacagctctgaggcctcctatgagctgacacagccaccctcggtgtcagtgtccccaggacagacggccaggatcacctgctctggaagatgactattcgaccaagctaatatacttattggtaccaagcgaagaagtacacggaccacggtcccctagtacttagagtcgagttagtaataaacgacgaacgttagaacgaaggacccgtacgacgggtacctacccgtagacgacgtaacgttctacgtcggcgttccgaacgctacgaacggaactaaacgacgtaccgtaattaccgacgtaactctaaggtacggtacgtaccgacgtacgtaagaaggtacgacggtacgtaagttaactttaaacgttacgtacgtaactacgtactaagtaaccgtaaccgaactaacccaaagtaacgtaaccgtttacccgtagggttttaccggacgggaacggtaaccgtaaggaccgttcggtaacccgtaccgttaagacccgtacgtacccgaacggtcgttaccccggaccccgtaccgg

SEQ ID NO: 157015 - DNA, 566 bp, Homo sapiens
  misc_feature: GYAE6OF02I2XHY.35.15.B04.1.454.CMB.1.raw
tcagtacagatcgtcacgaccggtgctcgatttagacagtatatatccgtgtcaggtgcagctggtggagtctgggggaggcttggtcaagcctggagggtccctgagactgtcttgtgcagcctctggattcaccttcagagactatttcatgacctggatccgccagactccagggaagggactggagtgggtctcacacatcagcagtactggacaactcccatgtactacgcagactctgtgaacgggccgattcacctattttagggacaacgcaagggtcgctgtatctgactaaatgaacacgctgagagtcgaggacacggcactctatttactgtgacaacgtagtactgtaggtggtggtccgtaggtttggttacggtcgttaacggtacgtaacggtacggtagtggtacggtcggtacgggtaccgaagggtaccgaaggtccacgtcctcgtcacgtctacccgacacggcctacgtccgttcctccccgtgccgtcctcgctccgacggcgacctccgtcggtcggccacggcgccggcgtcggagtccgg

SEQ ID NO: 157016 - DNA, 765 bp, Homo sapiens
  misc_feature: GYAE6OF02H6N6H.35.15.B04.1.454.CMB.1.raw
  modified_base (321)..(321): a, c, t, g, unknown or other
  misc_feature (321)..(321): n is a, c, g, or t
tcagtacagatcgtcacgaccggtgctcgatttagacagtatatatccgcgggggtgggtccaggaggcagaactctgggtgtctcaccatggcctggatccctctacttctccccctctcactctctgcacaggctctgaggcctctagtgagctgacacacgccctacccgtggtgtcacgtcgtccccaggacaggaccggccaaggctcaccgtgctcgtaggagtatgctatcgaacaaagcaatattactttattacggtaccagacaaggtaactcgacggaccacggcccttagtacttgatagtatagtaanaagcagtgagcgccagacggactccgagacgtacgtacttttcgacgtcggtaccctacgaacgtaccgtaccgggaagtaaacccgaaccgttacgtaccgtaaccggtttaacaaccgtaacgtaccggtaaggttacgggtaacgtaccgggaaacgaaccggaaaacggaagggtaccggtaaccggtacgttaaagttaagtttaaaccttacgtacggttaaacaaacgttacgaaacggtcgaaaaccgtaccgaaaaccgtaaaacgttaaccggttacggacccgggtttttaacggggtaagggacccggggtaaccgggtaaccgaaccggttccggttaaccggaccccggttttaaccgtaccgggtcccaaacccgggtacccgtaaaccggggtcccgttacccccccgggtacccggtttaaccccgg

SEQ ID NO: 157017 - DNA, 636 bp, Homo sapiens
  misc_feature: GYAE6OF02HFI9I.35.15.B04.1.454.CMB.1.raw
tcagtacagatcgtcacgaccggtgctcgatttagacagtatatatccgcgggggcctggggagcctagctgtgctgtgggtccaggaggcagaactctgggtgtctcaccatggcctggatccctctacttctcccctcctcactctctgcacaggctctgaggcctcctatgagctgacacagcccaccctcggtgtcagtcgtccccaggacagacggccaggatccacctgctctggacatgcattgaccaaagcaatatacttattgtaccagcagaagtcaggccaggaccctgtattgatgatagtaataaagacacgtgaagacggtcctacgaggtactcccgtaggacgcgtattctcgtgcttccgagtctacgagggaacaacgtagtaccgtacgttacgaaccgtagtcgaaggttcggaccgttaccggaacggacggaacggtaaacggacggaacggtacgtagtaacgttttaacgttacgttacggtaactaacgttaccgaacgtaccgaacgttaacccaaaccgtaaacgttaaacgtaccggttacccggtttagggtttaccgggaccgggtaacgggtaacccgtaaggtacccgttacggtaaccccggg

SEQ ID NO: 157018 - DNA, 720 bp, Homo sapiens
  misc_feature: GYAE6OF02H7JC7.35.15.B04.1.454.CMB.1.raw
  modified_base (180)..(180): a, c, t, g, unknown or other
  misc_feature (180)..(180): n is a, c, g, or t
  modified_base (213)..(213): a, c, t, g, unknown or other
  misc_feature (213)..(213): n is a, c, g, or t
  modified_base (232)..(232): a, c, t, g, unknown or other
  misc_feature (232)..(232): n is a, c, g, or t
  modified_base (311)..(311): a, c, t, g, unknown or other
  misc_feature (311)..(311): n is a, c, g, or t
  modified_base (425)..(425): a, c, t, g, unknown or other
  misc_feature (425)..(425): n is a, c, g, or t
tcagtacagatcgtcacgaccggtgctcgatttagacagtatatatccgcgggggtgggtccaggaggcagaactctgggtgtctcaccatggcctggatccctctacttcctcccctcctcactctctgcacaggctctgacggcctcctatgagctgacacagcccacccgttcggtntcgagtcgtacccaggacagaccggccaggacncaccgtgctcgtaggagangactacttcgaccaaagctaaatattacttatcggtacagacaagagtcacggcacggtcctagtatgatgatagtaanaacgcagtagacggtacgtcctaggaacggtactccgtagacgtaccgtatttccgcgtcggtaccctcgtacgtccgtagaacggacaacgtacgtacgtacgtcgtaaaccngtacgaggttacgacgtacgaggacgacggtaacggacgacgtacttagtaacttacgttacacgtacgtaacgttcgaacgaccaaacgtaacccaaccgtaaaacgttaccggtaaaccggttcccggggttttaacgggtaccggggtaacccggggtaaccgggtaacccggtaacgggttacccggtaacccgggttaaccccggtttaccgggtaacccggtacccggtaacccgggtaccccgggtaaaccggtcccgttaccccccgggggtaccctttacccgggg

SEQ ID NO: 157019 - DNA, 636 bp, Homo sapiens
  misc_feature: GYAE6OF02F5H2T.35.15.B04.1.454.CMB.1.raw
  modified_base (223)..(223): a, c, t, g, unknown or other
  misc_feature (223)..(223): n is a, c, g, or t
tcagtacagatcgtcacgaccggtgctcgatttagacagtatatatccgcgggggtgggtccaggaggcagaactctgggtgtctcaccatgacctggatccctctacttctcccccctcctcactctctgcacaggctctgaggcctcctatgagctgacacagcccaccctcggtgtcagtgtccccaggacagacggccaggactcacctgctctggagntgcattcgaccaaagctaatactacttagttcggtaccagacagaagtcgaacggccaacggtcccctagtattgatgatgtaataagacacgtgagacggtccctacgacgggtacttacccgtaggacgacgttacgttccgtcggtacggtcctaccgacgtaccgtacgaacgggaactaacgtacgtactacggttacacctatcgagtaggacgtaccgaggacgaagaacggacggagtctagtacttaagtactcgtaacaatacgaagacaacggaacctaaccgaaactaacgtaccggttcccggttagggttacgggaccggaagggtacccgtaaggcgttacgacccgttacgtacggtaccacggtaccccgtaggtcccgtccggtaccccgtaccg

SEQ ID NO: 157020 - DNA, 705 bp, Homo sapiens
  misc_feature: GYAE6OF02INBP9.35.15.B04.1.454.CMB.1.raw
  modified_base (163)..(163): a, c, t, g, unknown or other
  misc_feature (163)..(163): n is a, c, g, or t
  modified_base (228)..(228): a, c, t, g, unknown or other
  misc_feature (228)..(228): n is a, c, g, or t
tcagtacagatcgtcacgaccggtgctcgatttagacagtatatatccgcgggggggtccaggaggcagaactctgggtgtctcaccatggcctggatccctctaccttctcccctctcactctctgcacaggctcgtgacggcctcctatgagctcgaaccncaagccctacccgtcggtgtccaaggtcgtccccaggactcgaccggctaggactcaccgtgctntagggatatcacgtattcgaccgaaaagcaaaattactaagtttgtacgtaccgagcaagtaacgtcgacggccgaacgtccccgtagtagttggatacgtagtagtaagtaaacgactaccgttaagacggtacgtccctaacggaacgggtaccgtacccgttagacgtcgaaactttccgtacgttacggacgttccctacgtaccgcgacgggtaaccaactacggttaccgacgtttacggaactactacgtaccggtaggtaccggtacgtacggaaacgacgaacggacggttacgacgtacgtaagttaagtacgttacgttaacgactaacgtacgacgacgaaccgttaacaaccgttaaagtccgtaacgttcgttacgggaccggagaaccggttaagccggtacgtacggttcccgaacggttcgaaacccgttcgaacgtccgtaccgtcccgtcgttacccg

SEQ ID NO: 157021 - DNA, 597 bp, Homo sapiens
  misc_feature: GYAE6OF02FXUMI.35.15.B04.1.454.CMB.1.raw
  modified_base (174)..(174): a, c, t, g, unknown or other
  misc_feature (174)..(174): n is a, c, g, or t
tcagtacagatcgtcacgaccggtgctcgatttagacagtatatatccgcggggggggtccaggaggcagaactctgggtgtctcaccatggcctggatccctctacttctccccctcctcactctctgcacaggctctgaggcctcctatgagctgacacagccaccctggtntcagtgtccccaggacagacggccaggatcactgctctggagatgcatgccaaagcaatatacttattggtaccagcagaagtacacggccgacggccctggtacttgatgatgtaataaagactactagagacggaccctcgaagggactcccgtgacggtacgtatttcgtctcgggcctccgaagtcctacgacgggaacaacgagtcctaagtttcgaacctatacgagtacggagtacccgaggccaagaaacgcgaggctagatttactacttgtactaagtacacgactaacgaccaaccgtaaactaaacgttactacccggttagtttacgggacggtagggaccacggtcgtacgtaccggtccgtaacgtacgacgtacccggaaccgtccccaaccctacgtgtaaccccg

SEQ ID NO: 157022 - DNA, 713 bp, Homo sapiens
  misc_feature: GYAE6OF02HQ2XB.35.15.B04.1.454.CMB.1.raw
tcagtacagatcgtcacgaccggtgctcgatttagacagtatatatccgcgggggggtccaggaggcagaactctgggtgtctcaccatggcctggatccctctacttctccccctcctcactctctgcacaggctctggaggcctcctatgacgctgacacagcccaccctcggtgtcagtcgtccccaggacaggacggccaggatcacctgctcgtggagatgacattcgaccaaagcaatatacttattcggtacagcaggaagtcaggccacggcccctgtacttgactagacttaggtaataaagacactgagacggccctagacgggtactccgtagacgtcgtacttctcgtgcctccgtaagcgttacgaacgggtaaccaacgtacgtaccgaacggtttacgaaccctagttaccggagggttacggacgtacccggaaggtacgaaaggaacggaaccgggaacgggtacgttacgttaagtttaacgtttaccacggtaactaacgtacgaacgaacgtaaccgaacctaaaccgaaacgtaaacgttacccggttacccggttacgggtttacgggaccgggaaccgggtaaccgtaacggtaccgtacccgggtaacccggtaccgttaccgggtacccggaaccgaacccgggaaccggttcccggtaccccggtaccccccgttaggttaccccgg

SEQ ID NO: 157023 - DNA, 731 bp, Homo sapiens
  misc_feature: GYAE6OF02I7NC7.35.15.B04.1.454.CMB.1.raw
tcagtacagatcgtcacgaccggtgctcgatttagacagtatatatccgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaagcaatatacttatcggtaccagcagaagtcaggccaggccctgtattgatgatgtaataagacacgtgagacggccctgagggactccgtagacggcgtattcgtctcggcctccagtccgtacgtaggggaccaaacgagtaccgtaacgtttcgaacctaatacgacgggttaggaacggttcccgaacgggtacgaaacgggaaacgggacgggtaaacgggaccttaaggttaagttttaactttaaccgttacgttaacgtaaactacctaaggaaccgaacggaaaccctaaacccaaaacgttaaaccgtttaaccgggttaccccgggtttaaggggttttaccggggaccgggggtaaaccgggtaacccggaaagggtccccgttaacgggttaaacccccggttaccggttaaccgggtaacccgttaccggaacccccggtaaacgggtcccccggttacccggtacccccccggtttaacccggg

SEQ ID NO: 157024 - DNA, 681 bp, Homo sapiens
  misc_feature: GYAE6OF02FOBJZ.35.15.B04.1.454.CMB.1.raw
  modified_base (218)..(218): a, c, t, g, unknown or other
  misc_feature (218)..(218): n is a, c, g, or t
tcagtacagatcgtcacgaccggtgctcgatttagacagtatatatccgcggggggggtccaggaggcagaactctgggtgtctcaccatggcctggatccctctacttctcccctcctcactctctgcacaggctctgaggcctcctatgagctgacacagccaccctcggtgtcagtcgtccccaggacagacggccaggatcacctgctctgganatgctattcgaccaaagcaatatacttattcggtaccagacagaagtcaggccaggcccctgtattgatgatgtaataacgacactaggagacggccctacggacgggtactcccgtagacgcgtattcgtacgtcggtcctaccacgtccgtacgaacggggtaaccaacgtaacggtaccgtaacggttaccgaacctacgtacgaagggtcgggtaacgttaccggaaggtaccgaaggtaaacggtacgggacgtacgttacgtaacttttacgttacgagttactaacgttcgaacgactaacggaaccaacctaaactaaacgttaccgttaccggtttagggttacgggtacgggaccgggtaaccaagggtccgtaacggtacccggttacggtacggtaccgtaaccggaccggtaaccggtcccgtacccggttccccgtaccggttaccccg

SEQ ID NO: 157025 - DNA, 697 bp, Homo sapiens
  misc_feature: GYAE6OF02GFBR1.35.15.B04.1.454.CMB.1.raw
tcagtacagatcgtcacgaccggtgctcgatttagacagtatatatccgcgggggtgggtccaggaggcagaactctgggtgtctcaccatggcctggatccctctacttctcccccctcctcactctctgcacaggctctgaggcctcctatgagctgacacagcccaccctcggtgtcagtcgtcccccgaggacaggaccggccgagggactccacctggcctcgtggagatgcattgaccaagacaatattacttagttcggtaccagcagaacgtcgacggccgacggcccctgtattgagtagatagtaataaacgacacgtaggagacggtaccctacggaacgggactcccgtaggacgtccggtatttccgtcgtcgggtacctacccgacgcgtaccgtaacggggaaccaacggtacgttaccgtacgttacgaacccgagtcgtaacggttacgggacgtacggaggaccgaagggaacggacggaggttaacgtagtaactttacttacgtcgtactaacgtacgaagtaccgaacgaaccaacctaacgttaaccttaccggttccgggttaggttaccgggagggaaccgggtaaccgacggtaccggtaccggtaaccggttaccggtaccggcgtaaccggacccggtaaccggtcccgtaccccggtcccggttacccg

SEQ ID NO: 157026 - DNA, 752 bp, Homo sapiens
  misc_feature: GYAE6OF02FG4U0.35.15.B04.1.454.CMB.1.raw
  modified_base (220)..(220): a, c, t, g, unknown or other
  misc_feature (220)..(220): n is a, c, g, or t
tcagtacagatcgtcacgaccggtgctcgatttagacagtatatatccgcgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgganatgcattgccaaagcaatatacttattggtaccagcagaatcaggccaggcccctgtattgatgatgtaataaagacactgagacggccctgagggtactcccgtgacgcgtattcgtcgtggtcctccgagcgtacgaacggggtaaccaacgtacgtctaccggtttacgaccctaactacgtaacgggttcgggtaacgtcccggtaaagggacccgtaaagggaaaaccgggtaaccgggtaacgggtaccgtttaacgggttaaactttttaacgtttaaccgtttacggttaacctaaacgttaccgtaaaccggtacctaaaccggtaaaccctaaaccccgtaaaaccgtaaaaccgttaacccggtttaaccccgggtttagggttttaaccggggaccgggtaaaccggggaccctaaaacgggtcccgttaaccgggtacccgttacccggttaacggtaccggtaaccggtaccccggttaaccgggtcccggttaccccggttaccccccgttaccggg

SEQ ID NO: 157027 - DNA, 630 bp, Homo sapiens
  misc_feature: GYAE6OF02JH4ET.35.15.B04.1.454.CMB.1.raw
  modified_base (248)..(248): a, c, t, g, unknown or other
  misc_feature (248)..(248): n is a, c, g, or t
  modified_base (333)..(333): a, c, t, g, unknown or other
  misc_feature (333)..(333): n is a, c, g, or t
  modified_base (339)..(339): a, c, t, g, unknown or other
  misc_feature (339)..(339): n is a, c, g, or t
  modified_base (349)..(349): a, c, t, g, unknown or other
  misc_feature (349)..(349): n is a, c, g, or t
  modified_base (353)..(353): a, c, t, g, unknown or other
  misc_feature (353)..(353): n is a, c, g, or t
  modified_base (357)..(357): a, c, t, g, unknown or other
  misc_feature (357)..(357): n is a, c, g, or t
  modified_base (372)..(372): a, c, t, g, unknown or other
  misc_feature (372)..(372): n is a, c, g, or t
  modified_base (375)..(375): a, c, t, g, unknown or other
  misc_feature (375)..(375): n is a, c, g, or t
  modified_base (418)..(418): a, c, t, g, unknown or other
  misc_feature (418)..(418): n is a, c, g, or t
tcagtacagatcgtcacgaccggtgctcgatttagacagtatatatccgtggtcaggtgcagctggtggagtctgggggaggcttgggtcaagcctggagggtccctgagactgtcttgtgcagcctctggattcaccttcaggagactatttcatgacctggatccgcagactccagggaagggtctgggagtgggtctcgacacatcgagcagtactggcaagtcccatgtactacgcagactctntgaagggccattcacctattttaggactaacgtccgaaaggttcgctgtatcttgccaatgaacagcctgacgagtcggagtacncgccanctattaactntagnaagngtctgtaacgttggnggntagttggtggctacggtacgtacgacggtgtagggtactcggngggacgagggtaccaaacggtcaccgttctcccgtacgtcgaccttaccgaccgaacgggtcccgtaacgtccgggtacccttccccgttcggccgtccccgttagtcccggtaccccgtaacgggaccgttacccggtcccttacggggtaccgggggtaccgttaccggaaccggtcccgggtaacccgggtcgggaaccccttccgggg

SEQ ID NO: 157028 - DNA, 624 bp, Homo sapiens
  misc_feature: GYAE6OF02H6U3N.35.15.B04.1.454.CMB.1.raw
  modified_base (239)..(239): a, c, t, g, unknown or other
  misc_feature (239)..(239): n is a, c, g, or t
  modified_base (288)..(288): a, c, t, g, unknown or other
  misc_feature (288)..(288): n is a, c, g, or t
  modified_base (338)..(338): a, c, t, g, unknown or other
  misc_feature (338)..(338): n is a, c, g, or t
  modified_base (591)..(591): a, c, t, g, unknown or other
  misc_feature (591)..(591): n is a, c, g, or t
tcagtacagatcgtcacgaccggtgctcgatttagacagtatatatccgtgtcaggtgcagctggtggagtctgggggaggcttggtcaagcctggagggtccctgagactgtcttgtgcagcctctggattcaccttcagagactatttcatgacctggatccgccagactccagggaagggctggagtgggtctcacacatcagcagtactggcaatcccatgtactacgcagactntgtgaacggccgattcacctagttttaggactaacgccgtaagggttcnctgtatctgacaaatcgaacacgcctagagagtcgacggacgacggaccngtacctatttactgtgtacgaagagttctagtaggttgggtggtcgtagtttcgggttaggccgtttacgggtaactacggtaacggttagtcggtacgttcggtacggggaccgaacgggaccgtaacggtcaaccgttctaccgtcgacgtccgttaccgaacccgtaacgggtccccagttacccgttcccttcccggtcgccgcccgtcgccgtaccgacggcgaccgtccgtaccgggtcggggaccncggaccggccggtacccggtcgggcgtaccggg

SEQ ID NO: 157029 - DNA, 614 bp, Homo sapiens
  misc_feature: GYAE6OF02IYEB1.35.15.B04.1.454.CMB.1.raw
  modified_base (310)..(310): a, c, t, g, unknown or other
  misc_feature (310)..(310): n is a, c, g, or t
tcagtacagatcgtcacgaccggtgctcgatttagacagtatatatccgtgtcaggtgcagctggtggagtctgggggaggcttggtcaagcctggagggtccctgagactgtcttgtgcagcctctggattcaccttcagagacttatttcatgacctggatccgccagactccagggaaggactggagtgggtctcacacatcagcagtactggacaatcccatcgtactacgcagactctgtgaacgggccgattcacctattttagggacaacgaccaagggttcgctgtatctgacaaatgaacngcctagagagtcgaagacgacggccatctattactgtcgacagagtctgtagtggtgctgttgttgacgtacggtacgtacgtacggttagtgggacgttcggtcgggacgtaaacgggaccgtaacgggtacctaccgttaccgtccgtacgacgtaccttacccgaacgaccgggtccctacgttccggtccctttccccggcggtcccgtacccgtcgccgtacccgacgggaccgtcccgtaccgttccggtcggggacctaccgaccggcccgggtacccggtccgggtccttaccggg

SEQ ID NO: 157030 - DNA, 702 bp, Homo sapiens
  misc_feature: GYAE6OF02JCP3N.35.15.B04.1.454.CMB.1.raw
tcagtacagatcgtcacgaccggtgctcgatttagacagtatatatccgcgggggggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggactcacctgctcgtggagatgctattcgaccaaagcaatattaacttagttggtaccagacaagaagtcacggccacggtccccttagtacttagatagtatagtaataaagactactagagacgccgtacgaggtctcccgtgacgtacgtactttctacgttcggcctaccgagtccgtacggaacgggtaaccaaacgacgtaccgtacggtttacgaaccctagtacgaggttaggaccgtaccgaaggaccgtaaaggaacgggaacgtacgggtacgttaggttaactttaacgttaccttaggttaaccaacgttacgaacgaccgtaacgaacccgaaacctaaacgttaaacgttacccggttacccggtttacgggtttacggggaaccggggtacggtaacccgtaaggtccggtaacccggtaccgttaccgtaacgggtaccgaaccgtacccggacgtcccgtcccgtaccccggttcgtaccccg

SEQ ID NO: 157031 - DNA, 678 bp, Homo sapiens
  misc_feature: GYAE6OF02GCQX9.35.15.B04.1.454.CMB.1.raw
tcagtacagatcgtcacgaccggtgctcgatttagacagtatatatccgcggggggggtccaggaggcagaactctgggtgtctcaccatggcctggatccctctacttctccccctcctcactctctgcacaggctctgaggcctcctatgagctgacacacgcccaccctcggtgtcagtcgtcccaggacagacggccaggatcacctgctcgtggagatagctattacgacctaaagactaaatataacttagttcggtacagcaagaagtcgacggccgacgtccctgtattgagtgatagtaataaagtacacgtagacgacggccctaggacggtactaccgagtacgcgtactttccgtcgtcggcctaccgtacgtaccgtacggaaacgggtaacctaaaccgtacgttaccgtaaccgtttacgaaccctagtacggaaggtcgggacgtaccggaaggtacgaacggaacggaacggaggtcttaagtaagttttactacttagtaactactacgagtaccgtaagaacctaacccaaagttaaccgttaccggttacggttagggttcggggacgggttacggacgtaacggtcccgtacggtaccggtaccgtaggtaccgaccggtaccggtaccggtccgcccggtaccccggtcgtacccg

SEQ ID NO: 157032 - DNA, 731 bp, Homo sapiens
  misc_feature: GYAE6OF02IVWQU.35.15.B04.1.454.CMB.1.raw
  modified_base (193)..(193): a, c, t, g, unknown or other
  misc_feature (193)..(193): n is a, c, g, or t
  modified_base (273)..(273): a, c, t, g, unknown or other
  misc_feature (273)..(273): n is a, c, g, or t
  modified_base (420)..(420): a, c, t, g, unknown or other
  misc_feature (420)..(420): n is a, c, g, or t
  modified_base (576)..(576): a, c, t, g, unknown or other
  misc_feature (576)..(576): n is a, c, g, or t
tcagtacagatcgtcacgaccggtgctcgatttagacagtatatatccgcgggggggtccaggaggcagaactctgggtgtctcaccatggcctggatccctctacttctcccctcctcactctctgcacaggctctgaggcctctatagagctgacacagccacccgtggtgtcagtcgtaccccaggaccncggacgccaaggatacctacctgcctactggaagatacgctagttacgacaaagctaatattacgttagttcggtaaccngtacgaaggacgttaccaacggtccgtaaccggcccttagtaacgttagtaacgttggaagttacgttaaagtaaaacgccgtaacgtacggtagaccggttacccttcgggaacgggtacttccccaaggtaggacgtaactttanccggtacggtacctacgacgtacgacgggttaaacgacctaaagtaccgtaccgttacgtacgaaacccttagtacgtacgtacggacgtacccgagacgtaacgaacgaccgtaggtcttaagtacttaagttacccgtagttaactaacgttanacgtaacctaacgaaccgaaccgttaacgaacgtttaaccggtaccgtttaggtccgggtaaccgggacgaaccgtaccgaaccggttaacgacccggtttaacgacgggtactaccgttaccgacggacccgtccggtacccgtccggttaccc

SEQ ID NO: 157033 - DNA, 574 bp, Homo sapiens
  misc_feature: GYAE6OF02GSEFD.35.15.B04.1.454.CMB.1.raw
  modified_base (240)..(240): a, c, t, g, unknown or other
  misc_feature (240)..(240): n is a, c, g, or t
  modified_base (306)..(306): a, c, t, g, unknown or other
  misc_feature (306)..(306): n is a, c, g, or t
  modified_base (352)..(352): a, c, t, g, unknown or other
  misc_feature (352)..(352): n is a, c, g, or t
tcagtacagatcgtcacgaccggtgctcgatttagacagtatatatccgtgtcaggtgcagctggtggagtctgggggaggcttggtcaagcctggagggtccctgagactgtcttgtgcagcctctggattcaccttcagagactatttcatgacctggatccgccagactccagggaagggactggagtgggtctcacacatcagcagtactggcaatcccatgtactacgcagactntgtgaaggccgattcacctattttagggacaacgccgaagggttcgctgtatctgcaaagtgaacngcctagagagtcgaggacacggccatctattactgtagcaagtgtntgtagtggtgcgtagttgttggacttacggtacgtacggacggtagtcggacgttcgtcggggaccaaggggaccctaaggtccgtaccgtcgtacctcgacgtccttacccgaaccgtacgggtacccagttcccgtccttcccccgtggcccgtcccctgccctcgacggtccgctaccgtcgtcggggaccacgacggccggtcccggtcggcctccgg

SEQ ID NO: 157034 - DNA, 697 bp, Homo sapiens
  misc_feature: GYAE6OF02GYQ6S.35.15.B04.1.454.CMB.1.raw
tcagtacagatcgtcacgaccggtgctcgatttagacagtatatatccgcgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggactcacctgctctggagatgcattgaccaaagcaatatacttattggtaccagcagaagtcaggccacggccctgtattgatgatgtaataagacactgagacggccctagacgggtactcctggacgcgtacttcgtcgtggctcgagtcgtacgacggtaacaacgtacgtactacggttcgaaccgtatcggtaggtacggacgttacccgaagggtacaaagggtaaacggacgggtaagggtaccgtaggttaactttaacgttaacgtacgttactaaacgttacgaacggtacaaaccgtaaccaacccgtaaaacgtaaacggttaccgtttacccgggttacggtttaacggggtaccgggtaaacggggtacccgtaaaaacggtccgttaaccgggtaccccggttaaccgttaccgggtaaccgtaacccggtacccggtaaacgggtccccgttaccccgggtacccccgtttacccggg

SEQ ID NO: 157035 - DNA, 809 bp, Homo sapiens
  misc_feature: GYAE6OF02GZHS2.35.15.B04.1.454.CMB.1.raw
tcagtacagatcgtcacgaccggtgctcgatttagacagtatatatccgcgggggtgggtccaggaggcagaactctgggtgtctcaccatggcctggatccctctacttctccccctcctcactctctgcacaggctctgaggcctcctatgagctgacacagccaccctcggtgtcagtcgtccccgaggacagaccggccaggatcacctgctcgtgagatgcatcgaccaaagcaatattacttattaggtaccagtacagaagtcgacggacccacggccccgttgttacttagactagtatagttaaagtaaacgactacgtaggacggtaaccggtccccgtacggacggtaccgttcccgtaggtaacgtacgttacttcggttcgtacggccgttacgacgtcgtacggaacggtaaccaaacgtacgtaccgttaacggttacaaccgtacgtacggtacggtacggggtacccgtaccggaacggaaccgaaagggaaaccggacgggtaccggtaacggtttaacggttaagttttaaacgttacgtttaacgttacgtaaacgttaccggtaaacgtacggaaacccgtaaaccctaaaaccctaaaaccgttaaaccggtttaaacccgggttacccgggttttacggggttaaacgggtacccgggggtaaaccggtaacccggtaacgggtaacccggtaaccgggtttaaccccggtaccggtttaaccggtaccggtaacccggaccccggttaaccggtacccgtaccccggttaccccggttaccccgg

SEQ ID NO: 157036 - DNA, 640 bp, Homo sapiens
  misc_feature: GYAE6OF02IDRU0.35.15.B04.1.454.CMB.1.raw
  modified_base (177)..(177): a, c, t, g, unknown or other
  misc_feature (177)..(177): n is a, c, g, or t
tcagtacagatcgtcacgaccggtgctcgatttagacagtatatatccgcggggggtgggtccaggaggcagaactctgggtgtctcaccatggcctggatccctctacttctccccctcctcactctctgcacaggctctgaggcctcctatgagctgacacagccacccttcggngtcagtcgtcccaggacagcggccaggatcactgctcgtggagatgactatacgacaaagcaatattacttattcggtacagcagaagtcacggcacggcccctgtatgatgatagtaataaaagacgaacagtaaggcggacccctagagggactccgtagacgcgttacttacgtcgtgaccttacgacgctacgaggaaccaacgacgtactacgttacgaacctagtacgagtcggtacgtcgaaggacgaacgtaaggacgaggtacctagtacgttaatttcgtacgtactaaacgcgtaacgacgtaaacgaccaaccgtaaactaaacggtacgttacccgttagggtttacgggacgggtaacgggtaaccgaacgtacgttacggtaaccggttcccgtaaggttaccgaccggttaaccgaacgggttcctcccgggtacccccgttaccgg

SEQ ID NO: 157037 - DNA, 499 bp, Homo sapiens
  misc_feature: GYAE6OF02FNEJY.35.15.B04.1.454.CMB.1.raw
  modified_base (365)..(365): a, c, t, g, unknown or other
  misc_feature (365)..(365): n is a, c, g, or t
tcagtacagatcgtcacgaccggtgctcgatttagacagtatatatccgcgggggggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctctggagatgcattgaccaaaagcaatatacttattggtaccagcagaagtcaggccaggcccctgtatgatgatgtataaagacactgagacggccctgagggactccctgagcgtattctctggctccagctcgaggacaacagtcacgttnaccatcagtggatcgagcagaagacggaggctgtattattacgtgtacaatcagcagacacaacatacgtccgtgttgcggaggacagctgaccgtcgtaggacacgaccgacgactccgtccccgtgtacccg

SEQ ID NO: 157038 - DNA, 692 bp, Homo sapiens
  misc_feature: GYAE6OF02I0BJ9.35.15.B04.1.454.CMB.1.raw
  modified_base (126)..(126): a, c, t, g, unknown or other
  misc_feature (126)..(126): n is a, c, g, or t
tcagtacagatcgtcacgaccggtgctcgatttagacagtatatatccgtgtcaggtgcagctggtggagtctgggggaggcttggtcaagcctggagggtccctgagactgtcttgtgcagcctntggattcaccttcagagactattcatgacctggatccgccagactccgaggggaaggactggagtgggtctacacacatcagcagtactgcaacgtcccatcgtactacgacagtctcgtgtaggaacggcctattacgaccttaagttttacggaaccgaacgtaccgtaagggttccgtacgttagtaacttcgtacgacctaaagtacgtaaccacgtaccgtagaggtacgtacggacgaccgacgaccatacgttaagttacctggtagactaaggtacgtcgttagtacggttggtcgtagttgtttaggtcggtcgtaacggttaccgtacggtaccgtaggtcggtaccgtagggtaccgggtaaccgagggtaacccgtagggtaccgtaccgtaccgttccacgtaccgtaccgttacccgaccggtaaccgtcccgtaccgttcccgtttacccgttccccggtaccggccgtacccggtcgaccgtacccgcggaaccgtccggtaccgtccggtacggggacctacggtccgaccggcccggtcgccgtccgg

SEQ ID NO: 157039 - DNA, 567 bp, Homo sapiens
  misc_feature: GYAE6OF02I6RL4.35.15.B04.1.454.CMB.1.raw
  modified_base (491)..(491): a, c, t, g, unknown or other
  misc_feature (491)..(491): n is a, c, g, or t
tcagtacagatcgtcacgaccggtgctcgatttagacagtatatatccgtgtcaggtgcagctggtggagtctgggggaggcttggtcaagcctggagggtccctgagactgtcttgtgcagcctctggattcaccttcagagactatttcatgacctggatccgccagactccagggaagggactgggagtgggtctcacacatcagcagtactggcaatcccatgtactacgcagactctgtgaagggccgattcacctattttagggacaacgccaagggttcgctgtatctgcaaatgaacagcctgagagtcgaggacgacggcatctattactgtgcaagagtctgtagtggtgctagttgtggtcgtacggtactaacggtaggtagtggacgtgtcggggaccgaagggaccgtaaggtccgtaccggtcctacctcgtacgtcctacccgaccgaacggcctacgtccggtaccttccccgnggccgtcccgtgtcctaccgtacggccgacgcccgttcggtcggggactaccgcggccggcccgtgggcctccggg

SEQ ID NO: 157040 - DNA, 543 bp, Homo sapiens
  misc_feature: GYAE6OF02I3XP7.35.15.B04.1.454.CMB.1.raw
  modified_base (373)..(373): a, c, t, g, unknown or other
  misc_feature (373)..(373): n is a, c, g, or t
  modified_base (395)..(395): a, c, t, g, unknown or other
  misc_feature (395)..(395): n is a, c, g, or t
  modified_base (403)..(403): a, c, t, g, unknown or other
  misc_feature (403)..(403): n is a, c, g, or t
  modified_base (413)..(413): a, c, t, g, unknown or other
  misc_feature (413)..(413): n is a, c, g, or t
  modified_base (425)..(425): a, c, t, g, unknown or other
  misc_feature (425)..(425): n is a, c, g, or t
  modified_base (440)..(440): a, c, t, g, unknown or other
  misc_feature (440)..(440): n is a, c, g, or t
  modified_base (443)..(443): a, c, t, g, unknown or other
  misc_feature (443)..(443): n is a, c, g, or t
  modified_base (454)..(454): a, c, t, g, unknown or other
  misc_feature (454)..(454): n is a, c, g, or t
tcagtacagatcgtcacgaccggtgctcgatttagacagtatatatccgcgggggtgggtccaggaggcagaactctgggtgtctcaccatggcctggatccctctacttctccccctcctcactctctgcacaggctctgaggccctcctatgagctgacacagccaccctcggtgtcagtcgtccccaggacagacggccaggactcaccgtgctcgtggagatgctatcgaccaaagctaatactacttagttacggtaccagacaagaagtcgacggccgacggccctagtacttgatgatgtaataagacactagagacggtacctacgacgggtctaccgtagacgacgtacttcgtactggctcgnctcgaggacacgagtacacgtnacatcagngagtcacganagaacgacgagntagtaattatacgtntanactcgagacanaaccacaagtactacggttacgtagttacgggagacggtacacgtcgacgtacgcgtacgcgacgaccgtacgccgtccgcccgtaccg

SEQ ID NO: 157041 - DNA, 750 bp, Homo sapiens
  misc_feature: GYAE6OF02G8BN5.35.15.B04.1.454.CMB.1.raw
  modified_base (734)..(734): a, c, t, g, unknown or other
  misc_feature (734)..(734): n is a, c, g, or t
tcagtacagatcgtcacgaccggtgctcgatttagacagtatatatccgcgggggtgggtccaggaggcagaactctgggtgtctcaccatggcctggatccctctacttcctccccctcctcactctctgcacaggctctgacggcctcctatgagctgacacacgcccacccgtggtgtcagtcgtccccgaggaccacgaccggccaaggactccaccgtgctcgtggacgatgctattcgaaccaaagactaatattacttagttacggtaacagacaaggtaacgtcgacggccgaccggtccccgttagttagttaggtatgtaagttagttaaaacgtaaacgaccaagttacgggaacgtaccggtaccccttaggaaccgggtacctacccgttaggacggtaccgttaactttccgtacggtcgtacccgtacccgtaacgttccgaacggaaccgggaaacctaacgtacgttacgtaccggttaccgacctaacgtacggtaggtcggtaccgtacggaacggaccgtaaagggaacggtaacggtacggaaccttaggttaaactttaacgtttaccgtagtactaaacgttacgaaccgacgtaaacgaaaccctaaccgaaacgttaacgtaccggttaccggttaggttacggacgggtacgaaccggtcgtacgtacgtaccggtaccgtaggtacccaccgtaacgccggtacccncgtaccccgttaccgg

SEQ ID NO: 157042 - DNA, 641 bp, Homo sapiens
  misc_feature: GYAE6OF02JFIE0.35.15.B04.1.454.CMB.1.raw
  modified_base (160)..(160): a, c, t, g, unknown or other
  misc_feature (160)..(160): n is a, c, g, or t
  modified_base (234)..(234): a, c, t, g, unknown or other
  misc_feature (234)..(234): n is a, c, g, or t
  modified_base (584)..(584): a, c, t, g, unknown or other
  misc_feature (584)..(584): n is a, c, g, or t
  modified_base (608)..(608): a, c, t, g, unknown or other
  misc_feature (608)..(608): n is a, c, g, or t
tcagtacagatcgtcacgaccggtgctcgatttagacagtatatatccgcgggggtgggtccaggaggcagaactctgggtgtctcaccatggcctggatccctctacttctcccctctcactctctgcacaggctctgaggcctctatgagctgacacncgcccacccgtggtgtcaggtcgtccccgaggacaggaccggccaggactccgaccgttgccgtcgttgggaanagttcggactagttacgacccgaaaagtccaaagttattaaccttagtttcggaacccagaccgaagtaacgtcgaacggccgaacggtcccctagttacttgatagtattagtaactaaaacgctaacgtcggagacggaccctagacgggtaacttcccgtggacgtacggtacttcgtcgtacggtccttaccgagccgtacgaggaacctagacgtaccgtacgtacaccgtagtcgaggtacgtacgtacgacggtacgaaggacggacgacggttaactggttaacttagttacctagtactaagtcacgtcacgaacaccaagtacgtcgtaccgtgttacgnggtacgacgaacgtgacgtaccgngtacgacgactccgagtccgtaccgcccggtac

SEQ ID NO: 157043 - DNA, 940 bp, Homo sapiens
  misc_feature: GYAE6OF02GW3RH.35.15.B04.1.454.CMB.1.raw
  modified_base (103)..(103): a, c, t, g, unknown or other
  misc_feature (103)..(103): n is a, c, g, or t
tcagtacagatcgtcacgaccggtgctcgatttagacagtatatatccgcgggggggtccaggaggcagaactctgggtgtctcaccatggcctggatccctntacttctcccctctcactctctgcacaggctcgtgacgtcctctagtgacgtctcgacacaccgccctacccgttcggttctcgacggttcccgtaccccgaggaccgacggtacccggaccgaagggtacctacccgtaccgttcggtaccttcggtaggggaacttacgttcggaaccttaagttaccggaaaacccgtaaaaggtaccgttaaaatttaactttaaccgttttaacggtttaccgggtaacctacgaacgtaaaacgtaaccggtaccgaaccggtacccggacccgggttaccccgttagtttaagtacgtagttagtaagttagtaaagtaaacgaccgtagtaggaaccggtaccggtaccccgtagggaaccggtccgtaccggtagtacggtccttacgttccgtacggtacgtccctacgtacggtaccgtacgggaaccggtaaccaacggtacgtaccgttaccgttaacacgtaacgtacggtacgggtacgggtacgtaccggtaacggaacgaaaggggaacgaaccggtcgggttaaccttaagggttaaccttttaggtacctttacggtaaacttacgtccggaaacgacggttaaaacccgaacctaaaccggtaaaacttaagggttacccccggtttacggtttaacgggggtaccgggtaaccgggggtaacccggtaaaccgtaccgggttacccgttaacccgggtacccgtttaaccggggttaacggaaccccggttaacccgggaaccgggtaaccccggttcccggttacccccggtaccccggtaaccggttaaccccg

SEQ ID NO: 157044 - DNA, 766 bp, Homo sapiens
  misc_feature: GYAE6OF02IISGK.35.15.B04.1.454.CMB.1.raw
  modified_base (227)..(227): a, c, t, g, unknown or other
  misc_feature (227)..(227): n is a, c, g, or t
tcagtacagatcgtcacgaccggtgctcgatttagacagtatatatccgcggggggggtccaggaggcagaactctgggtgtctcaccatggcctggatccctctacttcctccccctctcactctctgcacaggctctgaggcctcctatgagctgacacagcccacccttcggtgtacagtccgtccccaggacacggacggccaggatccacctgctcgtgganatgctagttcgaccaaagctaatacttacttagttacggtaaccagacgaagaacgtcgacggaccacggtccccttagttaagtcgtaatgtaattagtaaacgttaaagacgtacgtagacggaccgtcctacggaggtacctaccgtaggtaacgtacgtacttccgtcgtcggacctccgaacgtccgtaacggaacggtaaccaacgtacggtaccgtaacgttccgaaccttacgtacgtacggtaccgggtacgtacccgaaggtacgaaacggtaacggacgggtaggtacgttaacgtttacttaacgtttacgttacgaactaacgtacgaacgtaccgaaacgaacctaaaccgtaaacgtaccgttaaaccggttccggttccgggtttaacggggaccggggtaacggtacccggttaacgggcccgttaacggttaccccgggttaaccgaccggttaccggaacccggtacccgggtaacggttacccccggtaccccggttaccccggttaccggtaaccccg

SEQ ID NO: 157045 - DNA, 755 bp, Homo sapiens
  misc_feature: GYAE6OF02HZ0ME.35.15.B04.1.454.CMB.1.raw
tcagtacagatcgtcacgaccggtgctcgatttagacagtatatatccgtgtcaggtgcagctggtggagtctggggggaggcttggtcaagcctggagggtccctgagactgtcttgtgcagcctctggattcaccttcagagtactatttcatgacctggactccgccagactccgagggaggactggagtggtctcacacatcagcagtacgtgactaactcccgtaatcgtaactacgacaacgtacctcgtaggtaggaacgggacctacttccgtaaccttaggttttaacgggacaaccgaccggtaagggttaccgcgttagtacttctacgaactaaagtacgaacgacgtaccgtaggaggtaacggtaccggaagtaaccggaaccggacctaacgttacttaacgttacgttaggtacgacgtaacggtacgttcgttaaggttacgggtgggtacggtcgtttaggtttcgggttacggtaccgttacgggttaaccgtacggtaacgggtagttacggtaccggtacgggtcgggaccgaaacggtaccgtaacggtaccacccgttccgtccgtacctcgtacccgtaccgaccgtaacccggtcctacggttcccgttacccgtaccccggtcggtaccccgtccgtaccgccgtaccggacggtaccgtcccgtaccggttccggaccgggtccgaccggtaccggtaccccggtcgggtaccgtccggttacccggg

SEQ ID NO: 157046 - DNA, 698 bp, Homo sapiens
  misc_feature: GYAE6OF02G3FV4.35.15.B04.1.454.CMB.1.raw
  modified_base (223)..(223): a, c, t, g, unknown or other
  misc_feature (223)..(223): n is a, c, g, or t
  modified_base (362)..(362): a, c, t, g, unknown or other
  misc_feature (362)..(362): n is a, c, g, or t
tcagtacagatcgtcacgaccggtgctcgatttagacagtatatatccgcgggggggtccaggaggcagaactctgggtgtctcaccatggcctggacccctctacttcctccccctcctcactctctgcacaggctctgaggcctctatgagctgacacagcccaccctcggtgtcagtcgtccccgaaggacaggacggccaggactcactgctgtgggantgactattgaccaaagcaattattaacttagtacggtaccagtacaagaacgtcgaacggccaacggccccttgtaagttagatggaataggtaataaagacgaacgtaggacgacgaccgtacgagggactccgtagngtacgtattacgtcgtagcctaccgagtacctaacgagggaaaccaagtacgtacgaaccgtagaccctaagtccgtaaggttacgggacgttaacgacggagaaacgaaacgtacggacggtcaaggttaagtttacttaacgtacgtaactacgtacgacgaacgtaacaaccgaaacctaaactaacgttacgggtaccgtttacgggttacggtacgggaaccgggtaacctacggtacggtaccgtaacccggttacgttaaccggaaccgtaaccggacccgtaacggtacccgttacccggtacccccgttacggtcccgttaaccccg

SEQ ID NO: 157047 - DNA, 799 bp, Homo sapiens
  misc_feature: GYAE6OF02J1EMF.35.15.B04.1.454.CMB.1.raw
  modified_base (178)..(178): a, c, t, g, unknown or other
  misc_feature (178)..(178): n is a, c, g, or t
  modified_base (230)..(230): a, c, t, g, unknown or other
  misc_feature (230)..(230): n is a, c, g, or t
tcagtacagatcgtcacgaccggtgctcgatttagacagtatatatccgcgggggggtccaggaggcagaactctgggtgtctcaccatggcctggatccctctacttcctccccctcctcactctctgcacaggctctgaggccctcctatgagctgacacacgcccaccctcggtntcagtcgtcccccaggacacggacggccaggactccacctcgctcgtggganagtgctattcgaccaaagctaattattacttagtcggtaaccagcaaggaacgtcgacggtaccgacggtaccccctaggtacttgacttggacttaggtaaactaaagacgtactaggacggtaccggtccctaggacgggtacctccggttaggagtccgactttaccgtcgtcggtacctacccgtagtccggtacgtacgggtaacctaccggaaggttaccctaaccgggttacacccgtacgtacggtaggtaccgggtaacgacccggtacggaccgtaagggtaaacggtaacggacggtaccgttacgggtttaaagtttaaccgttaccggttaacctaacggtaactaccgtaaacgtactaacccgtaaacgtaaaccctaaccgtaaacgtttaccggttacccggttagggttaaccggggaaccggtacccgggtaacgtaacccggtaaccggttaccgtaacccgggttaacccgttacgggtaacccggtacccggtacccgggacccggttacccgacccccggttaccccccggtaccggttaaccccg

SEQ ID NO: 157048 - DNA, 776 bp, Homo sapiens
  misc_feature: GYAE6OF02IUN9C.35.15.B04.1.454.CMB.1.raw
  modified_base (134)..(134): a, c, t, g, unknown or other
  misc_feature (134)..(134): n is a, c, g, or t
tcagtacagatcgtcacgaccggtgctcgatttagacagtatatatccgcgggggtgggtccaggaggcagaactctgggtgtctcaccatggcctggatccctctacttctcccccctcctcactctctgcanaggctctgaggcctcctatgagctgacacagccaccctcggtgtcagtcgtccccaggacacgacggccaggatccaccgtgcctcgtgggacgatgaccagttcgaccctaaaagactaaatattaacttagttacggtaacccaagtacaaggtaacgtacgacgggacccaacggtcccccttaggtagttagagtaggtaattaggtaaacttaaaacggactaacgtagacggacggacccctgaggtactcccgtagacgtcgtaacttcgtcgttcggtacctaccgacgtacgtacgaacggggaaacctaaccgaacggttaccgtaaccggttacgaacctaacgttaccgtaagggtacggtacggtacccgaggtacgtaaaggaaacgtaaccgggaacggtacgtagttaaacgtttaagttaaccgttagttaaccgaaacgttcggtaacgaccgtaaacgaaacccaaactaaaaccgtaaacggttacccggttacccgtttaggttacggggtaccggggtaacggtaacccgaacggtaccgtaaccggtaacccgttaccggttacgttaccggaccggtacccggtaaacggtcccgtccccggtacccccgttacccgg

SEQ ID NO: 157049 - DNA, 741 bp, Homo sapiens
  misc_feature: GYAE6OF02IUFVP.35.15.B04.1.454.CMB.1.raw
  modified_base (332)..(332): a, c, t, g, unknown or other
  misc_feature (332)..(332): n is a, c, g, or t
tcagtacagatcgtcacgaccggtgctcgatttagacagtatatatccgcgggggtgggtccaggaggcagaactctgggtgtctcaccatggcctggatccctctacttcctcccctcctcactctctgcacaggctctgaggcctcctatgagctagacacgacgccctacccgtcggtcgtcagttcgaccccagggacacggacggccaggactcaccgtgctacgtggagatgcctattcgaccgaaaagcaaattacttacttagttacggaacctacggcaaggtaagtcgacggcccgaacggtcccctgtacttagacgtagntaaggtaataaacgactacgtagacgacgtcccgtacgacggtacctaccgtaggacgaccgtacttcgtcgtcggtcctaccgacgtcgtaccggaaggtaaacccgaacggtaacgtccgtaacggttaccgtaaccgtaacgtaccgtaaagggtcggtaccggtaccgaacggacgaaacggaacggacgggaacggttaccgtaggttaactttaccggttaacttacgtaacctaacgtacgaaccgtacgtaaaccgacgaaacctaaacgtacgtaccggtcccgttagggttacgggaccggtaacggtaaccgtacgtaaccggtaccggtacccgttaccggtacgtacccggaacgtacccggaaccggtcccgttacccggtcccccgtaaccggg

SEQ ID NO: 157050 - DNA, 669 bp, Homo sapiens
  misc_feature: GYAE6OF02JPF7S.35.15.B04.1.454.CMB.1.raw
  modified_base (316)..(316): a, c, t, g, unknown or other
  misc_feature (316)..(316): n is a, c, g, or t
tcagtacagatcgtcacgaccggtgctcgatttagacagtatatatccgcgggggtggggtccaggaggcagaactctgggtgtctcaccatggcctggatccctctacttcctccccctcctcactctctgcacaggctctgaggcctcctatgagctgacacacgccacctcggtgtcagtcgtccccgaggacaggacggccagggactcaccgtgctcgtggacgatcgcatcgaccaagacaatactacttagttacgtaccagcaagagcgacggcgacggcccttgtacttagagtgacgtaggtaaanaacgtacacgtaggacggacggtaccctaggaacggtactccgtacggacggcgttacttcgtcgtcgtacctaccgtacggtactaccggaacggtaccaacggtaccgtaaccgacgttcggaacctagtacgtagggtacggcgtaccggagtacgaagtaagaccggaggtcgtagtacgtttaactacgttcgacgttaacacgagacccgaaacgtaaccaaaccgtaacgtaaccggttaacgtcccggtttaaggggtaccgacggggtacggaaccggtagaccgttacgggaccgtaccgtaggtccgaacggtccgaacgtcccgttacccggcccgtccgg

SEQ ID NO: 157051 - DNA, 791 bp, Homo sapiens
  misc_feature: GYAE6OF02H4Q24.35.15.B04.1.454.CMB.1.raw
  modified_base (254)..(254): a, c, t, g, unknown or other
  misc_feature (254)..(254): n is a, c, g, or t
tcagtacagatcgtcacgaccggtgctcgatttagacagtatatatccgcggggggtccaggaggcagaactctgggtgtctcaccatggcctggatccctctacttctcccctctcactctctgcacaggctctgacggcctcctatgagctgacacagcccaccgtcggtgtcagtcgtccccgaggacaggaccggccaaggacttaccgtcgctcgtagggagtactgctagttggtacaagtaaagttnttttgggttttacgaacctaaggtaaagtaagttcgaacggaccgacggtccccgttgttccgttaggtcgtacgtttcggttacggaacggaccgtaacgaacggtcccggtaaccccgttccggggtaccttacccgtaggaacgtacgttaacgtttccttcggttcggacccgttccgaacgtccgtacggtaccggggttaacttacggtcgggttttacctaaccggtttaggtacttaccgtaacgttacccgggttaacgggtcccgggggtaaacccgttagggggtacgggaacggtaggtacgggtaacggtacgttacggttaacgttaatttgggtttacgtttaacgtaacgtaaacgtacgtactaacgttattacttaaggttttcgttaggttaggttacggacgggtagttaacgtacgttcgtaccggtagttaccgtagtcgaccgtacggtaacggtccttccgcccgttcgccttacgttcccgtaccgttccccgtacctcccgtacgtaaccg

SEQ ID NO: 157052 - DNA, 790 bp, Homo sapiens
  misc_feature: GYAE6OF02GFCIK.35.15.B04.1.454.CMB.1.raw
  modified_base (163)..(163): a, c, t, g, unknown or other
  misc_feature (163)..(163): n is a, c, g, or t
  modified_base (175)..(175): a, c, t, g, unknown or other
  misc_feature (175)..(175): n is a, c, g, or t
  modified_base (236)..(236): a, c, t, g, unknown or other
  misc_feature (236)..(236): n is a, c, g, or t
tcagtacagatcgtcacgaccggtgctcgatttagacagtatatatccgcgggggggtccaggaggcagaactctgggtgtctcaccatggcctggatccctctacttcctccccctctcactctctgcacaggctctgacgcctcctatgagctgacacacncccaccctggtntcagtccgtaccccaaggacacggccgaccgaggtactaccaccgtgtcctacgtgggaangtcgtactacgttcgaaccgaaagactaaatactttaacgttagtttacggaaccacgagtaaagaactcgaacggcccacgggttcccttagtagttgagtagtaagtaagtaacgtaaagaacccttaggacgacggcccgtaccgttcggaaacggtccttaccgtaggtaacgtaccgttacgttccggtacgtaccgggtccttacccgtaaggtcccgtaaacgtaaccggggaacttaacgtaccgttaaccgtacgttacggaaccctacgtacgaggtaccggtaaacgttccggaaggcgtaaagggtaacccggaggtaaccgttggttaacgttaacgtttacgtttacgtaacgtaacttaacgaccggtaaccgtagaacccgtaacgtaaaccaaccgtttagtaacccggttccggtttaagggtaaccgggtacccggaagggttacccaacggttaccggtaaccggttaacccgttacgtaccgggaacttccgaaccggttaccggccttacccgggtcccgtccgttaacccg

SEQ ID NO: 157053 - DNA, 858 bp, Homo sapiens
  misc_feature: GYAE6OF02ILATL.35.15.B04.1.454.CMB.1.raw
  modified_base (102)..(102): a, c, t, g, unknown or other
  misc_feature (102)..(102): n is a, c, g, or t
  modified_base (132)..(132): a, c, t, g, unknown or other
  misc_feature (132)..(132): n is a, c, g, or t
tcagtacagatcgtcacgaccggtgctcgatttagacagtatatatccgcgggggggtccaggagcagaactctgggtgtctcaccatggcctggatccctntacttctccccctcctcactctctagcacnggctctgaggcctctactgagctagacacacgccctaccctcggtgtcgacgttccgtacccaaggacacggacggccgtagggacttccgtaccgtgtccttcgagggacgtatcggcctaagttccgaaacccgaaacgaccgttaaacttaagttaaccttaaggttttacgggtaaccgtacgacgtaaacggtaaccgtggaaccggtacccgtacggtccccggttattacgttagtagttacggtataaggttaactaacggacttaacggtacggtacgggaaccgtaccgtacgggaaccggtacctaccccggtagtacggacccgttcttccggtaccggttacggtaccgtcctacggccgttaacggacgtaaacgtaccgtaacgaccttaaccggtacggtacctacggttacaacgggtgaccggtacgaccggtacgtaagggaacgtacggtacgtcgttaacgttagtttaacgttacgtaccggtaaccgtaacgttcgggaaacctacggtaaccgtaacccgtaaactaccgttaaacggggtttacccggtttacccggtttacgggttaccgggtaaccgggttccgggtaaccggttcccgggaacgttaaccggtaaccggtttacccggttacggtacccgtaccgggacccggttaacccgggtacccgtcggtaccccccggttacgttaaccccgg

SEQ ID NO: 157054 - DNA, 833 bp, Homo sapiens
  misc_feature: GYAE6OF02II0T4.35.15.B04.1.454.CMB.1.raw
  modified_base (769)..(769): a, c, t, g, unknown or other
  misc_feature (769)..(769): n is a, c, g, or t
tcagtacagatcgtcacgaccggtgctcgatttagacagtatatatccgtgtcaggtgcagctggtggagtcgtgggggaggcttggtcaagcctggagggtccctgagactgtcttgtgcagcctgtggattcaccttcagagactatttcatgacctggactccgccagactccgagggaaggactggagtgggtctacgacactagtcacgacagtactggacaacgtcctagtacgtaccgaacgcgaacgtaccgtgtggtacggaacgggcccgtaattaccgtaaccgttaaggttttaacgggaaccaaccggtaccggtaaacgggttcgacgttacgtacgttaccgtaggaacctaaacgttacgaaccgtacggtcgtaacggtaacggttagaaccggaaggacccgacggtacctaaactacgtttaacgtaccgttaggtaccgtacggaaacggttacgtacgttacgttagggttacgggtacggttacgtaggttttagggtaccgggttacgttaaccgggttaaaccggttaccggtaaccgggtttaagggtacgggttaaccgggttacgggtaaccgggggtaaccggtaaaaccggggtaaacccgttaaccggggtaacccgttaacccgtacccgtttacccgtaggtaacccgttacccgttacccgaaacccggtaccgggaaccctaccgttccgttaccccgtcccggtacgtcccgtacccgtacgtccgtacccggnggtaaccgtccgtacccggttcggaccgggtacacggtaccgaccggtccggtacgcggtaccg

SEQ ID NO: 157055 - DNA, 713 bp, Homo sapiens
  misc_feature: GYAE6OF02F660T.35.15.B04.1.454.CMB.1.raw
tcagtacagatcgtcacgaccggtgctcgatttagacagtatatatccgtgtcaggtgcagctggtggagtctgggggaggcttggtcaagcctggagggtccctgagactgtcttgtgcagcctctggattcaccttcagagactatttcatgacctggatccgcagactccgaggaaggactggagtgggtctcacacatcagcagtactgacaactcccatgtacctacgacagtactcgtagtggaacggcgtatacaccttagtttacggactaaccgtaccgtaacggttccgacgttcgtaacgtctaggaactaaagttacgaaactacgtacctaggaacgtacggtacggaacggtaccgaccggtactacgttacttactttacgtacggtacgtacgtaaggtaacgttacgtaggttacgggtaggttcggtaccgtttaggtttcggttggtaaccggttacggtaaaccgtacggtaggttacgttcggtacggtacggtaccggggaccgtaacgggaaccgtacggttacccgtaccgtccgtaccgacgtacgtcccttaaccgacgtaaccgggccttaccgttcccgtccttccccggcgtacccgtcccttacgccgtacggacggtacctccgtacccggtgggtacccggactacggtacccggccggtaccggtacggtccgtacccgg

SEQ ID NO: 157056 - DNA, 681 bp, Homo sapiens
  misc_feature: GYAE6OF02IMSV6.35.15.B04.1.454.CMB.1.raw
  modified_base (129)..(129): a, c, t, g, unknown or other
  misc_feature (129)..(129): n is a, c, g, or t
  modified_base (532)..(532): a, c, t, g, unknown or other
  misc_feature (532)..(532): n is a, c, g, or t
  modified_base (674)..(674): a, c, t, g, unknown or other
  misc_feature (674)..(674): n is a, c, g, or t
tcagtacagatcgtcacgaccggtgctcgatttagacagtatatatccgtgtcgaggtgcagctggtggacgtcgtgggggaggcttggtcaagcctggagggtccctgagactgtcttgtgcagcctntcggattccaccttcagagacttatttcatgacctggactcccgcagacctccgaaggggaacggctggaggtcgggtcctcacacacgtcagcaggtactggaccatcccaagtcgtaacctacggacaacgccttgtaggtacggaaaccgggtccgaacttacctaaccgttaagttttaacggggaacctaaacggtcccgtaaaggggttccgtacttaggtaactcgtacgtaacgaaaacgttgaaaaccgtcggtaccttagggaacgtaacgggttaccgaaacgggaacaccggtacaacttacgttaacgtacgtgtacgacaaggtctcgtgtacgtggtgactaggttcgtacgcgtaacggtactacggacgttagtccggacgtcggngggtacaaacggtctaacggtccacggtccttacgctaagtcctaccgaccgaacgtcccagttccgtcccctccgcgaccgtccgacgtccacgaacggtccaccgtcgcggtcgggcacgtaccggccggccgttaccgngtaccgg

SEQ ID NO: 157057 - DNA, 740 bp, Homo sapiens
  misc_feature: GYAE6OF02HCRQE.35.15.B04.1.454.CMB.1.raw
tcagtacagatcgtcacgaccggtgctcgatttagacagtatatatccgcgggggtgggtccaggaggcagaactctgggtgtctcaccatggcctggatccctctacttctccccctcctcactctctgcacaggctctgaggcctcctatgagctgacacagccaccctcggtgtcagtcgtccccaggacaggacggccaggatccacctgctcgtggagatgcattgaccaaagacaattatacttagttcgtacctagacagaagtcgacggcccgacggtcccctagtacttgatggtactagtaactaaacgacgtaccgtagggacgaacggtacccctcggaacgggtaccgtaccgttcggacgtcgttaactttcgtccgtcggtacctcccgacgtcgtaccgaaggggtaacccaaacgtaccggttacgtaacccggtttacgaaaccgttagtacccggtaggtaccgggtacgttacccggaggaacgtaaacggtaacggacggacgggtcgttacgttaaacgttttactacgtacgttactaaagttcccgaagaccgaacgtaaccaaaccgtaaacgtaacggttaccggtttacccgtttagggttccggggacgggtaaccggggtaaccaaccggtacccggacggtttaaccccggtcggttaacggacccttacccgggacctaccgggtacccgtacccgtcccccgtaccgg

SEQ ID NO: 157058 - DNA, 858 bp, Homo sapiens
  misc_feature: GYAE6OF02F30YM.35.15.B04.1.454.CMB.1.raw
  modified_base (619)..(619): a, c, t, g, unknown or other
  misc_feature (619)..(619): n is a, c, g, or t
tcagtacagatcgtcacgaccggtgctcgatttagacagtatatatccgcgggggtgggtccaggaggcagaactctgggtgtctcaccatggcctggatccctctacttctccccctcctcactctctgcacaggctctgacggcctcctatgagctgacacagcccaccctcggtgtcagtcgtccccaggacagaccggccaggactcacctgctctggagatgacagttcgaccaaaagccaaattacttaccgtttagtttacggaacccagaccgaaggtaacgttaccgaacgggacccgaacgggtcccccttagtaacgtttagtaacgttggtaacgttaacggttaaataaaaacggtaccgtaaacgttagggaaccggtaaccgggtaccccttaacgggtaacggggtaccctttaccccggagggtaaccggtaccggttaaacgttttccgttaccgttcgggtacccttacccggaacggtacccggttaacggtaaccggggaaacctaaaccggacgtttacccggtaacgtttaccgaacctacgttacggtacggtagggtaacccgtcggaacgacggaaacggaagccggtacggngttaacgttaagtttacgttaacgtgtaaacgacgttacgacgttaacgaacgtaacccaaccgtaaaagtaacgtttacggttaccccgttagggttttaaccggggcggtaaacccggtaaccggtaaccgtacccggtttaaccgggtaaccccgtttaccgggtaaccggtccggtaaaccccggtaccggtacccggaccccggttaccccgggtacccccgtttaaccccggg

SEQ ID NO: 157059 - DNA, 689 bp, Homo sapiens
  misc_feature: GYAE6OF02HMXVQ.35.15.B04.1.454.CMB.1.raw
tcagtacagatcgtcacgaccggtgctcgatttagacagtatatatccgcgggggtgggtccaggaggcagaactctgggtgtctcaccatggcctggatccctctacttctccccctcctcactctctgcacaggctctgacggcctcctatgagctgacacagcccaccctggtgtcagtcgtccccaggaccagacggccaggactcacctgctcgtggagatgctattcggaccaaagcaaattattacttaagttcggtaaccagacaaggaacgtcgacggcccacggcccctgtattgatggatagtaagaaagacacgtggaacgtacgccctagacgggtactcccgtagacggctacgttcctcgtcggtactacccgaggtccgtacggaacgggaactaacggtacgtaccgttacggttacgaaccgtactacgtaaggtcgggaacgtaccggaggacgaaacgaacggacggacggtctagtacgttttactacgttagtacaattccgagaccgaaacgaccaaccaacgtaaacgttccgttaccggtttaggttacgggaccgggtaacgggaaccttaaggcccgttaacgggtaccccgttaccggtaacgggttacccaaccgggtaacccgtaaccgggtccgttacccccggaccccgttacccgg

SEQ ID NO: 157060 - DNA, 636 bp, Homo sapiens
  misc_feature: GYAE6OF02J0O9X.35.15.B04.1.454.CMB.1.raw
  modified_base (225)..(225): a, c, t, g, unknown or other
  misc_feature (225)..(225): n is a, c, g, or t
tcagtacagatcgtcacgaccggtgctcgatttagacagtatatatccgcgggggctgtgggtccaggaggcagaactctgggtgtctcaccatggcctggatccctctacttcctcccctcctcactctctgcacaggctctgaggcctcctatgagctgacacagcccaccctcggtcgtcagtcgtccccaggacagacggccaggatcacctgctctgganatgcattgacaaagcaatatacttatgtacagcagagtcaggccacggcccctagtatgagtagtatagtaataaagacacgtagagacgcctgaggactaccgtgagcgtattctcgtgtcctcgtacgactcgaacggacaacgtgtaccgacttcgaaccagtccgtaggtacggtacgtaccggaggtacgaggaaacggaccggagtacgttagttaacgttaacttacgtagtaacctaacgacgtaacgtaccgaactaaccgtaaaccaaacgttaacgtaccgttccggttacgggttacggtaaccggggaaccggttaacaaccggtcggttaccggtaaccccggttaggttaacccgggaccttaaccgggtaccctaccgggggccccttacccggg

SEQ ID NO: 157061 - DNA, 761 bp, Homo sapiens
  misc_feature: GYAE6OF02H3U93.35.15.B04.1.454.CMB.1.raw
  modified_base (125)..(125): a, c, t, g, unknown or other
  misc_feature (125)..(125): n is a, c, g, or t
  modified_base (207)..(207): a, c, t, g, unknown or other
  misc_feature (207)..(207): n is a, c, g, or t
  modified_base (242)..(242): a, c, t, g, unknown or other
  misc_feature (242)..(242): n is a, c, g, or t
tcagtacagatcgtcacgaccggtgctcgatttagacagtatatatccgtgtcaggtgcagctggtggagtctgggggagcttggtcaagcctggagggtccctgagactgtcttgtgcagcctntggatttccaccttcagagacttatttcatgacctggactccgcagactcgagggaaggctggagtgggtactcacacgatnacgcgtagtactggacaactcccatgtactaccgnaagactgtgtacggtacggaccgtattccgaaccttaggtttaacggactaaccgaccgtaagggttctcgttgtactcttcggaacaaagttcgaaacgcgaccgttaggaagtacggtacgaacggacgaccggacacttacgttaacttaagtcgagttaacaaaggtacgttacgtaggttaaggtccgggtagtacggttaaggtttcggtttcgggtaccgttaaccgggttaacgttaaccgggtacggttaaggtaccgggtaacgttcggtacgggggtaaccgaaacgggttaacccgtaacggtccgtaaccgttcgtaaccctacgacgtcccttaaccggaccgtaaccgggtaccctaagttccccgggttcccttacccccggtagggtccccgtacccgtccggtaacccgttaccgggaccggtcccgttacccgacggtttcccgggacgggtacccaacgggtcccggcccgggtttccggaccggttacgttccccggg

SEQ ID NO: 157062 - DNA, 611 bp, Homo sapiens
  misc_feature: GYAE6OF02G9NLO.35.15.B04.1.454.CMB.1.raw
tcagtacagatcgtcacgaccggtgctcgatttagacagtatatatccgcgggggtgggtccaggaggcagaactctgggtgtctcaccatggcctggatccctctacttctccccctcctcactctctgcacaggctctgaggcctcctatgagctgacacacgccaccctcggtgtcagtcgtccccaggacagacggccaggatcacctgctctggagatgcattgaccaaagcaatatacttattggtaccagcagaagtcgaggccacggcccctagtattagatgatagtaataaagactattagacggccctgaggctcccgtgagcgtattcctcgtcggtcctcacgctacgacggaacaacgacgtacctacgtacgacctactcgaggtacggacgtccgaaggacgaaggaacgacggaggtctagtaactttacgttacgtgtaacgaacttacgaacgacgaacgaacctaaaccgaaacgtaaaccgttaacggttcccggttaggtttacgggaccgggtacggaaccgtaacggtcgtaccgtaccgtacgtacgtacgacgaccgacggtcctcccggtcccgtacgtacccg

SEQ ID NO: 157063 - DNA, 761 bp, Homo sapiens
  misc_feature: GYAE6OF02HH414.35.15.B04.1.454.CMB.1.raw
tcagtacagatcgtcacgaccggtgctcgatttagacagtatatatccgcgggggtgggtccaggaggcagaactctgggtgtctcaccatggcctggatccctctacttctcccctcctcactctctgcacaggctctgaggcctcctatgagctgacacagccaccctcggtgtcagtcgtccccagggaccaggaccggccgaggactccacctgctctaggagatgctatcgacaagtcaatagtaccttatcggtacagcgagagttcacggccacggtccccgtagtactcgagtcgatagtaagaacgactacgtgacgtacggtccctaggacggtactaccgtgacgtacgcttacgtcgtggtcctacgacggtctacgacgggtaacacggtagtaccgtaggttccgaacgtctaccggtacgtacggtaccgttaccggaggttaccaagggtaacgacgggtaaccggtcggttaccgtaaacgtttcgttaacgggttactaacccggtaaggttacccgaacggttaaccgaaccgggttaacccgaaacccttaaacccggttaacgtaacccggtttaacccggtttacgggttttaacccggggaccgggttaaaccgggtaaccccggttaacggaccccgggtttaaaccgggacccgttttaccccgggtagtaacccggtaaccgtaacccccggcgggttaacccccctttaccggggtaccccccttaaccccggg

SEQ ID NO: 157064 - DNA, 748 bp, Homo sapiens
  misc_feature: GYAE6OF02GCIKF.35.15.B04.1.454.CMB.1.raw
  modified_base (175)..(175): a, c, t, g, unknown or other
  misc_feature (175)..(175): n is a, c, g, or t
tcagtacagatcgtcacgaccggtgctcgatttagacagtatatatccgcgggggggtccaggaggcagaactctgggtgtctcaccatggcctggatccctctacttctccccctctcactctctgcacaggctctgacggcctctatgagctgacacacgcccacccgtggtntcagtcgtccccaaggacaggaccggccaaggactccacctgcctcgtgggagatcgcagttcgacctaaagcaaattacttactttagttacggtaccagacaagtaagtcgacggccgtacggccctagtattgatagtagtagtaataagactagtaggacggtacggtaccgtaggacggtacctccggtagacgcgttacttccgtcgtcggtcctaccgagtcgtaccggaagggtaaccaacgtacggtacctacggttaacgaccgtagtacgtagggtacggtaacgtaccggaggtaacgaacggaacggtaacggacggttacgttagtttaaacgtttaacgttacgtaccgtaaacttaacgtccgaacgtaccgaaccgtaaacccaaaccgtaaacgtaacgtttaccgttcccgggtttaagggttacccggggaaccgggtaaccggtaccgtaacgggttaccggttaacccgtaccccggttaaggttacggacccggtaacggtaccccgggttaacggccccggttacccgggcccccgtttacggtacccg

SEQ ID NO: 157065 - DNA, 688 bp, Homo sapiens
  misc_feature: GYAE6OF02J042D.35.15.B04.1.454.CMB.1.raw
  modified_base (396)..(396): a, c, t, g, unknown or other
  misc_feature (396)..(396): n is a, c, g, or t
tcagtacagatcgtcacgaccggtgctcgatttagacagtatatatccggcgggggtggtccaggaggcagaactctgggtgtctcaccatggcctggatccctctacttcctcccctctcactctctgctacaggctctgaggcctctatgagctgacacacgtcccaccgtggtagtcgagttcgtaccccaggacgacgacgacgagtattacctgctcgaggagtacgtgactagttcgtacgaaggtaacgttagttttcggttttacgacctagaccgtaacgtacgttaccgacggtaccacgtccgtagttaagttcgaacgtgacgttagaagtaaacgctacgtaggtacgaccggtcctaaggtacggtccaaccgtggaacgtnttacgttacgtcgtacgtccgtctagtaaccgacggaaggaccaacggttcgacgttaccggacaactgacgtcggtaacgtacggacgtaggacgtaaaggaacggcggtaacgtacgtaagttaacgttcgtaacgtacgactaagtcagtacacgtaacaccgtagtaccgtgtacccgttggtacgtcggtacgtacgacgtcgtaaccggtcgtaacgtaccggtaccgtacggtaccgtaaccggttcccgttaccgttcccggtaaccgtcgttaccccgttcgg

SEQ ID NO: 157066 - DNA, 728 bp, Homo sapiens
  misc_feature: GYAE6OF02HZHSA.35.15.B04.1.454.CMB.1.raw
tcagtacagatcgtcacgaccggtgctcgatttagacagtatatatccgcgggggcctggggagcctagctgtgctgtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatccacctgctctggagatgcatgaccaagcaatatacttattggaccagcaagaacgtcgaggccaggaccctgtatgatgatgtaataagacactgagacgtccctgagggtactccgtgacgtcgtactttcgtcgtcgggtacctccgaacgtccgtaccgaagggtaaccaaacgtacggttaccgtaaccggtttaccggaacccgtaacgttacgtaacggttacggggttaacggtacccggtaacgggtaaccggaaacgggaaaacggtaaccgggtaaacggggtaccgtttaagttaaacggttttaacgtttaacgtttaaccggttaaccgtaaaacgttaccgaacggttacccaacggtaacccgaaacccgttaaaaccgtaaaccgttaacccgggttaccccggtttacgggttttaccggggaccgggggttaaaccgggtaaacccggtaaacggttacccggtaccggttaaaccccggg

SEQ ID NO: 157067 - DNA, 758 bp, Homo sapiens
  misc_feature: GYAE6OF02GGH2W.35.15.B04.1.454.CMB.1.raw
tcagtacagatcgtcacgaccggtgctcgatttagacagtatatatccgtgtcaggtgacagctggtggagtctgggggaggcttggtcaagcctggagtgtccctggagactgtcttgtgctagtcctctggattcaccttcagagactattcatgacctggatccgcagactccgaagggaaggtcgtggtagtggtctacacactagtccagctagtacgtggactaacctccagttcgtaacctacgctacgtacttcgtggtacgaacgggccgtacttacgtacgttagtttaacggacctaaccggtaccggtaaggggttccgtacgttacgtaagttcgtacggtaacctaaaggtacgaaacgacgtacgtaaggaacggtacggtaacggaacggtaaccgaccggactaacgttacgttacgttacgtagtacgacgtaaacgtggtaccttaggttaggtacggtcggtacgttaggttcggttacgtaaccggttacgtaacgtacggtacggtagtacggtacgtcggtacggaccggaacgggtacgtaccggtaccgtaccgttccgtccgtaccgtccgttaccgtcccggtaaccggtaccgtcccgttaaccggttcccgttacccgttccccggtggtccccgttccgtaccgtccggtacggaaccgtcggtacccgttaccggcgggttaccggaccgtaccggtaccggtcccgggtcgggtacccgttccggg

SEQ ID NO: 157068 - DNA, 792 bp, Homo sapiens
  misc_feature: GYAE6OF02F01M2.35.15.B04.1.454.CMB.1.raw
tcagtacagatcgtcacgaccggtgctcgatttagacagtatatatccgtgtcaggtgcagctggtggagtcgtgggggaggcttggtcaagcctggagggtccctgagactgtcttgtgcagcctcgtggattcaccttcagagactatttcatgacctggatccgccagactccgagggaaggactggagtggtctcacacatcagcagtacgtggactaactccatcgtactacgcagtactcgtgtaggaacgggccgtacttaccaaccgttaagtttttaacgggaacctaaaccggtaccgtaaacggggttaccggtacgttaggtacttacgtagtaactaaagtacgaaactacgtccgtaggaagacgtacggaacggaaccgaccggacctaacttactaactttaacgtggtacgtacgtaaaggtacgttacgttaggttacggttagggtacggtacgtaggtttacggtttcggtacgttaaccgggttaacgttaaccggtaacggttacggtacggtaccggtaccgggtaccggggaaccgtaaacggggtaaccgtaaacgggttccgaccgttccgtacctacgtaccgtacccgttacccgaacccgtaccgggtaccctacggttcccgttcccgttcccccggtgggtcccgtaccccgtcggtacccgtaacccggtcggaaccgtaccccgtaacccggttaccgggaccggggtaccaaccgggaccgggtaccccgggtcccggttaccggggccctcccgggg

SEQ ID NO: 157069 - DNA, 699 bp, Homo sapiens
  misc_feature: GYAE6OF02GIWB8.35.15.B04.1.454.CMB.1.raw
  modified_base (231)..(231): a, c, t, g, unknown or other
  misc_feature (231)..(231): n is a, c, g, or t
tcagtacagatcgtcacgaccggtgctcgatttagacagtatatatccgcgggggtgggtccaggaggcagaactctgggtgtctcaccatggcctggatccctctacttctccccctcctcactctctgcacaggctctgacggcctcctatgagtctgacacacgccctacccgtcggtgtcagtcgtccccaggacaggaccggccgagactccacctgctcgtgganatgactagttacaaccgaaagacctaaattattactttaagttacgtaaccgacgtacaaggaacgtcgacggcccgaccggtccccgttagtacgttcgtatagtagtaagtaataaacgacgaagtgacggacgtcccgtaggaacggtctaccgtggacgtacgtacttccgtcgtcggtcctacgacgtacgtacgaacggtaacctaacgtacggttaccgtacgttaccgtaacctagtaccggaggtcggtaacgccgtaagaacgtaaaggaacggacgacggttatagttaacgtttatacgtagtaactactacgtagacgtacgaacctaacgtaactaacgttaccggtcgttagggtacgggacgtacggaacccgaaggtcctaacccggtaccgaccggttacgtaccgaaccggtaccccgtaaggtcccgtacccgtacccgggttacccg

SEQ ID NO: 157070 - DNA, 777 bp, Homo sapiens
  misc_feature: GYAE6OF02IBPZ3.35.15.B04.1.454.CMB.1.raw
  modified_base (301)..(301): a, c, t, g, unknown or other
  misc_feature (301)..(301): n is a, c, g, or t
tcagtacagatcgtcacgaccggtgctcgatttagacagtatatatccggcggggggggtccaggaggcagaactctgggtgtctcaccatggcatggatccctctacttctccccctactcactctctgcacaggctctggacggccttcctagtgagtctggaacacgcgccctacccgtcggtgtacaacggttccgtaccccgaaggaccgaacggtaccgggaccaagggacttcccaccgttggctccggtagggactattcgactaacgtcgacaaagcctaattataactttntacggtaccagacaggttacgacgcgggactaccggtccgtatagttcgtagtcgtagtaacgttaagaaacgcgtaacgtaggaccgaccggtcccgacggtacggaccgttcccgaggtaccgtctacgttccgtccgtcgtacctccgacgccttacggaacggaacaacggttcgaccgttacgttacgacctagtacgacgggtttacgacggtaccggaggactaaacgggcggaacgtacgtaatttacggtaatttaccgttaacgtttccgaaaacgttcgtacgtaaacgggaccaaaacgaccccgttaaaaccgaacgggttaattacccggtttccgggttacgggtttccggggaaccgggtaccaaccgggttaaggtccccgttacgggtaccccggttccgttaccggacggtaaccctcccggggtaactccccgttaccccggtccggttaccccgg

SEQ ID NO: 157071 - DNA, 710 bp, Homo sapiens
  misc_feature: GYAE6OF02GYX6I.35.15.B04.1.454.CMB.1.raw
  modified_base (126)..(126): a, c, t, g, unknown or other
  misc_feature (126)..(126): n is a, c, g, or t
  modified_base (201)..(201): a, c, t, g, unknown or other
  misc_feature (201)..(201): n is a, c, g, or t
  modified_base (642)..(642): a, c, t, g, unknown or other
  misc_feature (642)..(642): n is a, c, g, or t
tcagtacagatcgtcacgaccggtgctcgatttagacagtatatatccgtgtcaggtgcagctggtggagtctgggggaggcttggtcaagcctggagggtccctgagactgtcttgtgcagcctntggattcaccttcagagactatttcatgacctggactccgcagacctccgagggaaggctggagtggtctcacantcagcagtactgacactccatcgtactacgcagtactgtgtaggacggccgtattcctaacttagttttaacgggacaccggaccgtacggttcgacgttgtacgtctgaactaagtacgaacgacgtccgtaggaggtacgtacgaacggaccgacggtcctacttacgttaactttcgtgtacgtaaccgtaaggtacgttacgttagggtacggttgggtacggtcgttaggtttcggtacggtaccgtttacggtaacgtacggtaaggtacgtacggtcggtacggacgggtaacggaacggtacgtaccggtaccgtaccgttccgtcgtaccgtactcccgtaacccgaacgggtaacccgaccgttaccgttacccgtttcccccgttcccgggtccgtacccgtcccgtacgtcccggtaccggcggtaccncccggtaccggtccgggacgggaccctcggtacccggtcccggtaccggttccgggaccgttcccggg

SEQ ID NO: 157072 - DNA, 740 bp, Homo sapiens
  misc_feature: GYAE6OF02GTTZD.35.15.B04.1.454.CMB.1.raw
  modified_base (190)..(190): a, c, t, g, unknown or other
  misc_feature (190)..(190): n is a, c, g, or t
  modified_base (344)..(344): a, c, t, g, unknown or other
  misc_feature (344)..(344): n is a, c, g, or t
  modified_base (362)..(362): a, c, t, g, unknown or other
  misc_feature (362)..(362): n is a, c, g, or t
tcagtacagatcgtcacgaccggtgctcgatttagacagtatatatccggcgggggtgggtccaggaggcagaactctgggtgtctcaccagtggcctggactccctctacttcctcccctcctcactctctgcacgaggctcgtgacggcctcctagtgcgtctagacacgacgccctacccgtcggtntcgtagtccgtaccccgaggaccgaggaccggccaaggtacgtcccacgtcgtacctcggtaggacgagtcgacttacgtacgaacctaagacttaatacttacgttaagtcgaacacgacgtaagtaacgccgacgccgaccgtccgttagtntacgattgtataagtaanaacgacgtagagacgccgtccgtaggtacgtactccggagtaccgtacttacgtacgttcgaccgtaccgttccgacgttacgacggtaaaccggtaaactagtaccggttaccgtacggtaacctaacccgtaggtaccgtaggggtacggttacggaccgaagggaaccggaaggaacccggttgtaagggttacctaggttacttaacggtttacgagtaacgacttacgacgacgtaaaccgacctaaccgaagttaccgttacggttccggtagggtaaccggagggaacgtccgtaaacggtccgttacgggtaccctacggaccgggttcaaacccgggcgtaccggtccgttaccccggcccgttaccgg

SEQ ID NO: 157073 - DNA, 618 bp, Homo sapiens
  misc_feature: GYAE6OF02HLDD2.35.15.B04.1.454.CMB.1.raw
  modified_base (289)..(289): a, c, t, g, unknown or other
  misc_feature (289)..(289): n is a, c, g, or t
  modified_base (408)..(408): a, c, t, g, unknown or other
  misc_feature (408)..(408): n is a, c, g, or t
tcagtacagatcgtcacgaccggtgctcgatttagacagtatatatccgcggggggggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctcgtggagatgcattcgaccaaagcaatatacttattgtaccagcagatcaggccagcccctgtacttgatgatgtaanaaagacactgacgacggccctcgagggactcccgtagacgcgtacttccgtacgtcgggtcttccgagtcccgtacggaacggggaactaacctaggtaccgtacggtttacgacctanacggtaacgtcgggtacgtccgaggacgtaagaacggaacgggagcgtagtattaacgtttacgtgtacctaatcgagacgacgaaccaacgaaacgtaacgtaccgttaccggttgtttcggacgggtacgggaacctaggtctacgtacccttacgttacggtcgaccggtaccgaacggtccgtacccgtccccgtacggttacccg

SEQ ID NO: 157074 - DNA, 846 bp, Homo sapiens
  misc_feature: GYAE6OF02IG65T.35.15.B04.1.454.CMB.1.raw
  modified_base (141)..(141): a, c, t, g, unknown or other
  misc_feature (141)..(141): n is a, c, g, or t
  modified_base (301)..(301): a, c, t, g, unknown or other
  misc_feature (301)..(301): n is a, c, g, or t
tcagtacagatcgtcacgaccggtgctcgatttagacagtatatatccgcgggggtggtccaggaggcagaactctgggtgtctcaccatggcctggactccctctacttcctccccctctcactctctcgcacgaggctntggacgtcccttactagtcgagctgaaccacgacgtcccctacccgttgggatccgtacggttccgacccgaaggcgacggacccggccgtaaggactaccgtctcggtcctgggtacgggattactcgtacgttacgtaacccggaaacaaaaccgttnttaaacgtttaattaccgtttaacggtaccggtaacgacgaacgtaacggtaaccgtcggaaccggacccgaccggttacccgttagttacgttacgtaagtacggtttaaacgtaaagttaaacgtaaaccgtacggtaagtcgggtaaaccggtccggtacccggtaacgggtacgtacccgttcgcgtaacggtacgtttaccgttcgtccgttacggaccttacggacgaccgtaccgggaaacggtaaactacggtccgtaacgttacggtactaacgtcgacggtcgttagggaccgtacgaacgggaacgaaggtaccgtaggacgttacgtaagtttacgtttactacgttacgaactacggtacgaactaaccgacgaaaccacgtaaacttccgggtacggtttaccgttacggggttaccggaccgggtacggtaaccgttaacgggtccgtttaaccggtaacccggttacgtaccggttacccgtaccgggaacccgttaccccgggcgttacccccgacccggtttcccgg

SEQ ID NO: 157075 - DNA, 742 bp, Homo sapiens
  misc_feature: GYAE6OF02H93O5.35.15.B04.1.454.CMB.1.raw
  modified_base (183)..(183): a, c, t, g, unknown or other
  misc_feature (183)..(183): n is a, c, g, or t
  modified_base (199)..(199): a, c, t, g, unknown or other
  misc_feature (199)..(199): n is a, c, g, or t
tcagtacagatcgtcacgaccggtgctcgatttagacagtatatatccgcggggctggggagcctagctgtgctgtgggtccaggaggcagaactctgggtgtctcaccatggcctggatccctctacttcctccccctcctcactctctgcacaggctctgaggcctcctatgagctgacanacgcccaccctcggtntcagtcgtcccagacagacgccaggactcaccgtgctcgtaggagtatcgactagttcgaccaaaagcctaatattacttagttcggaaccagacaagtaacgtcacggaccacggtcccttagtacgtttcgagtgaatacggtaataaaggactacgtagacggtacgtaccctagacgggtactaccggtagacggtacctacgttccgttcgtacggtaccttaccggaagtccgttaacggaaacgggtaacctaaaccgtaacggttacctaacccgggtttaacgaaccttaagtaccggtaacggggtcgtaaaccggttacccgaagggtacccaaaggggtaaccggtaaaccggtacggggttcctaaaggttaaacgttttacgtttaaaccgttacgtaaactaaacgttcctaaaccggaccgtaacctaaccgaaacccgtttaaaccgtacgttaacccgggtttccgtagggtttacccgggaacggtaaccggtaacctacggttacccgacggttaacccccgg

SEQ ID NO: 157076 - DNA, 676 bp, Homo sapiens
  misc_feature: GYAE6OF02GTCV8.35.15.B04.1.454.CMB.1.raw
  modified_base (143)..(143): a, c, t, g, unknown or other
  misc_feature (143)..(143): n is a, c, g, or t
  modified_base (171)..(171): a, c, t, g, unknown or other
  misc_feature (171)..(171): n is a, c, g, or t
  modified_base (294)..(294): a, c, t, g, unknown or other
  misc_feature (294)..(294): n is a, c, g, or t
tcagtacagatcgtcacgaccggtgctcgatttagacagtatatatccgtgtcaggtgcagctggtgggagtctgggggaggcttggtcaagcctggaggtccctgagactgtcttgtgcagcctctggattcaccttcaganacctatttcatcgacctggatccgccanactccgagggaaggactggagtcggtatcacaccatcagcaaggtactggacaactcccatacgtacctacgacagactctgtagacggacactcactatttaggacaacgacgtacggtacnctcgtatctagactaaatcgaacacgacagaggacgtacggagaacaccggactagtattaacttatcgtagtaccaagtacgttactaggtagttagggtagcgttaggttcgttcggtacgttaaaccggtacgttaacgtaacggttaggtacgggtactcgggtaccggggaaccgaacggggtaacctaacgggtacccgtaacgtcctacccgtcctacggaccttaccgaccgtaaccggtccctacgttccggtacccctttcccgtacggtacccctacccgtccccaacggtaacgaccgtaccgtacccgtacgggaccgggtacgaaccggccggcccgggttaccccggcgggttacctcgggtacccg

SEQ ID NO: 157077 - DNA, 761 bp, Homo sapiens
  misc_feature: GYAE6OF02GWR05.35.15.B04.1.454.CMB.1.raw
tcagtacagatcgtcacgaccggtgctcgatttagacagtatatatccgcgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacgccaggatcactgctctggagatgctattcgaccaaagcaaattataacttagttacggtaccagacagaagtcgaggccgacggccctagtattgagtgatagtaataaacgacacgtagagacggcctagacggactcccgagacgcgtattcgtcgtacggtcctccgacgccgtacggaacgggaacctaaacgtacgtaccgtaacgttaccggaaccctaagttaccggaaacgggttacgggtaacggttacccggaacgggtaacgtaaacggggtaaaacggaaaccgggtaacgggttacgttaacgggttaaacgtttttaaacggttaacgttacggttaaacctaacgttaccgaacgtaccgaaacggtaaccaacctaaaaccgttaacgtttacccggttaacccggtttagggttaaccggggtaccgggaacgggtaacccgaacgggttaacccgttaccggtaacccgttaacccggttaggtaacccgtaaccggtaccccggtaaacgggtccccggttacccggtacccccgttacccggg

SEQ ID NO: 157078 - DNA, 760 bp, Homo sapiens
  misc_feature: GYAE6OF02JU12F.35.15.B04.1.454.CMB.1.raw
  modified_base (492)..(492): a, c, t, g, unknown or other
  misc_feature (492)..(492): n is a, c, g, or t
  modified_base (629)..(629): a, c, t, g, unknown or other
  misc_feature (629)..(629): n is a, c, g, or t
tcagtacagatcgtcacgaccggtgctcgatttagacagtatatatccggcggggggtgggtccaggaggcagaactctgggtgtctcaccagtggcctggatccctctacttcctccccctctcactctctgcacaggctctgacgcctctagtgagctagacacacgcccacccgttgggtctcacggtccggtaccccaagggaccacggacccggcctagggattcccacccgtggtcctaccggtgggactacgttgaccgttagttacgaacccggtaaaatctaaacttaacttaccgtttaaggtttaccggtaaccaggtaccgaaacggtaaacgggtaccgaccgggtaccccgtaccgggtccccgttagttaggttacggaacgttacgggtagttaacgtaaacgtaaaacgggtccaacggtacgggtaacggtaccgtacccgtggaacgggtctccggagtaccgtgtacttcgngtacgtcctacggatacgcgagaactcacgttgacgtcgtcagtacgtcggtacggtacgacgtacgaagacggttaacgacggtagttacgttacgtagtttactaacgtacgtttacaacgtacgagaccgtaanaccgaaccgtaacgtagtacccgtttagtacggggttacggccggtaaacggaccgtggtaccgtacgggtacccgttaccgtaggttaccccgacgggttaccgaccggtttccgccccggtaccgtccg

SEQ ID NO: 157079 - DNA, 657 bp, Homo sapiens
  misc_feature: GYAE6OF02IQ1J7.35.15.B04.1.454.CMB.1.raw
  modified_base (229)..(229): a, c, t, g, unknown or other
  misc_feature (229)..(229): n is a, c, g, or t
tcagtacagatcgtcacgaccggtgctcgatttagacagtatatatccgcgggggtgggtccaggaggcagaactctgggtgtctcaccatggcctggatccctctacttctccccctcctcactctctgcacaggctctgaggcctcctatgagctgacacagcccaccctcggtgtcaggtcgtccccgaggacaggaccggccaggactccacctgctcgtggagntgactattcgaccaaagcaattacttacttagttacggtaaccagacgaagtaagtcgacggccgacggcccctgtacttgatagtagtagtaataaaacgactacgtagaaggtccgaccctagaacgggacctaccgtagacgtcgtacgttcctcggtcgcctcgacgtccgtacggaacggaactaacgtcgtacgtacgtacgacctagtacgtaggtacgtacgtacgaggacgaaaggaacgacggtacggtcttaaggttaactttacgttaacgtagtacgtaactacgaagtacaaacgacccaaacgtaactaacgttcgttaaccggttggtaccgggacgggtacggacgaacggtccgtaccggtaccgttccggtacgcgaccggaccgtacgccgtacccgtccccgtacgg

SEQ ID NO: 157080 - DNA, 716 bp, Homo sapiens
  misc_feature: GYAE6OF02I6O48.35.15.B04.1.454.CMB.1.raw
tcagtacagatcgtcacgaccggtgctcgatttagacagtatatatccgcgggggtgggtccaggaggcagaactctgggtgtctcaccatggcctggatccctctacttctccccctcctcactctctgcacaggctctgaggcctcctatgagctgacacagcctaccctggtgtcagtcgtccccaggacagacggccaaggactcacctgctccgtaggacgtatggctattgaccctaaaagctaaatacttaacttaagttacggtaaccagaccgaaggaaacgttacgaaggccccgaacgggccccctaggtacttagataggtatacgtaattaaaaggactaacgtaggaacgtacggcccttacgaagggtactacccgtagaggcgtaacttctctcggtacctaccagtctacgagggacaacgagtcctaacgttcgaaccagttaccaaggtacgggtacgtaccgtaacgggtacaaacgggaacgaacggaggtactaaggtaatttaacgttaactacggtacaaacgttacgtaacgacgtaaacgaaccaaccgtaaaacgtaaactacgggttaccccggtttagtttcgggaacggtaccggggtaaccgaacggtaccggtacggtaacccgttacggtaacgaccgtacggtaaccccgtaacggtcccgtaccggtcccccgttaaccgg

SEQ ID NO: 157081 - DNA, 648 bp, Homo sapiens
  misc_feature: GYAE6OF02HPRF0.35.15.B04.1.454.CMB.1.raw
  modified_base (167)..(167): a, c, t, g, unknown or other
  misc_feature (167)..(167): n is a, c, g, or t
  modified_base (237)..(237): a, c, t, g, unknown or other
  misc_feature (237)..(237): n is a, c, g, or t
  modified_base (283)..(283): a, c, t, g, unknown or other
  misc_feature (283)..(283): n is a, c, g, or t
tcagtacagatcgtcacgaccggtgctcgatttagacagtatatatccgcgggggtgggtccagggaggcagaactctgggtgtctcaccatggcctggatcctctacttctccccctctcactctctgcacaggctctgacgcctctatgagctagacacagcccnccgtcggtgtacagttcgaccccaggacagacggccaggatcacctgctgtggagtatgctatcgacaanacaatatcttatcgacagacagactcaggcacgcctagtatagtangtatgtaactaaagtacactaggacggtacgtccctaggaggaccttccgagacgacgtacttactcggtcgactccagccgtgaacgaaccaacgtagtacgtacgttacgactaagtacgtaggtacggtacgtaccggaaggacggaacgaaacgacgggacggactttaagacgttttaacttacgtacgtaacaagtcgtaacgacacgaaccaactaaacttaaacgtccgttaacgggtttacggttacgggtacgggaaccggtaaccgtacggaccttaaccgggtaacccttaccggtaacggcccgaaccggtaccccggaaagggtccccttacccgggcccctttaacccgg

SEQ ID NO: 157082 - DNA, 886 bp, Homo sapiens
  misc_feature: GYAE6OF02JJKL4.35.15.B04.1.454.CMB.1.raw
tcagtacagatcgtcacgaccggtgctcgatttagacagtatatatccgcgggggggtccaggaggcagaactctgggtgtctcaccatggcctggatccctctacttctccccctcctcactctctgcacaggctctgacggcctcctatcgagtctgacacacgcccacctcgtgtcgagtcgtacccaggacacggaccggaccgtacggattaccgacctcgccttcgtagggtaacgtatcgtaccgtaagttacgaacccgaaaagacctaaagttacttaaccgtttagttacgggttaaccaacgaccgtaaggaaacggttaccgacggtacccgtacccggtaccccgttagttacgttagtacgttaggattaagttaaacgtaaacgaacctacgtaacgtacggtaccggtacccgtacggtaacgggtaccgttacccgtacgggtacgtaccgttaacgtttcggaccgttccggtccgttaaccggtacggtacctaacgggtaaccgaaaccgttaacgacccggtttaaccgtaacgggtttaccaacccggttaacgttaccgtagggttaccgtaaccgggttaacgacgggaacgtaaacggtaaacgggaaccgggttacgtacccggttaaaggtttaaacgtttaccggtaacgttaaaccgtaactaaaccggttcgaaacgttacgaaaccggaaccctaacgtaaaccgttagttaacccgggtttacggttaacgggtaacgggtaccgggtacggaaacccggtaccgttaaccggtaacgttaccgttaaaccggtccggttaccaccggaacccggtaccgtccccgtaccccggttccgttacccgttaacccg

SEQ ID NO: 157083 - DNA, 793 bp, Homo sapiens
  misc_feature: GYAE6OF02F7UDF.35.15.B04.1.454.CMB.1.raw
tcagtacagatcgtcacgaccggtgctcgatttagacagtatatatccgcggggggtccaggaggcagaactctgggtgtctcaccatggcctggatccctctacttctccccctctcactcgtctgcacaggcctctgacggcctcctatggagctgacacacgccacccgttggtgtcagtcgtcccgaggacagacgcaggatccgactgctcgtaggactagtgactagttcggaccaaagtcctaaattacgttaacgtttagttaccggtaccacgtacgtaagtaacgtcgaacggtccgtaaccgggtcccttaaggtttacgttaggacgtttacggtaactttaaggttaaagttaaaccggaccgttacgtagggaaaccggtacccgggtacccggtaggtaaccgggtaccttaccccggtaggtaccggtacgtttaaccgttcgttccggtacgtaccctacgtacgtacggtaccggaacggtaacaaccgtacggttacgtactacgacgtactacggtaggtacgtaccgtcgacgggtaacaacgggaaagtacccggtagtacttagtaacgtttacgttactacgtacgtaacacgtacgtaacccacgtaaacctaaccgtaaacgttacgttccccgggtttcgtttacgggaccggggtaacggacgggtaacctaacgggtttcccggaaccggttacccgttaacgggttacacccggtaaccgtcggtaaccggtccccttaccccggggtccctaggttaccccg

SEQ ID NO: 157084 - DNA, 768 bp, Homo sapiens
  misc_feature: GYAE6OF02FRARW.35.15.B04.1.454.CMB.1.raw
tcagtacagatcgtcacgaccggtgctcgattttagacagtatatatccggcgggggtgggtccaggaggcagaactctgggtgtctcaccatggcctggatcctctacttctcccctctcactctctgacacaggctctagagcctacctatgagtctagactacacgaccacccgtggtagtcagtcgtacccgaggtacgagaccggaccgaggacctacgacgtgtcgtacgtaggagatacggctaattcgaaccaaaagtcaaattacgtacttaacgttggaaccagtacgaacgaacgtacacggaccgtaacggacccctagttactagtacggtacgtaagtacggtaaagaaaacgaccgtaacgttaggaaggacggtacctacgaacgggtacgtacccgtaggaaccggtcgttaacgttaccgtacgttcggacctaacgtacggtaccgtaggtaaaccgggtaaaccgtaaacggtggttaacccggtttaacgttaacgtaaccgtaaacgtaccgtaaggttaaccgggaccgttaaccgaacgggttaaaccgaaggtaaaccggaacggttaacggttacgtaagttaacttaacgttaccggtagtaaccagttaaccgagtacctaacgactaacccgaaataccgtacgttaccgttgggtaacggacgtaacggaacgtaacgtcgtaaccgtaccgttacgtaagacctaacgccggtaaccggtcgtaccgcccggtaacg

SEQ ID NO: 157085 - DNA, 860 bp, Homo sapiens
  misc_feature: GYAE6OF02ITVRD.35.15.B04.1.454.CMB.1.raw
  modified_base (104)..(104): a, c, t, g, unknown or other
  misc_feature (104)..(104): n is a, c, g, or t
tcagtacagatcgtcacgaccggtgctcgatttagacagtatatatccgcgggggcctggggagcctagctgtgctgtgggtccaggaggcagaactctgggtntctcaccatggcctggatccctctacttcctcccctcctcactctctgcacaggctctgacgtcctctatgacgtctagacacgcgcctacccgttcggtcgtactaggtccgtaccccgaggaccgacggaccggacctaacggtactttaccctgccgtacgtagggaatctcgctagttcgtacaaaggttaaaggtttagtttttacgggtttacgaccgtaaggtaaacgtacgtacgaccggacccgcggttaccccgtggttccgttacggtctagttcggtacgaacggtaccgtaacgacggtcccgtacccgtaccggactcccgtaggacgtacgtacgtttcctcggtcgtacctccgtagcccgtaggacgggtactacggttcgtacctaccgtatcgtacacgttcgtaacggggtccggtaccggtagggacgggtaacggtggtaccggtacggtacttaaccgttactttaacgtttcggttaacggttttacgtaaacctaaacgttaaaccgtttaacgttaaccgtttagttttaaacccgttttttaacgggttttcggttttaacggggttaccgggttttaaccgggggaaccgggttttaaccggggttaaacccgttttaaggggtttaaccccgggtttacggtttaacccggtttaaacggggttacccggggttacccaaccggggttaacccccggttaaccccgggtccttaccccccccggggg

SEQ ID NO: 157086 - DNA, 608 bp, Homo sapiens
  misc_feature: GYAE6OF01D1RB3.19.57.F02.1.454.CMB.1.raw
  modified_base (327)..(327): a, c, t, g, unknown or other
  misc_feature (327)..(327): n is a, c, g, or t
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaacccctaagctcctgatctatggtgcatccactttggaaagtcggggtcccctnaaggttcagcggcagtggatctgggacagatttcactctcgccatcagcagcctgcagactgaagtattttgactaactttatttttgtactaacaggtaccttaaacctacccttttaccccccttacttaacccgtttttccgggaccgggtaacggggaacccgtaaaggggttcgggaaacggtaacgttaccgaaacggtaccggtaaaccgttgggttacgggaccgtttacggaccctaacccgtaatttcccgtttcggttccctttaacccg

SEQ ID NO: 157087 - DNA, 601 bp, Homo sapiens
  misc_feature: GYAE6OF01BDD3S.19.57.F02.1.454.CMB.1.raw
  modified_base (304)..(304): a, c, t, g, unknown or other
  misc_feature (304)..(304): n is a, c, g, or t
tcagtactctcgtgcacgaccggtgctcgatttagctcgatatagttgggtttgggggcaggagtcagacccagtcaggacacagcatggacatgagggtccccgctcagctcctggggctcctgcctgctctggttcccaggttccagatgcgacatccagtatgacccagtctccatcttccgtgtctgcatctgtaggagacagagtcaccatcacttgtcgggcgagtcaggatattaggcgctcgttaggctggtatcagcagaaagcagggaacccctagcctcctgatctagtggtncatcctacgtttggaaagtcggggtacccctagaaggttcaggacggacaggtggagtcgtgggacagtactttcactctcgccatcagcagcctgacagactgaagtattttgacttaatttattttgactaacgtaggtaccttaaacctacccttttaccccctactaccgttttaccgggaccgggtaacgggtaaccctaaaggggttcgggtaagtacgttaccgaaacggtccgtaaaccgttgggttacgggtaccttacggtaccctaacccgttagttccgttacgg

SEQ ID NO: 157088 - DNA, 605 bp, Homo sapiens
  misc_feature: GYAE6OF01DHD4K.19.57.F02.1.454.CMB.1.raw
  modified_base (201)..(201): a, c, t, g, unknown or other
  misc_feature (201)..(201): n is a, c, g, or t
tcagtactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtagganacagagtcaccatcacttgcgggcagtcaggatattaggcgctcgtaggctggtatcagcagaaagcacgggaaacccctaagctcctgatctatggtgcatcctactttggaaacgtgggtcccctagaaggttcaggcggacaggtggatcgtgggacagtatttcactctcgccatcagtcagcctgcagactgtaagtatttgactaactttattttgactaacgaggtaccttaaccgtaccctttccccctacgttaaccgttttccggggaccggtaacggggtaacccgtaaaggggttacgggtaaacggtaacgtaccggaaacggtcccgggtaaaaccgttcgggttacgggtaccgttacggacccgtaacccgtaagttccgtttaccgg

SEQ ID NO: 157089 - DNA, 519 bp, Homo sapiens
  misc_feature: GYAE6OF01DOG53.19.57.F02.1.454.CMB.1.raw
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaccccctaagctcctgatctatggtgcatccatttggaaagtggggtccctcaaggttcagcggcagtggatctgggacagatttcactctcgccatcagcagccctgcagactgaagtattttgctaactttatttttgtactaactaggaccttaacctaccttttcccccctctacgttttcggcgggtagggaccaagggtggagatcgaaagcgaactggtggctgcaccatctgttcttac

SEQ ID NO: 157090 - DNA, 541 bp, Homo sapiens
  misc_feature: GYAE6OF01BE0F9.19.57.F02.1.454.CMB.1.raw
  modified_base (534)..(534): a, c, t, g, unknown or other
  misc_feature (534)..(534): n is a, c, g, or t
tcagtactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttggtcgggcgagtcaggatattaggcgctcgttaggctggtatcagcagaaagcagggaaaccccctaagctcctgatctatggtgcatccactttaggaaaggtcggggtcccctgaaggttcagcggcagtggatcgtgggacagtatttcactctcgccatcagcagcctgcagactgaagtattttgctaactttattttgacaactaggtaccttaacctaccttttccccctactaccgtttccgggacgggtacgggtaacccaaagggttggacgattacaaggccgaactggtagctagaccacctntcgttcg

SEQ ID NO: 157091 - DNA, 594 bp, Homo sapiens
  misc_feature: GYAE6OF01AWVSS.19.57.F02.1.454.CMB.1.raw
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcaagaaagcgaacgggaaaccccctaagctcctgatctatggtgcatccatttaggaaagtcgggtcccctgaaggttcaggcggcagtggatcgtgggacagtatttcactctcgccatcagcagcctgcagactagaagtattttgacttaactttattttcgactaacgtacgtaccttaaacctacccttttccccctactacgttttccgggaccggtaacgggtaacccgtaaagggttacggaagtaaccgttacgtaaacggtaccggtaaacgttcgggtacggtacctcggtacctacccgtaagttccttggttacctttaccg

SEQ ID NO: 157092 - DNA, 582 bp, Homo sapiens
  misc_feature: GYAE6OF01CTDNL.19.57.F02.1.454.CMB.1.raw
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaaccccctaagctcctgatctatggtgcatccactttggaaagtggggtccctcgaaggttcagcggcagtggatctgggacagatttcactctcgccatcagcagcctgcagactgaagattttgactaactttattttttgtactaaacgtaggtaccttaaccgtaccctttttaccccccttacctaccgttttccgggaccgggtacggggtaacccgtaaacggggtgggaaggtacgttaccgaaaggtaccggtaaacgttggtacggcctacggccaacccgtatccttcgttctttaccg

SEQ ID NO: 157093 - DNA, 563 bp, Homo sapiens
  misc_feature: GYAE6OF01D9HTG.19.57.F02.1.454.CMB.1.raw
  modified_base (407)..(407): a, c, t, g, unknown or other
  misc_feature (407)..(407): n is a, c, g, or t
tcagtactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacgttggtcgggcagtcaggtatagttaggcgcttcggttaggctggtatcgagcaaggaagcgaacgggaaaccccctaagcctcctgatctatggtgctatcctacgtttaggaacggtcgggtaccctagtaaggtcaggcgcgtaggtggatcgtaggactagtacttcacttctcgactactcagcncgcctgcagactagtattatttagacttaacttttattttcgactaacgtacgtaccttaaccttccctttacccctcgttaccggttcggacggtacgggaccgtaagggtagacgactacgacgtacgacgtgcgtcacgaccactgtcgttcg

SEQ ID NO: 157094 - DNA, 544 bp, Homo sapiens
  misc_feature: GYAE6OF01BTXFH.19.57.F02.1.454.CMB.1.raw
tcagtactctcgtgcacgaccggtgctcgatttagctcgatatagttgggtttggggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttggtcgggcgagtcaggatattaggcgctcgttaggctggtatcagcagaaagcagggaaaccccctaagctcctgatctatggtgcatccactttggaaagtcgggtccctcgaaggttcagcggcagtggatcgtgggacagatttcactctcgccatcagcagcctgcagactgaagtattttgactaacttttattttcgtactaacgtaggccttaaccgtacccttttccccctctaccgttttaccgggacgggtacgggaaccaagggtggagtatacgaagcggaatcggtggctcggacacctatccgtgttcttaccg

SEQ ID NO: 157095 - DNA, 572 bp, Homo sapiens
  misc_feature: GYAE6OF01DMK7K.19.57.F02.1.454.CMB.1.raw
  modified_base (299)..(299): a, c, t, g, unknown or other
  misc_feature (299)..(299): n is a, c, g, or t
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaaccccctaagctcctgatctatggtncatccatttggaagtgggtccctgaggttcagcgcagtgatctggacagatttcactctcgccatcagcagccctgacagtactgtaagtattttagacctaacttttagtttttgtactaaacgtacggtacttaaaccgtacccttttccccctactaccgtttcgggacgggtacgggaacccgtaagggtcggaagtacgtacgaaacggtccgtaaacgttggtagggccttacgggtaccaacctagttcttcggttcctttacccg

SEQ ID NO: 157096 - DNA, 750 bp, Homo sapiens
  misc_feature: GYAE6OF01D4COW.19.57.F02.1.454.CMB.1.raw
tcagtactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacgagtacgtaccactactacttacgttcgggtccgggacgtacgtacggaagtattaaggttacggccgtccgtttacgggttacggtcgttaggttactacgacgacgaaaaggaaccgaccgggtaaaacccccggtaaaacccctacgtccttaccgtagtacttacgtaggtggtcgactaccgtaccgttaggtttaaacgggaacggggttccccggtcctaaggttacggtacgacggtcggacgtagggtagtactcgggacggagtagtttacttcctacttccgccgaactctaacgcgacgtacccgtctaggacgtaacttcggtaaaggtacttttcgtactaaaccttttattttttagttaccaacaaacggttaccttaacccttaacccttttcccccctttacccgtaacgtttccgggttaccggggaaggggtaacccgtaacggtaaggggtacgaagttaaccgtaaggacggtaaccgtaggttcgggtaccgtcgacccgaacccttacgttagttccgtttcg

SEQ ID NO: 157097 - DNA, 524 bp, Homo sapiens
  misc_feature: GYAE6OF01B0VON.19.57.F02.1.454.CMB.1.raw
  modified_base (197)..(197): a, c, t, g, unknown or other
  misc_feature (197)..(197): n is a, c, g, or t
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtagganacagagtcaccatcacttgtcgggcgagtcaggatattaggcgctcgtaggctggtatcagcagaaagcagggaaccccctagctcctgatctatggtgcatccactttgggaaagtcggggtcccctgaaggttcaggcggcagtggatcgtgggacagatttcactctcgccatcagcagcctgcagactgaagtatttgactaactttattttcgtactaactaggtaccttaacctacccttttaccccctactaccgtttcgggacggtacggaccgaagggtgagatacgaagacgaactgtagctagcacatctgtcttc

SEQ ID NO: 157098 - DNA, 567 bp, Homo sapiens
  misc_feature: GYAE6OF01CD4B0.19.57.F02.1.454.CMB.1.raw
  modified_base (327)..(327): a, c, t, g, unknown or other
  misc_feature (327)..(327): n is a, c, g, or t
tcagtactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgcgggcagtcaggatattaggcgctcgttaggctggtatcagcagaaagcagggaaaccccctagctcctgatctatggtgcatccactttggaaagtcgggtccctnaaggttcagcggcagtgatcgtgggacagatttcactctcgccatcagcacgcctgcagactagtaagtattttgactaactttatttttacgactaactacggtaccttaaacctacccttttaccccctcgtacccgtttcgggaccggtacgggtaaccgtaaagggtacggaagtacgtacgtaaacggccgtaaacgttggtacgggtacctaggacccaacctgttcgttaccg

SEQ ID NO: 157099 - DNA, 567 bp, Homo sapiens
  misc_feature: GYAE6OF01BR5SY.19.57.F02.1.454.CMB.1.raw
  modified_base (328)..(328): a, c, t, g, unknown or other
  misc_feature (328)..(328): n is a, c, g, or t
  modified_base (397)..(397): a, c, t, g, unknown or other
  misc_feature (397)..(397): n is a, c, g, or t
tcagtactctcgtgcacgaccggtgctcgatttagctcgatatagttgggtttggggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaaccccctagctcctgatctatggtgcatccactttggaaagtcggggtcccctnaaggttcagcggcagtggatcgtgggacagtatttcactctcgccatcagcagcctgcagactgaagtnttttgcttaactttatttttgtacaactaggtaccttaacctaccttttcccccctattaccgtttcgggacggtacgggaacctaaggactgggaagtacgtaccgaaaggaccggtaacgttcgggtaggaccgttacggaccctaacccgtattccgttggttaccc

SEQ ID NO: 157100 - DNA, 564 bp, Homo sapiens
  misc_feature: GYAE6OF01BTQ8H.19.57.F02.1.454.CMB.1.raw
tcagtactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgcgggcagtcaggatattaggcgctcgttaggctggtatcagcagaaagcaagggaaaccccctaagcctcctgatctagtggtgcatcctacgtttgggaaagtcgggtcccctcgaaggttcaggcggcaggtggatcgtgggactagtactttcactctcgccatcagcacgcctgcagactgaagtattttcgacttaacttttattttgtacaactaggtaccttaaccttaccctttccccctacgtaccgtttccgggaccgggtacgggtaccgtaagggtgtaacggtataccgaaaggccgaacgtggtacggtctacgaccacctagtcttacg

SEQ ID NO: 157101 - DNA, 545 bp, Homo sapiens
  misc_feature: GYAE6OF01B2T6D.19.57.F02.1.454.CMB.1.raw
  modified_base (301)..(301): a, c, t, g, unknown or other
  misc_feature (301)..(301): n is a, c, g, or t
  modified_base (325)..(325): a, c, t, g, unknown or other
  misc_feature (325)..(325): n is a, c, g, or t
tcagtactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaacccctagctcctgatctatggtncatcacttggaacgtgggtccctnaaggttcagcggcagtggatcgtgggacagtatttcactctcgccatcagcagcctgcagactgaagtatttgactaatttattttgactaactacggtacttaacctacctttcccctacgttaccgtttcggaccgggtacgggtaacccgtaagggtcggaacgactacgaaacggcgtaaacgtggtacggtcttaggaccactagttcgttacgg

SEQ ID NO: 157102 - DNA, 596 bp, Homo sapiens
  misc_feature: GYAE6OF01EMZFE.19.57.F02.1.454.CMB.1.raw
tcagtactctcgtgcacgaccggtgctcgatttagctcgatatagttgggtttgggggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctaggtatcagcagaaagcagggaaaccccctaagctcctgatctatggtgcatccactttggaaagtcggggtccctgaaggttcagcggcagtggatcgtgggacagatttcactctcgccatcagcagcctgcagactagaagttattttgacttaacttttatttttgtacaacaggtaccttaaacctacccttttcccccttactaccgttttccggggacgggtaacggggaacccgtaaggggtacgggtaagtaacgttaccgaaacgggtaccgtaaaccggttgggttcgggaccttcggaccctaacccgtattccgttcggttcctttaccc

SEQ ID NO: 157103 - DNA, 625 bp, Homo sapiens
  misc_feature: GYAE6OF01BENHX.19.57.F02.1.454.CMB.1.raw
tcagtactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaagcgaacgggaaaccccctaagcctcctgatctagtggtgcatcctacgtttaggaaacggtcgggtcccctcgaaggttcaggcggcaggtggatcgtagggacagtactttcactctcgccatcagcacgcctgcagactagaagtattttgacttaacttttagttttacgtaactaacgtacggtaccttaaaccttacccttttacccccttacgttaacccggtttaccggggaccgggtaacggggtaacccgtaaaggggttcgggtaacggtacgttaaccgaaacggtacccggtaaaccgttcgggtacggtccgttacggaccctaacccgtagtttcccgttacg

SEQ ID NO: 157104 - DNA, 575 bp, Homo sapiens
  misc_feature: GYAE6OF01BVA47.19.57.F02.1.454.CMB.1.raw
  modified_base (298)..(298): a, c, t, g, unknown or other
  misc_feature (298)..(298): n is a, c, g, or t
  modified_base (394)..(394): a, c, t, g, unknown or other
  misc_feature (394)..(394): n is a, c, g, or t
tcagtactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcggcagtcaggatattaggcgctcgttaggctggtatcagcagaaagcaggaaccccctagctcctgatctatggtncatccactttggaaagtggggtccctcaaggttcagcggcaggtggatcgtgggacagatttcactctcgccatcagcagcctgcagactgaagtntttgactaactttatttttgtacaactacggacttaactacccttttccccctactaccgtttaccgggcgggtaacgggtaaccctaaagggtacgggtaacggaacgttaccgaaacggtcccggtaaacgttcgggtcgggtaccttacgggtacccaacccgtagttccgtttaccg

SEQ ID NO: 157105 - DNA, 534 bp, Homo sapiens
  misc_feature: GYAE6OF01AZ5JB.19.57.F02.1.454.CMB.1.raw
  modified_base (396)..(396): a, c, t, g, unknown or other
  misc_feature (396)..(396): n is a, c, g, or t
  modified_base (423)..(423): a, c, t, g, unknown or other
  misc_feature (423)..(423): n is a, c, g, or t
tcagtactctcgtgcacgaccggtgctcgatttagctcgatatagttgggtttggggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcaggatattaggcgctcgttaggctggtatcagcagaaagcagggaaacccctagctctgatctatgtgcatccactttggaaagtcggggtccctacgaaggttcaggcggcaggtggatcgtgggacagtatttcactctcgccatcagcagcctgcagactgaagtnttttgctaactttattttgactaacgnggtacttaacctccctttcccctctaccgtttcggacgggtacggaccgtaagggtgaagacgtacgaagtcgaacgttcggtggtactcgaccacctatcctgtccttac

SEQ ID NO: 157106 - DNA, 574 bp, Homo sapiens
  misc_feature: GYAE6OF01DHVGA.19.57.F02.1.454.CMB.1.raw
tcagtactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcaagggaaaccccctaagctcctgatctatggtgcatcctactttgggaaagtcggggtcccctgaaggttcagcggcagtggatcgtgggacaggtatttcacttctcgccatcagcagcctgcagactgaagtattttgacttaactttatttttcgtacaaacgtaggtaccttaaccgttacctttccccctcttaccgttttccgggacgggtaacgggtaaccgtaaagggttcggaagtaacgtacgaacggtccgaaacgttggtacggtcttacggacctaaccagttcgttacg

SEQ ID NO: 157107 - DNA, 725 bp, Homo sapiens
  misc_feature: GYAE6OF01B4BAY.19.57.F02.1.454.CMB.1.raw
  modified_base (202)..(202): a, c, t, g, unknown or other
  misc_feature (202)..(202): n is a, c, g, or t
tcagtactctcgtgcacgaccggtgctcgatttagctcgatatagttgggtttgggggcaggagtcagacccagtcaggacacagcatggacatgagggtcccccgctcagctcctggggctcctgctgctctggttcccaggttccagatgcgacatccagatgacccagtctccatcttccgtgtctgcatctgtagganacagagtcaccatcacttggtcgggcgagtcgaggatagttaggcgcttcggttaggctggtatcagcagaagcaacgggaaaccccctagctccgtagatctagtggtcgactataccgtaacgtttagggaaacggttcggggtacccctagtaaacggttcgaacggtcggacgtaggtacggtacgtcgtaggggactaaggttactttacctaaccgttccgttccggaccctagtaccgagccaacggtccttaggacctaaggtacctaggtaaacggttatttttacggaacctttaaacgtttttagtttttacgtaacctaacgtaacggtacctttaaacccttacccgttttaccccccgttagttaacccggttttaccgggaccggggttaacggggtaacccgtaaaggggtttaccgggaacggtaacgttaccggaacggtaacggtaaaccgttgggttaacgggtccctagggtaaccctaacccttaagttcccgtttaccgg

SEQ ID NO: 157108 - DNA, 561 bp, Homo sapiens
  misc_feature: GYAE6OF01DR2OF.19.57.F02.1.454.CMB.1.raw
  modified_base (552)..(552): a, c, t, g, unknown or other
  misc_feature (552)..(552): n is a, c, g, or t
tcagtactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttggtcgggcgagtcaggatattaggcgctcgttaggctggtatcagcagaaagcaagggaaaccccctagctcctgatctatggtgcatcctacgtttaggaagtcggggtcccctcgaaggttcaggaggcgagtggatcgtgggacagtatttcactctcgccatcagcagcctgacagactgtaagtattttagacttaactttatttttcgacaactacggtacttaacctacccttttccccctactaccgtttacgggccgggtaacgggtaccgaaagggtcggaagtactacgaaggccgaaacgtggtaggcctacgaccaaccnttccgttcg

SEQ ID NO: 157109 - DNA, 566 bp, Homo sapiens
  misc_feature: GYAE6OF01D3ZDY.19.57.F02.1.454.CMB.1.raw
tcagtactctcgtgcacgaccggtgctcgatttagctcgatatagttgggtttggggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcaggaaccccctaagctcctgatctatggtgcatccatttggaagtcggggtccctgaaggttcagcggcaggtggatcgtgggacagtattcactctcgccatcagcagcctgcagactagaagtattttgacttaactttatttttcgtactaacacggtacctaacctacccttttcccccttacttaccgtttccgggacgggacgggtaaccgtaagggtaggaacgtatacgaaacggaccgaacgttgggtcggtaccgtcggtaccaccctaatttccgtgttccttaccg

SEQ ID NO: 157110 - DNA, 615 bp, Homo sapiens
  misc_feature: GYAE6OF01B12WP.19.57.F02.1.454.CMB.1.raw
tcagtactctcgtgcacgaccggtgctcgatttagctcgatatagttgggtttggggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcaggatattaggcgctcgttaggctggtatcagcagaaagcacgggaaacccctagctcctgatctatggtgcactccacgtttgggaaacgtcgggtacccctcgacggttcagcggcaggtggatcgtggacagtatttcactctcgccatcagcagcctgcagactgaagtattttagacttaacttttatttttacgtactaacgtaggtaccttaaacctcccttttaccccctacgttaccggttttccgggccgggtaacgggtacccgtaaaggggtcggtaaacggtaacgttaccggaaacgggtaccggtaaacggttcgggttacgggtaccgttacgggacctacccgtatttcccggttgttcccgtttaacccg

SEQ ID NO: 157111 - DNA, 607 bp, Homo sapiens
  misc_feature: GYAE6OF01AJEI6.19.57.F02.1.454.CMB.1.raw
tcagtactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttggtcgggcagtcaggatattaggcgctcgttaggctggtatcagcagaagcacgggaaaccccctagctcctgatctatggtgcatcctaagtttagggaaacgtcggggtacccctagtaaaggttcaggcggcgaggtggatcgtgggacagtacttcactctcgccatcagcagcctgacagactagaagtatttcgacttaacttttattttacgtaactaacgtacggtaccttaacctacccttttaccccctagttacccgttttacgggaccgggtaacgggtaaccgtaaagggtacggtaacggtaacgttacgaaacgggtccgtaaacgttcgggtacggtacctacggaccctaaccgttacgttccgttaccgg

SEQ ID NO: 157112 - DNA, 675 bp, Homo sapiens
  misc_feature: GYAE6OF01B3DBZ.19.57.F02.1.454.CMB.1.raw
  modified_base (324)..(324): a, c, t, g, unknown or other
  misc_feature (324)..(324): n is a, c, g, or t
tcagtactctcgtgcacgaccggtgctcgatttagctcgatatagttgggtttggggggagtcagacccagtcaggacacagcatggacatgagggtccccgctcagctcctggggctcctgctgctctggttcccaggttccagatgcgacatccagatcgacccagtctccatccttccgtgtctgcatctggtaggagacagacgtcaccatctacgttggtcgggcgtagtcgaggatagttaggcgtcttcggttaggcttggtatcgagacaagaaacgcgaacgggaaaccccctaagcctacctgatctagtggtnctataccgtagttagggaaacggttcgggtacccctagtaacggttcgacggcggtacgaggtcggtacgtcggtagggaactagttatttccgaccgttcgtaccggacctaagtccgacgccgtaacggtccctaggaccgtaagtaaccgtaggtaagtttacgttttcgaactttaacgttttagttttacggtactaacgtacggtaccttaacccttacccctttccccgttacgttaccggtttccgggacgggtacggtaacgtagggtacgaacgtacgtacggaacggtacgtacggtcgtacgacgttacgacctaccgtagttccttagttccttaccg

SEQ ID NO: 157113 - DNA, 550 bp, Homo sapiens
  misc_feature: GYAE6OF01A0DK5.19.57.F02.1.454.CMB.1.raw
  modified_base (340)..(340): a, c, t, g, unknown or other
  misc_feature (340)..(340): n is a, c, g, or t
  modified_base (386)..(386): a, c, t, g, unknown or other
  misc_feature (386)..(386): n is a, c, g, or t
  modified_base (416)..(416): a, c, t, g, unknown or other
  misc_feature (416)..(416): n is a, c, g, or t
  modified_base (429)..(429): a, c, t, g, unknown or other
  misc_feature (429)..(429): n is a, c, g, or t
tcagtactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcgaacgggaaaccccctaagcctcctgatctatggtgcatcctactttgggaaagtgggaactccccgtntaacggttcagcggcagtggatcgtagggacagtactttcacttcncgaccatcagcagcctgcagactagaagtntttcgctaatttntttagtcaactaggtaccttaactcctttccccagtacgtttcggacgggtacggaccgtaaggggtcgagtactacgaacggtacgtaacgttgtacggtactagacctaccgtgttccg

SEQ ID NO: 157114 - DNA, 705 bp, Homo sapiens
  misc_feature: GYAE6OF01EGVNI.19.57.F02.1.454.CMB.1.raw
tcagtactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttcgtgtctgcatctgtaggagacagagtcacatcacgttgtcgggcgagtcgaggtattagttaggcgtcgtcggttaggctggtatcgagacaagaaacgccgaacgggaaaccccctaagcctaccgtgacttctagtggtcactactccgtacgtttagggaacggttccgggtacccctacggtaacggttcgacggcggacgtaggtcggtacgttacggtagggtacctagtttactttccgaacttccgtaccgaccgtactacgacgtaccgtacgtccgtagaccgaacgtacgttacgtaaagttacgtttttacgaacttttaacgtttttacgtttttacgaaccgtaaacgtacggttaacccttaaccgtttacccccttttaccccctacgttacccggtttaccggggaccggtaacgggtaacccgtaaggggtacgtacgtaacgtaccggaacggtaccgtaacgttcggtacggtaccgtacgacctaaccgttagttcgttaccg

SEQ ID NO: 157115 - DNA, 698 bp, Homo sapiens
  misc_feature: GYAE6OF01AW2BW.19.57.F02.1.454.CMB.1.raw
  modified_base (202)..(202): a, c, t, g, unknown or other
  misc_feature (202)..(202): n is a, c, g, or t
tcagtactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctggtagganacagagtcaccatcacttggtcgggcgagtcgaggtattagttagggcgtcgtcggttaggcttggtacttcgagacaaggaaagccgaacggggaaaacccccctaagcctcctgacttctagtggtgctactcctacgtttagggaacggtcgggtcccctagtaacggttcacggcggcaggtcggattcggtgggacaggtactttcacgttctacgcctatccgagtccgagtcccgtacggacacgtaccgtaggtaaacgtttagttttacgacctttaaacgtttttagtttttacgtaaccgtaaacgtaaccggttaacctttaaacccgttaccccgtttttacccccgttacgttaccggtttaccgggaccggggttaaccgggtaaccggtaacggggttaggaacggtacgtaccgaacggtaccgtaacgttcgggtcggtacccgttacggtaccctaccggttaacgttcgttaccgg

SEQ ID NO: 157116 - DNA, 599 bp, Homo sapiens
  misc_feature: GYAE6OF01B4KTR.19.57.F02.1.454.CMB.1.raw
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacgttgtcgggcgagtcaggatattaggcgctcgttaggctggtatcagcagaagcgaacggaaacccctaagctcctgactctagtggtgactataccagtttagggaaacggtcggggtcccctagaacggttcgagcggacaggtggatcgtgggactagtatttccatctccgcctatcgacgcagacctgacgagtactaggaacgttagttttcgaacttaacttttaagtttttacgtactaacgtacggtacttaaccctacccttttaccccctacgtaccgttttcggacggtacggaacgtagggtagacgtagtaccgaagtacggaaccgttggacggtaccgtcgacccgactattccgtcgttcgtttacccg

SEQ ID NO: 157117 - DNA, 585 bp, Homo sapiens
  misc_feature: GYAE6OF01EQ3BO.19.57.F02.1.454.CMB.1.raw
  modified_base (373)..(373): a, c, t, g, unknown or other
  misc_feature (373)..(373): n is a, c, g, or t
tcagtactctcgtgcacgaccggtgctcgatttagctcgatatagttgggtttggggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcaggatataggcgctcgttaggctggtatcagcagaaagcagggaaaccccctaagctcctgatctatggtgcatccactttggaaagttcgggtccctcaaggttcagtcggcagtgatctggacagatttcactctcgccatcancagcctgcagactgaagtattttgactaacttttatttttcgtacaacgtacggtaccttaaacctacccttttacccccctacgttaaccggttttccgggacgggtacgggaacccgtaagggtacggtagaacgttacgaaaggttaggaaaccgttgtacgggtactacggtacctaacccgtaagtttccttgttccctttaacccg

SEQ ID NO: 157118 - DNA, 625 bp, Homo sapiens
  misc_feature: GYAE6OF01C8L9G.19.57.F02.1.454.CMB.1.raw
tcagtactctcgtgcacgaccggtgctcgatttagctcgatatagttgggtttggggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatagttaggcgctcgttaggctggtatcgagcaaggaaacgcgaacgggaaaccccctaagcctcctgtactctagtggtcgactacttccgtaagtttaggaaacggttcggggtacccctaggtaacggttcgacggcggacgaggtggatcgtagggactagtacttcactctcgctatcagcacgctgacagtactagtaagtatttcgacttaatttattttacgactaagtacggtacctaaccttccctttacccccgtacgttaccggtttacgggaccgggtaacgggtaaccgaagggttacggaacgtaacgtaccgtaaaggtaccgtaacggtggtacggtctaccggtacctaaccgtattccgtttgtcctttaacccg

SEQ ID NO: 157119 - DNA, 586 bp, Homo sapiens
  misc_feature: GYAE6OF01ESJ2S.19.57.F02.1.454.CMB.1.raw
tcagtactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcaggatattaggcgctcgttaggctggtatcagcagaagcaacgggaaaccccctaagctcctgatctatggtgcatctacttggaagtcgggtccctgaacggttcagcgcagtggatcgtgggactaggtatttcactctcgcctatcagcacgcctgcagactagaagttatttcgacttaacttttattttgtaactaacgaaggtacctaaccgttacccttttcccccttacttaccgtttccgggaccggtaacgggtaaccgtaaagggtagggaacggtaacgtaccgaaaggtaccggtaaacgttgggtacggtacgtacggaccctaaccgtacgttccgttacg

SEQ ID NO: 157120 - DNA, 611 bp, Homo sapiens
  misc_feature: GYAE6OF01A46AG.19.57.F02.1.454.CMB.1.raw
  modified_base (303)..(303): a, c, t, g, unknown or other
  misc_feature (303)..(303): n is a, c, g, or t
  modified_base (346)..(346): a, c, t, g, unknown or other
  misc_feature (346)..(346): n is a, c, g, or t
tcagtactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcaggatattaggcgctcgttaggctggtatcagcagaagcacgggaaaccccctaagcctcctgatctatggtncactcctacttaggaaagtcgggtccctgtaaggttcagcggnaggtggatcgtagggactagtactttcacttcgtcgccatcagcacgcctagcacgtactagtaagtattttacgacttaacgttttattttacgtactaacgtaacggtccttaaaccgttaccctttacccccgttacgtaaccgttttccggggaaccgggtaacgggtaaacccgtaagggtacgggtaagtacgttacggaaacggtaccggtaaacgttcgggtacgggtcctacggaccacccgttatcccggttacg

SEQ ID NO: 157121 - DNA, 600 bp, Homo sapiens
  misc_feature: GYAE6OF01AM5W9.19.57.F02.1.454.CMB.1.raw
tcagtactctcgtgcacgaccggtgctcgatttagctcgatatagttgggtttggggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatagttaggcgctcgttaggctggtatcagcagaaagcaacgggaaaccccctaagcctcctgatctatggtgcatcctacgtttagggaaacgttcggggtcccctacgtaaggttcagcggcaggtggatcgtgggacagtatttcactctcgccatcagcagcctgcagactagaagtattttgacttaacttttattttcgactaacgtacggtaccttaacctacccttttaccccctacttaccgttttcgggaccgggtaacgggaacccgtaagggtcggaacgtaacgtacgaacggacggtaaacgttcggtacgggtcctacggaccctaaccgtacttccgttcgttcctttacccg

SEQ ID NO: 157122 - DNA, 578 bp, Homo sapiens
  misc_feature: GYAE6OF01AP5PX.19.57.F02.1.454.CMB.1.raw
  modified_base (396)..(396): a, c, t, g, unknown or other
  misc_feature (396)..(396): n is a, c, g, or t
  modified_base (415)..(415): a, c, t, g, unknown or other
  misc_feature (415)..(415): n is a, c, g, or t
tcagtactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcaggatataggcgctcgttaggctggtatcagcagaaagcacgggaaaccccctaagctcctgatctagtggtgcatcctacgtttgggaaacggtcggggtcccctagaaggttcaggcggcaaggtggatcgtgggactagtacttcactcgtccgcatcgagcncgctgcagactagtaagtnttttgacttaactttattttacgtactaaccgtaggtaccttaaccttacccgtttacccccgtacttaccgtttccgggaccgggtaacgggacctaagggtcggacgtagtaccgaaggccgtaacgtggtacggtactacgaccaccgtgttcgttaccg

SEQ ID NO: 157123 - DNA, 563 bp, Homo sapiens
  misc_feature: GYAE6OF01B6QF7.19.57.F02.1.454.CMB.1.raw
tcagtactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcaggatattaggcgctcgttaggctggtatcagcagaagcacgggaaacccctagctctgatctatggtgcatcctacgtttaggaaacgttcggggtacccctgaacggttcaggcggcaggtggatcgtgggacagtatttcactctcgccatcagcacgcctgcagactgaagtatttgacttaacttttattttcgtacaacgtaggtacctaacctaccctttccccctagtaccgtttcgggacgggtacgggtaaccgtaagggtggaacgtactacgaacggtccgtaacgtggtcggtacttacgacctacctagttccgttacg

SEQ ID NO: 157124 - DNA, 806 bp, Homo sapiens
  misc_feature: GYAE6OF01ENPA6.19.57.F02.1.454.CMB.1.raw
  modified_base (773)..(773): a, c, t, g, unknown or other
  misc_feature (773)..(773): n is a, c, g, or t
tcagtactctcgtgcacgaccggtgctcgatttagctcgatatagttgggtttggggggagtcagacccagtcaggacacagcatggacatgagggtccccgctcagctcctggggctcctgctgctctggttcccaggttccagatgcgacatccagatcgacccagtctccatcttccgtgtctgcatctggtaggagacagacgtccacctatcctacgttggcgggcgagtcgagggtattagttacgggccgtcgttacggttaggccgttggtactcgagacgaaaggaaaacggccgaaaccggggaaaccccctagtcctaccgtaggtactcgtagtcggtgtacctacgttacctacggtttaggaaaccggttccggggtacccctagtaacggttaccgacggtacggacgtaacgggtgtaacgttccgggtacgggtacgtaagtttaccgtttaccgtacccgttaccgtacccgtaaccctagtacccggtaaccgtccgaaccggtccgtacggtaacccgtaacgtaacccggttaagttaaaacggttttacgttttaccggtaaaccctttttaaacgttttttacggtttttaccgaacccgtaaaacggttacccggttaaccctttaaaccccgtttccccccgttttaacccccgtggtttaaccccggttaccgggaccggggttaacggtaacccggtagggttacggtacgtaacgtaaccgggacgtacgtaacggtgtaccggngtacgtacccacgttacttcgttgttctacccg

SEQ ID NO: 157125 - DNA, 844 bp, Homo sapiens
  misc_feature: GYAE6OF01BLCUQ.19.57.F02.1.454.CMB.1.raw
tcagtactctcgtgcacgaccggtgctcgatttagctcgatatagttgggtttgggggcaggagtcagacccagtcaggacacagcatggacatgagggtccccgctcagctcctgggctcctgctgctctggttcccaggttccagatgcgacatccagatcgacccagtcctccattcttccgtgtctgcatcgtagtaggagacagagtccacatcacgttcggtcgggcgtagtcgaggtatagttaggcgtcgttacggttaggcgttaggtactacgacggacaaaggaaaacgaccggaaacccggggtaaaacccccctaagtccgttaccgtagacttacgtagttgggactacctacgttaccgtacggtttaagggtaaacgggttccgggtacccctaggtaacggttacgacgggtcggacgtaggttcggacgttcgggtagggtaccctaagttaccgtttaccgtacgttacccgttaccggtaccctaacgttaccgaacggtccgtaaccggtcccgttacggaaaccgtaacggtaacgttaacggttaaagtttacgtttttaaccgacccgtttttaaagttttttaaccggttttacgaaccccgttaaacggttacggtttaaacccccgtttaaaccctttacccccgtttttaaccccccgttacggtttaacccggttttacccggggaccgggttaaacggggtaaccgtaaacggggttacgaacggttaacgttaacccgaaacggttccgggaaaccgtttggtaaccgggtaccgttaccggaacccttcgttaaaccgtttcgtttaacccg

SEQ ID NO: 157126 - DNA, 581 bp, Homo sapiens
  misc_feature: GYAE6OF01DBTCZ.19.57.F02.1.454.CMB.1.raw
  modified_base (198)..(198): a, c, t, g, unknown or other
  misc_feature (198)..(198): n is a, c, g, or t
  modified_base (379)..(379): a, c, t, g, unknown or other
  misc_feature (379)..(379): n is a, c, g, or t
tcagtactctcgtgcacgaccggtgctcgatttagctcgatatagttgggtttggggggagtcagacccagtcaggacacagcatggacatgagggtccccgctcagctcctggggctcctgctgctctggttcccaggttccagatgcgacatccagatgacccagtctccatcttccgtgtctgcatctgtagganacagagtcaccatcacttgtcgggcgagtcaggatattaggcgtctcgttaggctggtatcagcaagaagcaacgggaaccccctagctcctgatctagtggtgcatcctacgtttaggaaggtcgggtccctagaaggttcagcggacaggtggtatcgtaggacagtactttcacttcncgccatcagccacgcctgacgagtacgtaggtaagttatttacgacttaacttttagtttttcgactaacgaggtaccttaacctacccttttccccgtactacggtttcggacgggtacgggaaccgtaagggtaggacgtagtacgaacggtacggtaaccgttgggtcgtcgtacgaccacgtattcgtgttccgttac

SEQ ID NO: 157127 - DNA, 786 bp, Homo sapiens
  misc_feature: GYAE6OF01D0PQR.19.57.F02.1.454.CMB.1.raw
  modified_base (103)..(103): a, c, t, g, unknown or other
  misc_feature (103)..(103): n is a, c, g, or t
  modified_base (203)..(203): a, c, t, g, unknown or other
  misc_feature (203)..(203): n is a, c, g, or t
tcagtactctcgtgcacgaccggtgctcgatttagctcgatatagttgggtttggggggagtcagacccagtcaggacacagcatggacatgagggtccccgntcagctcctgggctcctgctgctcgtggttcccaggttccagatgcgacatccagatcgacccagtcctccattccttccgtgtctgcatctggtagganacagacgtcaccatctacgttggtcgggacgtagtcgaggattagttacggcgtcttcggttaggctaggtatcgagacaaaggaaacgaccggaaaccgggtaaaaccccctaagtccgttaccgtagtaacgttccgtaagtcgggtactacctaacttaccgttaaggtttaacggggaaacggttacccggggtaccccttaaggtaaccgggttcgacggtaccggtagtacggttaggtacgtacggtacgggtaactacggtttaacctttaccgaccgttaccgtaccgacctaacgttccggaacgtaccacggtaccccgttaggaaccgtaacggtaacgttaacggtaaagttttccgttttaacgaacctttttaaacgtttttcgtttaacgtaacccgtaaacggtacggtttaacccttaaccccgtttccccttaacccccggttacgttaacccggttacggggaaccgggtacggtaacggtaagggtacgtacgacgttaacggaacggtacgttaacggtggtaccgataccgactaccgtagtcctttcgtaccttacccg

SEQ ID NO: 157128 - DNA, 764 bp, Homo sapiens
  misc_feature: GYAE6OF01E4KRL.19.57.F02.1.454.CMB.1.raw
  modified_base (205)..(205): a, c, t, g, unknown or other
  misc_feature (205)..(205): n is a, c, g, or t
tcagtactctcgtgcacgaccggtgctcgatttagctcgatatagttgggtttgggggcaggagtcagacccagtcaggacacagcatggacatgagggtccccgctcagctccgtgggctcctgctgctctggttcccaggttccagatgcgacatccagatcgacccagtcctccatcttccgtgtctgcatcgtggtagganacagacgtccacctatctacgttggtccgggcgagtcgaaggtattacgttaggcgtcgttacggttaggcgttaggtactcgaagtacgaaggaaacgacccgtaaacccggggtaaaaccccctaaggtccttaccgtagaacgtttaccgtaagttccgggtctaaccgtacgttacccgtaacggtttaacgggtaaaccgggttcccgggttaccccgtaaggtaaccgggttcgaacggtaccggtacggtaacggttcgggtaacgttccggtaaaggggtaacgtacggtttaaccttccgtaaccgttccgtacggtaccctaagtccgtaacgaccgtacggtccctaggacctaacggacgttaggtaaacgttcgttttaacgacctttaacgtttttagtttacgaactaaccggttaacgtacccttaaccgttaccccttttccccgagttacccgttcggggaccggtaacggtaccgtaagggacggtaacgtactacggaacggtcgtacgttgccggactacggactacgtctgttaccg

SEQ ID NO: 157129 - DNA, 714 bp, Homo sapiens
  misc_feature: GYAE6OF01A8XIA.19.57.F02.1.454.CMB.1.raw
  modified_base (102)..(102): a, c, t, g, unknown or other
  misc_feature (102)..(102): n is a, c, g, or t
tcagtactctcgtgcacgaccggtgctcgatttagctcgatatagttgggtttgggggagtcagaaccagtcaggacacagcatggacatgagggtccccgntcagctcctggggctcctgctgctctggttcccaggttccagatgcgacatccagatcgacccagtcctccatcttccgtgtctgcatctggtaggagacagagtcaccatcacgttggcgggcagtcaggtattagttagggcgtcgtcggttaggcgtggtactcgagcaagaaacgccgaaccgggaaaccccctaagcctaccgtgacttactagtggtagcacttccgtacgtttacggggaaacggttccggggttacccctacgtaacgggttcgacggtcggacgtaggtcgggtaacttcggtacggggaactaggttacttttaccaccgttaccgtacgtacccgtactccgaagtccgacgtcctagacgaagtacgtaggtaagtttagttttacgaactttaacgttttagtttttacgacgtaaacgacggttaacccttaaccttaccccgtttcccccgttacgttacccggtttaccgggacgggtaacggtaaccggtaagggtacggtaagtacgtaacgaacggtcggtaaacggttcggtacgggtaccgttacggaccctaccgttattccgttcgttccgttaacccg

SEQ ID NO: 157130 - DNA, 644 bp, Homo sapiens
  misc_feature: GYAE6OF01C9NAH.19.57.F02.1.454.CMB.1.raw
  modified_base (424)..(424): a, c, t, g, unknown or other
  misc_feature (424)..(424): n is a, c, g, or t
tcagtactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcaggatattaggcgctcgtagctggtatcagcagaaagcacgggaaccccctaagctcctgatctatggtcgactatacctacgtttagggaaacggttcggggtacccctacgtaacggttcaaggcggacaggtggatcgtgggacagtactttcactctcgccatcagcagcctgacagtactagtaagttntttacgactttaaacttttagtttttacgtactaaacgtacggtaaccttaaacccgttacccttttaccccccgttacgtttaacccgttttccggggaacccggggtaaccggggtaacccgtaaacggggttacgggaacgtaacgttacggaaacggtaccggtaaaaccgttcggtacggtaccgtacggaccctaacccgtagttccgttaccg

SEQ ID NO: 157131 - DNA, 788 bp, Homo sapiens
  misc_feature: GYAE6OF01DHA0B.19.57.F02.1.454.CMB.1.raw
  modified_base (322)..(322): a, c, t, g, unknown or other
  misc_feature (322)..(322): n is a, c, g, or t
tcagtactctcgtgcacgaccggtgctcgatttagctcgatatagttgggtttgggggcaggagtcagacccagtcaggacacagcatggacatgagggtccccgctcagctccgtggggctcctgctgctctggttcccaggttccagatgcgacatccagatcgacccagtctccatcttccgtgtctgcatcgtgtaggagacagacgtcaccatctacgttggcgggcgagtcaggtatagttaggcgtcgtcggtaggctaggtatcagcaagaacgcgaaccggaacccctagcctacgtagtactcgtatggtcnctactccgtaacgttagggaacggttccgggtaccctaggtaacggttacgacggtcggtacgtaggtcggtaacgtcggtacgggtaactaaggttactttaccgaaccttaccgtacctaaccgtacgtaccgtacggaccgtaacggtcccgtaggaccgtaaggtaaccgttagggttaaacttttagtttaccggtaacttttaaacgtttttagttttaaccgaaccttaaacgggttaaccgttaaccctttaaccccgttttaaccccctttaacccccccggtttagttaaccccgggttttaccggggaaacccggggttaaaccgggtaaccggtaaacggggttaccggggtaaacgttaacggtaacccggtaaaggtacccggttaacgggtcgggttaaccggtccgtaaccggaacccctaaccggtttacgtttcccgggttttacccg

SEQ ID NO: 157132 - DNA, 561 bp, Homo sapiens
  misc_feature: GYAE6OF01BSV19.19.57.F02.1.454.CMB.1.raw
tcagtactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgcgggcagtcaggatattaggcgctcgttaggctggtatcagcagaagcagggaaacccctagctctgatctatggtgcatccactttggaaagtcggggtcccctacgaaggttcaggcggcaggtggaatcgtgggactaggtatttcactctcgcatcagcagcctgcagactagaagtattttgactaactttattttgtacaacgtaggtcctaaaccgtacctttcccctctaccgtttaccgggacggtaacgggtacctaaagggtcggaacgtacgtacgaaacggtccgaaacgtcggttcggactacggaccaccctaagttccgttaccg

SEQ ID NO: 157133 - DNA, 873 bp, Homo sapiens
  misc_feature: GYAE6OF01DTSH4.19.57.F02.1.454.CMB.1.raw
tcagtactctcgtgcacgaccggtgctcgatttagctcgatatagttgggtttggggggagtcagacccagtcaggacacagcatggacatgagggtccccgctcagctcctggggctcctgctgctctggttcccaggttccagatgcgacatccagatgacccagtctccattcttccgtgtctgctatctggtaggagacagagtccaccatccacgtttcggtcggggaccgtagtccgaaggtaacttagttacgggccgtaccgttacggttagggccgttagggttactacgaaggacgaaaggaaaacggaccgaaaccggggtaaaaccccccttaaggcccttccgtagtactttcgtaagtcggtacgacctaacttacccgttaacgtttaacgggtaaaccggttcccggggttacccctaaggttaaacgggttccgacgggaccgggtacgtaagggttacggtaacgttaccggtaaggggtaactacggtttaccttttacccgaaccgtttccgtacccggtaaccctacggttaccgaacgtaccgtaaccgtccccgtagggtaaccgaacggttaccgttaaaggttaacgtttactttttaccggaacctttttaaacgttttttagtttttaccggaaccttaaacggtaccggttaacccctttaaacccgttcccccgttttaaccccccgttaggttaacccgggttttacggggaaccggggtaccgggtaaacccggttaagggtacgggaaacttaaccggtaaccgtaaacggtaccgttaacggtcgggtacgttaccgaccgtaaccgtacctaagtttccgttacggttcctttaaccgg

SEQ ID NO: 157134 - DNA, 698 bp, Homo sapiens
  misc_feature: GYAE6OF01BE4YH.19.57.F02.1.454.CMB.1.raw
  modified_base (326)..(326): a, c, t, g, unknown or other
  misc_feature (326)..(326): n is a, c, g, or t
  modified_base (503)..(503): a, c, t, g, unknown or other
  misc_feature (503)..(503): n is a, c, g, or t
tcagtactctcgtgcacgaccggtgctcgatttagctcgatatagttgggtttggggggagtcagacccagtcaggacacagcatggacatgagggtccccgctcagctcctggggctcctgctgctctggttcccaggttccagatgcgacatccagatcgacccagtctccatccttccgtgtctgctatcgtgtaggagacagagtcaccatcacgttggcgggcaggtcaggtattagttaggcgtctcggttaggcttggtatcgagacaagaaacgacgaaccgggaaacccccctaagcctccgtagatctagtcggtnactactccgtaacgtttagggaaacggtccgggtacccctagtaacggttcgaacggcggtacgtaggtacggtactacggtacgggaactacggttacttacctaccgtcgtacccgtacctacgtcgacgtaccgacggtacctagaccgttaaagtaccgtaagtaacggtttntttacgaaccttttaacgttttacgtttcgtaactaaacgtcgttaacccttaacctttaccccgtttaccccgtacgtaccggtttaccgggacggggtaacggtaaccggtaagggtcggtaagtacgtacggaacgtacggtacgtggtaccgtactaccgtaccctagtaccgttacgttcgttctaaccg

SEQ ID NO: 157135 - DNA, 532 bp, Homo sapiens
  misc_feature: GYAE6OF01EUXUZ.19.57.F02.1.454.CMB.1.raw
  modified_base (305)..(305): a, c, t, g, unknown or other
  misc_feature (305)..(305): n is a, c, g, or t
  modified_base (424)..(424): a, c, t, g, unknown or other
  misc_feature (424)..(424): n is a, c, g, or t
tcagtactctcgtgcacgaccggtgctcgatttagctcgatatagttgggtttggggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgcgggcgagtcaggatattaggcgctcgttaggctggtatcagacagaaagcgacgggaacccctaagctcctgatctagtggtncatcctacgtttaggaagtcgggtccctacgaacggttcagcggctaggtggtatcgtgggacaggtacttcactctcgccatcagcagcctgcagactgtaagtatttgactaatttntttgactacgtagactaactcctttcccctagtcgttacggcggtacggaccgtaacgggtgaacgtgtacgaggcctaacgtgtacggcctgaccactgttcgtacg

SEQ ID NO: 157136 - DNA, 587 bp, Homo sapiens
  misc_feature: GYAE6OF01DDND8.19.57.F02.1.454.CMB.1.raw
  modified_base (447)..(447): a, c, t, g, unknown or other
  misc_feature (447)..(447): n is a, c, g, or t
  modified_base (570)..(570): a, c, t, g, unknown or other
  misc_feature (570)..(570): n is a, c, g, or t
tcagtactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttggtcgggcgagtcaggatagttaggcgcttcggttaggctggtatcagacaagaaacgccgaacgggaaaccccctaagcctccgtagactcgtagtggtcactactaccgtacgtttagggaacggtcgggtacccctagtaacggttcgaggtcggcgaaggtggagtcgtagggactagtactttcacctcgcgccatcagcacgcctgacacgactagtaagtntttgactttaactttacgtttgactaacgagttacctaaccttcccttaccctactaccgttcgggaccggtagggaccgtagggtcgagtaacgtcgaaggtccgaagttggacgtcgtacnccgtaacctgttctacg

SEQ ID NO: 157137 - DNA, 824 bp, Homo sapiens
  misc_feature: GYAE6OF01CHQCG.19.57.F02.1.454.CMB.1.raw
tcagtactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtcctccattcttccgtgtctgcatctggtaggagacagagtccaccatcacgttggtcgggcgagtcgaggtattagttaggcgtcgttcggttacggtcgttgggtactcgaaggtacaaggtaaacggaccgaaaccggggtaaaacccccctaagtcccgttccgtagtaacttaccgttaaggttcggtacgtacctaaccgttacccgtacggtttaacgggtaaaaccgggttccggggttacccccttacggtaaacgggtttccgaacgggtccggtacgtagggtcggtacgttcggtacgggtaactacggttactttaccgaccgttccgtccgtacctaagtccgtaacgtccgtacggtacccgttacggaacctacggtaaccgtaggttaaacgtttacgttttacgtaaccgttttaacgtttttacgttttacgtaaacgtaaccgtaaccggttaacccttaaacccgttaccccttttaccccccgtacgttaccgggtttacccggggaacgggtaaaccggggtaaccgtaacggggtacggtaacggtaaccgttaaccgtaacgggtacccggttaacggttagttaccgggtaccttaacggtacccttaaccgtcgtttccgttaccgg

SEQ ID NO: 157138 - DNA, 806 bp, Homo sapiens
  misc_feature: GYAE6OF01D1Y4I.19.57.F02.1.454.CMB.1.raw
tcagtactctcgtgcacgaccggtgctcgatttagctcgatatagttgggtttggggggagtcagacccagtcaggacacagcatggacatgagggtccccgctcagctccgtgggctcctgctgctctggttcccaggttccagatgcgacatccagatgacccagtctccattccttccgtgtctgcatctgtaggagacagagtcaccatcacgttggtcgggcgagtcaggattagtaggcgtctcggttaggctggtatcagacaagaaagcgaacgggaaaccccctagcctaccgtgactcgtagtggtgctactccgtaacgtttagggaaacggttccggggtacccctaggtaaacgggtttccgaacgggtccgggtacgtaagggttcgggtaaacgttcccgggtaagggggtaaaccctaacgggttaactttttacccgaaccgtttcccgtacccggtaaccctaacgttaccggaacgtacccgtaacggtccccgttaagaccgtaaacggtaaccgttaaggtaacgtttaacgtttttacggtaacctttaaacgtttttacgttttttacgaaaccgtaaccgtacgggtaacctttaaaccccgttaccccctttttacccccgtacgtttacccggttttacgggacccgggtaacggggtaacccggtaaagggtacgggtaacgtaaaccgttacgtaaaaccggtaccggtaaaacggttcggtaacgggtccgttaacggtaccaaacccgttagttacccgttagttaacgtttaccc

SEQ ID NO: 157139 - DNA, 558 bp, Homo sapiens
  misc_feature: GYAE6OF01DA8JE.19.57.F02.1.454.CMB.1.raw
  modified_base (241)..(241): a, c, t, g, unknown or other
  misc_feature (241)..(241): n is a, c, g, or t
  modified_base (257)..(258): a, c, t, g, unknown or other
  misc_feature (257)..(258): n is a, c, g, or t
  modified_base (298)..(298): a, c, t, g, unknown or other
  misc_feature (298)..(298): n is a, c, g, or t
  modified_base (419)..(419): a, c, t, g, unknown or other
  misc_feature (419)..(419): n is a, c, g, or t
tcagtactctcgtgcacgaccggtgctcgatttagctcgatatagttggggtttgggggggagtcagacccagtcaggacacagcatggacatgagggtccccgctcagctcctggggctcctgctgctctggttcccaggttccagatgcgacatccagatcgacccagtctccatcttccgtgtctgcatctggtaggagacagatcacatcacttggcggcgagtcaggatataggcncgtcgtaggctggtannagcaagaagcgaacggaaacccctagctctgatctatggnacatacctacgtttaggaaacggtcgggtcccctagaaggttcaggcggacaggttggatcgtagggaactagtactttcgactcgtcgaccatcagcaagcctagacagactagtaagtntttacgacttaacttttattttagacaacgtaggtaaccttaacctaccctttcccctagttacgttacggggacggtagggaaccgaaggtcggagtatacgaacgtacgactggtcgactgacactagtctgtctac

SEQ ID NO: 157140 - DNA, 799 bp, Homo sapiens
  misc_feature: GYAE6OF01BFEKI.19.57.F02.1.454.CMB.1.raw
tcagtactctcgtgcacgaccggtgctcgatttagctcgatatagttgggtttgggggcaggagtcagacccagtcaggacacagcatggacatgagggtcccccgctcagctcctggggctcctgctgctctggttcccaggttccagatgcgacatccagatcgacccagtctccattcttccgtgtctgctatctggtaggagacagacgtccacctatcctacgttggtcgggataggtcaaggtattagttaggcgtcgttacggttaggcgttaggtatcgacgtacaaggtaaacggacccgaaacccggggtaaacccccctaaggcccttaccgtacggtaacttaccgtaggttcggtacgtacctaacgttcccgttaacggtttacggggtaaaacggttcccggggtacccccttaaggtaaacggtttccgaacggccggtacgtagggtacggttaacgtcggtacggggtaacctaggttactttaccgtaccgttacgtccgtacctactcgagaccgtacgtcccgtggacctaaggtacctaaggttaactttacggttttacaaccgtttaacttttttagttttaccgaacgttaaaccgtaccggttaaccctttaacccgtttaccccccgttttacccccgtacggttaccgggtttacccggggaaccgggttaccgggtaaccgtaggggttaacggtaagaccgttaacggaaacggttcgaaccggttcgggtacgtaccgacggtacccttaacgtgttccgtttacccg

SEQ ID NO: 157141 - DNA, 751 bp, Homo sapiens
  misc_feature: GYAE6OF01DFKPN.19.57.F02.1.454.CMB.1.raw
tcagtactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacgttgtcgggcgagtcaggtatagttaggcgtcttcgtaggctggtatcagcaagaagcgaacgggaaacccctaagctacctgattctagtggtacgctaacttccgtacgttagggaacggttcgggtccctacgtaacgggttcacggcggtcgtaaggtggtaacttcgggtacgggactaacgttactttccaaccgtttcgtacccgtaccctagttaccgacgaccgtacggtcctacggacctaaggaaccgtttaggtaaacggtttagtttttaccgggtaacctttttaaacgtttttaactttttttaacgtaaccttaaacggtacccggttaaccctttaaaccccgtttacccctttttacccccccgttacgtttaaccccgggttttccggggaacccgggggtaaacgggtacccggtaaggggtaccggtaacggtaacgtacccggaaacggtaccggtaaacgttgggttaccggtaccgtaccggtaccctaaccgtacgtttcgttaacccg

SEQ ID NO: 157142 - DNA, 680 bp, Homo sapiens
  misc_feature: GYAE6OF01BDYXC.19.57.F02.1.454.CMB.1.raw
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccattcttccgtgtctgcatctggtaggagacagtacgtcacctatcgtacgttggtccgggcgagtcaggtaattagtacggcgtcgttcggtagctggtatcgagacaagaaacgcgaacgggtaaacccctagcctctagtatccgtagtgtcgactacgtacctaacgtttaggaacggttccgggtaccctacggtaacggttcgaacggcgtacgtaaggtcgaagttcgtaggggacctaaggttaccttttacgaacccgtttccgtacccgtactacgtaccgacgtaccgtaaccgtccgttacgacggtacgtaaccggtagttaaagttcgtttaagtacgtttaacgttttattttaccgaagtaaccgtacggtaccttaaacccgttccttaccctacgttacccgtttggggaaccgtaagggaccgtagggtagacgtaagtacgaacgtacgtacgtggtcgcgtacgacctactatttcgtcgttccttacg

SEQ ID NO: 157143 - DNA, 821 bp, Homo sapiens
  misc_feature: GYAE6OF01A9DIR.19.57.F02.1.454.CMB.1.raw
  modified_base (103)..(103): a, c, t, g, unknown or other
  misc_feature (103)..(103): n is a, c, g, or t
  modified_base (151)..(151): a, c, t, g, unknown or other
  misc_feature (151)..(151): n is a, c, g, or t
tcagtactctcgtgcacgaccggtgctcgatttagctcgatatagttgggtttggggggagtcagacccagtcaggacacagcatggacatgagggtccccgntcagctcctgggctcctgctgctctggttcccaggttccagatgcganatccagatcgacccagtctccattcttccgtgtctgctatcgtgtaggagacagagtccaaccatccgtacgttggtaccggggacgagttaccgaagggtattaagtttaggggccgtcgttcggttaagggccttaggggtacttccaaggtacaaggaaaacggacccgaaccggggtaaaacccccctaaggccttcccgtgtacttcgttagtcggtcacgtactccgtaacggttttacgggtaaacggttcccggggttaccccctaggtaacggtttaccgacgggaccggtacgtaggtacggtagttccggtacggggtactaacgttacgtttctaaccgttccgttcccgaccgtaagtacccgacggtacccgtacgcccgtttaggaccgtaacgggttacctaagggtaaacgttttattttaccgggtaaaccttttaaccgtttttaacgttttacgttaaccgaaaccggtttacggtaccctttaaacccgttacccccgtttaccccccgtttaacccttacgggtttaacccgggtttaccggggaacgggttaacccgggtaaacgggtacggtaggaacgttaccgtaacggtacggaacgtggttccggtgtaccgactacgtacctcgttccgttagttaccccg

SEQ ID NO: 157144 - DNA, 915 bp, Homo sapiens
  misc_feature: GYAE6OF01EZQU2.19.57.F02.1.454.CMB.1.raw
tcagtactctcgtgcacgaccggtgctcgatttagctcgatatagttgggtttgggggcaggagtcagacccagtcaggacacagcatggacatgagggtccccgctcagctcctgggctcctgctgctcgtcgtcctagtcagatgcgacactccgagacgtcgaccctacgtcctacctacttccgttccgtcgtcgtcgactacgttcgttagggtaacggaagaacgaacggtacgtacccaacctacttaccgtacggtttcggggaccgggtacggtaggtacggtaaggtaagtttaacggtacgggtccgtacggttcggttaaggcgttaggtactacgaacgtaacgaaaggaaaccgaacccgggtaaaaccccgggtaaaacccctacgtcccgttacgacgttacgttaccgtaggttcggtactactaccgttaccgttacggttaacgggaaccgggttcccggtacccgtaagttacggtacgacggtcggacgtaggtacgtacgttcgggtaacggtacttacggttactttaccgtaccgttaccgtaccgacccgtaacgtccgtaaccgtaccgtacccgttccgaacgttaacgaaccggtaacgttaaggttaacccgtttaagtttaccggttaacctttttaaacgttttacggttttaccgaaaccgtttaaccggtaacccgtttaaacccctttaaccccgtttttaccccccgtttacccgttaacgggtttaccccgggttaccgggggaaacccggggttaaaccggttaccgggtaaagggttacggtaaaccgttacgggtaacgggtaaacccggtaccgggttaggtaccggttaccgggtaaccgtaccctaacccggttcttacggttccctttacgg

SEQ ID NO: 157145 - DNA, 764 bp, Homo sapiens
  misc_feature: GYAE6OF01BSP1B.19.57.F02.1.454.CMB.1.raw
  modified_base (107)..(107): a, c, t, g, unknown or other
  misc_feature (107)..(107): n is a, c, g, or t
  modified_base (179)..(179): a, c, t, g, unknown or other
  misc_feature (179)..(179): n is a, c, g, or t
  modified_base (619)..(619): a, c, t, g, unknown or other
  misc_feature (619)..(619): n is a, c, g, or t
tcagtactctcgtgcacgaccggtgctcgatttagctcgatataggttgggtttggggcaggagtcagacccagtcaggacacagcagtggacatgacgggtccccnctcagctccgtgggctcctgctgctcgtcggttcccaggttccagatgccgacagtccagactcgaaccccngtcctccacttcgttccgtgtcctgcctatcgtaggtaggactacagtacgtccacctattcgacgtttggcgggacgtagtcgaggtacttaggttcggccgtacgttacggttaggccgttaggtaactccgaggacgaaggaaacgacggtaaaccgggtaaaccccctaggtccttacgtagtaacttacgtaacggtggtaccgtactaacgttacccggtttaacggtttacggggaaacgggtttcccgggtaccccgttaagtaacgggttacgaacgggccggtaacgtacggtacgggtctttacggacgggaaacttacgttaaccgtttcgaaccttccgtaccgacccgtaattccggaagacccgtacggtaccgttagaccgaagttaaccgtagttaacgtttacgttacgtacttaacgtttntttacgtacctaacgtacgtaccttaccgtaccctttcccgtagtaccggttacggaccggtacggtaccgtaggttacgacgtacgtaacgaacggtcgaaccggttgaccggtacgtacgtacctaccttagtccgtttaccg

SEQ ID NO: 157146 - DNA, 588 bp, Homo sapiens
  misc_feature: GYAE6OF01BEE7V.19.57.F02.1.454.CMB.1.raw
  modified_base (307)..(307): a, c, t, g, unknown or other
  misc_feature (307)..(307): n is a, c, g, or t
  modified_base (408)..(408): a, c, t, g, unknown or other
  misc_feature (408)..(408): n is a, c, g, or t
tcagtactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcaggatattaggcgcgtcgttaggctggtatcagcagaaagcgaacgggaaaccccctaagcctcctgatctatggtncactcctacgtttaggaaacggtcggggtacccctagaacggttcgacggtcggacaggtggactcgtagggactagtattcactctcgacactcagcgancctgcagactagaagttattttacgacttaacttttagttttacgttacaaacgtacggtaccttaacctacccttttcccctacgtaccgtttcgggacggtaacgggtaccgtaaaggtacggagactacggaacgtacggaacgttcggtacggtctacgacctactagttcgtacg

SEQ ID NO: 157147 - DNA, 881 bp, Homo sapiens
  misc_feature: GYAE6OF01APLU2.19.57.F02.1.454.CMB.1.raw
  modified_base (661)..(661): a, c, t, g, unknown or other
  misc_feature (661)..(661): n is a, c, g, or t
tcagtactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatcgacccagtctccatcttccgtgtctgcatcgtggtaggagacagacgtcaccatctacgttggtccgggcgagtcgaggtattagttacggcgtcgttacggttacggcgtagggttactacgaggtacgaaacggaaaacggtacccggaaacccggggtaaaaacccccccgttaaaggtccccttacccgttacggtaaccgtttacgtttaacggttcggggtacgtacccttaacgtttaacccccggtttaaacgggttttaacggggtaaaaccgggtttcccgggggttacccccctttaacgggtaaacggtttaccggaacgggtccgggacggtacgggtacgggttaacgtccgggttaacggggaacgttaaagttacccgttttaccgtaacccgtttccgtacccgtaacccgttaccgtaccgacggtacccgtacggtacccgtcggaacgtaacggtaccgttaaggttaaacggtttnttttaccgtacctttttaaaccgtttttagtttttaccgggaaccctaaacggttaccgttaacccgtttaacccctttacccgttttccccccgttaagtttacccggtttaccgggacggtaaccgggtaaccgtagggtacggtaacggtacgtaacgaacggtaccgttaaggttaccgtcggtaccgtacgacccgttaacctcgttacgttccg

SEQ ID NO: 157148 - DNA, 794 bp, Homo sapiens
  misc_feature: GYAE6OF01A4OVH.19.57.F02.1.454.CMB.1.raw
  modified_base (298)..(298): a, c, t, g, unknown or other
  misc_feature (298)..(298): n is a, c, g, or t
tcagtactctcgtgcacgaccggtgctcgatttagctcgatataggttgggtttggggggagtcagacccagtcaggacacagcatggacatgacgggtccccgctcagctccgtggggctcctgctgctctggttcccaggttccagatgcgacatccagactcgacccagtcctcctattccttccgtgtctgcattcgtaggtaggagacgagactaccaacctatctacgttggtcgggacgacgtcgaggtattagttacgggcgtacgtacggttaggctaggtatcgaganaagaacgaccgaaccggaaacccctagtcctacctagacttacgtagtcggtactaccacgttaccgttaacggtttaagggaaaccgggttcccggggttacccctaaggttaaaccgggtttcgacgggtaccggtaggtaacggttggaaccgtacgggtacgggtaacctaagggttacctttaccgaccgttcctaccggacctgtaccgaagtccgtaaccggcccgtaggaaccgtaaaggtaccgtaaggtaacgttttacgtttaacgacttttaaacgtttttgtttaacgtaaccgtaaaccgttacgttaacccctttaaacccgtttcccctttaccccgttacggttaacccgggttcgggaacggggaaccggtacgggtaaacgggtaggaaaccggtataaccgggtaacggaccggttaacgttggtacccgtacggttaccgaccctaacgttaggtttccctcgtttacctacccg

SEQ ID NO: 157149 - DNA, 805 bp, Homo sapiens
  misc_feature: GYAE6OF01C7WEI.19.57.F02.1.454.CMB.1.raw
  modified_base (484)..(484): a, c, t, g, unknown or other
  misc_feature (484)..(484): n is a, c, g, or t
tcagtactctcgtgcacgaccggtgctcgatttagctcgatatagttgggtttggggggagtcagacccagtcaggacacagcatggacatggagggtccccgctcagctcctggggctcctgctgctctggttcccaggttccagatgcgacatccagatcgacccagtcctccatccttccgtgtctgcatctggtaggagacagagtccaacctatcctacgtttggacgggcgagtacgaggtaattagtacggcgtcgttacggttaggcgtaggtatcgaagacgaaggaaacgaccgaaaccggggtaaaaccccctaaggtcctaccgtagaacttacgttaagtcgggtacacctaacttccgttaacggtttaagggtaaacgggtccggggttacccctaggtaaacggttccgaagggcggtacgaggtacggtacgtcggtagggaactagttactttaccgaccgttccnccgacataccgacgccgaacgtccgtacgacgtaacgtacgtaaggtaacgtttaaggttttacgaaacctttttaaactttttaacggtttttcgtaaacgtaaaccggtaaaccgggttaaccccttaaaccctttacccccttttacccccccgtttacgttaacccgggttttacccggggaacggggtaaacccgggtaacgggtaaacggggttacgggaaacggtaaacgttaacggaaacggtaacccgtaacggtttgggccgggtactacccggtaccctaaccggtacttacgttcgtttccgttacccg

SEQ ID NO: 157150 - DNA, 660 bp, Homo sapiens
  misc_feature: GYAE6OF01AKWJJ.19.57.F02.1.454.CMB.1.raw
  modified_base (197)..(197): a, c, t, g, unknown or other
  misc_feature (197)..(197): n is a, c, g, or t
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtagganactagagtcaccatcacgttgtcgggcgagtcaggatacttaggcgtctcgtaggctggtatcagcagaacgcgaacgggaaccccctaagcctctgattctatggtcgcattacccaagttttcgggaaacggttccgggggttacccccttacggtaacggtttccgaacgggtcggtacgtaggttagggactccggtaggggaactaggtactttccgactcgtcgacctagtcaggccaggtccctaggacgagtactaggtaagtattttcgaactttaactttcgttttacggttacaaccgagtacccttaacctcccttttacccccacgtaccgtttacgggaccggggttacgggaaccgtaaggggcgtaacgagtaccgtaacggcggtaaacgttcgttaccggggcttaccggaccctaaccgagtttccttcggtaccctttacccg

SEQ ID NO: 157151 - DNA, 803 bp, Homo sapiens
  misc_feature: GYAE6OF01D260L.19.57.F02.1.454.CMB.1.raw
  modified_base (107)..(107): a, c, t, g, unknown or other
  misc_feature (107)..(107): n is a, c, g, or t
tcagtactctcgtgcacgaccggtgctcgatttagctcgatatagttgggtttgggggcaggagtcagacccagtcaggacacagcatggacatgagggtcccccgntcagctcctggggcctcctgctgctctcggttcccaggttccagatgcgacatccagatcgacccagtctccattccttccgtgtctgctatcgtggtaggagacagacgtccaccatctacgttggccgggcagtacgaggtatagttaggcgtcgttcggttaggcgttaggttatagacgaagtaaacgaccgaaccgggaacccctagcctcgtgatcgtagtggtcgactactaccgtaagttacggtaaacggttccgggtaccctagtaacggttcgaacggcggacgtaggtacggtacgttcggtagggaccgtacgttactttaccgaccgtttccgtacccgtaccgtaacgtaccgacggtaccgtaccggtacccgttaggaacccgtaacggtaaccgttaagggttaaacggttttacgttttaccgttaaaccgtttttaaactttttttacggtttttaccggaaccgttaaaccgttaaccgggttaacccctttaaaccccgtttacccccgttttaccccccgttaaccggtttacccggtttaaccgggggaccggggttaaaccgggtaaacccgggtaagggtaacgggtaacgtaacggttaaccgtaaacgggtaccgttaacgggtggtacgggtactcccgtaaccgtactccgtttgtacgttacccg

SEQ ID NO: 157152 - DNA, 797 bp, Homo sapiens
  misc_feature: GYAE6OF01BP7H1.19.57.F02.1.454.CMB.1.raw
  modified_base (102)..(102): a, c, t, g, unknown or other
  misc_feature (102)..(102): n is a, c, g, or t
  modified_base (468)..(468): a, c, t, g, unknown or other
  misc_feature (468)..(468): n is a, c, g, or t
tcagtactctcgtgcacgaccggtgctcgatttagctcgatatagttgggtttgggggagtcagacccagtcaggacacagcatggacatgagggtccccgntcagctcctgggctcctgctgctctggttcccaggttccagatgcgacatccagatcgacccagtctccatccttccgtgtctgctatcgtgtaggacacagatcaccatcctacgttggcgggcagtcaggattagtaggcgtcttcggttaggctggtatcgagacaaggaaacgccggtaaaccccggtaaacctacgtcccgttaccgtagttacgttacgttaggttcgggtacctaaccgttacgttaacccgtttaaggttaaacggggtaccgggtttcccggtaccctacggtacgttacggacgtcggacgtaggtggtacgtcggtacggtacgtacttccgttacacccgttcnccgtaacctacgtacgacgtaccgaccgtctaccggacgtaacgtacgtagttaacgtttacgtttacgaactttttaacttttacggtttacctaaaccgtaccgtacgttaaccccttaacccgtttacccccgttaccccgttaccgggtttaccgggttaacccggggaacgggttacccggtaaaccgggtacgggttaaccaacggggtaaacctaacccggggtaaaccgtaccggttaaacgggttccgggtaaaccggttacccgtacgtaaaccccgttaccgtttaaagttccccgttttacgttccggttaaccccg

SEQ ID NO: 157153 - DNA, 612 bp, Homo sapiens
  misc_feature: GYAE6OF01A1BAG.19.57.F02.1.454.CMB.1.raw
tcagtactctcgtgcacgaccggtgctcgatttagctcgatatagttgggtttggggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttggcgggcgagtcaggatagttaggcgctcgttaggctggtatcagcagaagcaacgggaaaccccctaagcctcctgatctagtggtgcatcctacgtttagggaaacggttcgggtcccctacgtaacggttcaggcggcgagtggatcgtgggtacaggtactttcacttcctcgcctagtcacgcacgctgacgagacgtgaagtattttcgacttaacttttgttttacgtactaacgtacggtaccttaaccgtacccttttccccctacgttacctttccggggaccgggtaacgggaacccggtaagggtcggaacgtacgtacgtaacgtccgtaaacgtcgggtacggcgttcgacctaccctaattcccgttagttcctttacccg

SEQ ID NO: 157154 - DNA, 708 bp, Homo sapiens
  misc_feature: GYAE6OF01AYXMB.19.57.F02.1.454.CMB.1.raw
tcagtactctcgtgcacgaccggtgctcgatttagctcgatatagttgggtttggggggagtcagacccagtcaggacacagcatggacatgagggtccccgctcagctcctggggctcctgctgctctggttcccaggttccagatgcgacatccagatcgacccagtcctccatccttccgtgtctgccattctggtaggagacagacgtcacatcacttggtcgggcgagtcaggtatagttaggcgctcggttaggctggtatcgagacagaaacgcgaacggaacccctagctcgtgtactctagtcggtgacactacctagtttaggaacggttccgggtcccctagtaacggttccgaggccggtacgtaggtggtacgttcggtacgggaactacggttacttttaccgaccgttccgtccggtacccaagttccacgtaccacggtccctaggacctacgggtaactacgggtaatttacgttttcgaaacttttaaccgtttttattttacggaccctaaacgtacgttaccctttaacccgttaccccgttttccccctaaccgtttccgggttaccgggaccggggtaaccggtaaccggtagggttacggaacgtactaacggaaccggtagtaacggttcgggacgtacccgtacgtaacccacgtacctttcgttaccggtttcccttaaccg

SEQ ID NO: 157155 - DNA, 872 bp, Homo sapiens
  misc_feature: GYAE6OF01AMPRC.19.57.F02.1.454.CMB.1.raw
tcagtactctcgtgcacgaccggtgctcgatttagctcgatatagttgggtttgggggcaggagtcagacccagtcaggacacagcatggacatgagggtcccccgctcagctccgtggggctcctgctgctctggttcccaggttccagatgcgacatccagatcgacccagtctccattccttccgtgtctgctatcgtgtaggagacagacgtccaccatcacgttggtcggcgagtcgaggtacttagttacggccgtcgttacggttaggccgtaggtatcgacggacgaaggaaacggaccgaacccgggggaaaacccccctaaggtcccttaccgtagtacttacgttacggtggtacactacgttaccgttaacggttacgggaaacgggttccgggtcccctaacgtaacgggttacgaacgggccggtacgtagggtacggtacgttacgggtacggggaaccttaacggttacgtttaccctaaccgttacccgtaccggtacctaacgtaccgaacggtacccgtaacggtacccgtacgaaccgtaacggtaaccgttaggttaaacgtttacgttttaccggtaaccttttaaacgtttttacgtttttaacggtaaaccgttaaccgtaaccggttaaccctttaaacccgtttcccccgtttttacccccgttaacgtttaaccccgggttttaccgggggaaccggggttaaacccggggtaacccgggtaaacggggttaccgggtaaacggtaaccggttaacccggtaaacgggttacccggtaaacgttccggggttacggtacccggttacccgtaacccgtacccggtttaacgttcccgttaaccgg

SEQ ID NO: 157156 - DNA, 795 bp, Homo sapiens
  misc_feature: GYAE6OF01DB75F.19.57.F02.1.454.CMB.1.raw
tcagtactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatcgacccagtcctccattccttccgtgtctgcagtcgtgtaggagacagacgtccaaccattcctacgttggaccgggcgtaagtcaggtattaacgttacggccgtcgttacggtttaacggcgttaggtaactcgaagaccgaaagaaacgaccgaaccgggtaaaaccccctagccgttaccgtagtactcgtaagttcggtcgacctaacgttccgtaacgtttacgggaaaccggttccgggtcccctaacgtaacggttccgaaggccggtagtacggttcggaagttccggtagggactacgttacgttttaccaccgttcctacggaccctagtaccgaggtacctacggacccgttagaccgtagtaaccgttagttaaacggttagttttacgtaacctttaagttttttaagtttaccgtaacgttaaaccgttaacggttaccctttaaacccctttcccgtttacccccgttaccgtttaacccggtttaccggggtaaccggggtaaacccgggtaccgtaaacggggttagaacggttaaacgtaaccgtaaacgggtaccgtaaacggttcggtacggtaaccgttacggtacctaacccgttaagttcgttacccg

SEQ ID NO: 157157 - DNA, 780 bp, Homo sapiens
  misc_feature: GYAE6OF01CMF92.19.57.F02.1.454.CMB.1.raw
  modified_base (210)..(210): a, c, t, g, unknown or other
  misc_feature (210)..(210): n is a, c, g, or t
tcagtactctcgtgcacgaccggtgctcgatttagctcgatatagttgggtttgggggcaggagtcagacccagtcaggacacagcatggacatgacgggtccccgctcagctcctggggcctctgctgctctggttaccaggttccagatgcgacatccagatcgacccagtcctccattcttccgtgtctgacatcgtaggtaagganacagacgtccaacctatccgtacgttggtccgggcgtagtacgaaggtatacggttacggccgtcgttacggttaggtctggtaactcgagacgaaggaaacggccgaaaccgggtaaacccctagtcccttacgtagtacttacgtagttcggacgacttaacgtaccgttaacggtttaacgggaaacgggtttcccgggttacccctaaggtaaaccgggttccgacgggtacggtaccgtaagggtaccggaagtttccgggaacgggtaacgtaaggttaccgttttaccgaccgttaccgtaccgtaacctacgttaaccgtcggtaccgaaccggtccgtacggaacgtacggtaacgtaaggtaacgtttacgtttacgtaacttttaacgttttacgtttaactacggtaaccgacgttacccttaaacccgttccctttaccccgtacgttaacccgttcgggaacgggtaaccggtaacgtaagggtaggtaacgtacgtaacgaacggtccgtaacggttcgtacgtaccgtacgtagtaacccttgttcccgttacg

SEQ ID NO: 157158 - DNA, 713 bp, Homo sapiens
  misc_feature: GYAE6OF01ETP2Z.19.57.F02.1.454.CMB.1.raw
  modified_base (347)..(347): a, c, t, g, unknown or other
  misc_feature (347)..(347): n is a, c, g, or t
tcagtactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatcgacccagtcctccatccttccgtgtctgctatcgtaggtaggagacagacgtccacctagtctacgttggtcgggacgtagtcaggtattagttaggcgtcttacggttaggctaggtactcgaagacgaagaaacgaccgaaccgggaaccccctagcctccgtgtactcgtagtcggtacnctactaccgttagttacgggaacggtcccgggtaccctaggtaacggttcgacggtcggacgtaggtggtactcggtacgggactaggttactttccgaccgttccgtacccgaccctacgtactacggtaccgtacgtaccgtgacgtacgtacgtagtaagtttacgtttacgaactttacttttagttttacgacgttaacgtacggttaccctaacccttacccgtttccccttacgttacccggtttaccgggaccgggtaacggtaccggtaaaggggtcgaaccgtaacggtaccggaacgttaccggtaacggttcggtaccggtacttccggaaccttaccgtagttcgtttacccg

SEQ ID NO: 157159 - DNA, 888 bp, Homo sapiens
  misc_feature: GYAE6OF01A6YY2.19.57.F02.1.454.CMB.1.raw
  modified_base (569)..(569): a, c, t, g, unknown or other
  misc_feature (569)..(569): n is a, c, g, or t
tcagtactctcgtgcacgaccggtgctcgatttagctcgatatagttgggtttgggggcaggagtcagacccagtcaggacacagcatggacatgagggtccccgctcagctccgtgggctctgctgctcgtcggttcccgaggttccagatgacgacactccgagtactcgacccagtcctcctattccgttccgtgtctgctagtctacggtaaggacaacgagtacgtacccaactattccgtacgttcgggtccgggacggtacgtacgaacggttagttacggtacggccgtcgttacggttacggtcgttaggtaacgtacgaacggtacaaacggaaacgtaacccggaaaccccggtaaaaccccccgtaaggtccccgtaccgttacgtacgttacggttacggtcggtaccgtaccgtaaaccgttaacccggttaacggttttaacggggtaaacccgggttacccgggttaccccgttaacggtaaccggttccggaacgggtcggtacgtagggttaccgtacggtacggtaacggaccgttaacgttacttaccncgttaaccctacggaccctaacgtccgtaacgtaccgacgtccttacgggccggtacggtaacgtagtaaacggtgttacgggtaggttacttttagtttaacgtttacgttaaaccgttaaacttaaacgttaattttaaacggtttaacctttttacggttaccggtttacggttaccggttaacccgggtttaccgggaaacggttaaacccgggtaaacgggtaacgggtttaaggtaacgttaccgtaaccgtaaggttaaacccgggtttaaacgccggttttaaggccccgggttagaaccccggtaacccg

SEQ ID NO: 157160 - DNA, 708 bp, Homo sapiens
  misc_feature: GYAE6OF01EEMD5.19.57.F02.1.454.CMB.1.raw
  modified_base (701)..(701): a, c, t, g, unknown or other
  misc_feature (701)..(701): n is a, c, g, or t
tcagtactctcgtgcacgaccggtgctcgatttagctcgatatagttgggtttgggggcaggagtcagacccagtcaggacacagcatggacatgagggtccccgctcagctcctggggctcctgctgctctggtccaggttcagatgcgacatccagatcgacccagtctccatccttcgtgtctgctatcgtagtaggagacagacgtaccacattcacgtttggtcgggacgtagttacgaggtattagttaggcgtcgttcggttaggcgttaggtatcgagacaagaacgaccgtaaccggaaacccctagccttccgtagacttactagttcgggtacactactaccgtacgtttagggaacgttccgggtaccctaggtacggttcaggcggtacgtaggtgtagtcggtacgggactaagttactttaccacgttccgtacgaccgtactaccgaacgcccgtaacgtccgtagaaccgtacgtacgttacggtaacgtttagtttttaccgaactttttaaacgtttttacgtttttacggaaccgtaaccgtacggttaacccttaaccccgtttaccccgttttaccccgttacgttaccggttccggggtaaccggaacgggttaacccgtagggttaggaccgtaacgtacgaacggtcgtaaccgtggacggtccacgacctacgtntcgttac

SEQ ID NO: 157161 - DNA, 686 bp, Homo sapiens
  misc_feature: GYAE6OF01CRXYI.19.57.F02.1.454.CMB.1.raw
  modified_base (102)..(102): a, c, t, g, unknown or other
  misc_feature (102)..(102): n is a, c, g, or t
  modified_base (409)..(409): a, c, t, g, unknown or other
  misc_feature (409)..(409): n is a, c, g, or t
tcagtactctcgtgcacgaccggtgctcgatttagctcgatatagttgggtttgggggagtcagacccagtcaggacacagcatggacatgacgggtccccntcagctccgtgggctcctgctgctcgtggtcccaggttccagatgcgacatccagtatcgacccagtcctcctatccttccgtgtcgtgcatctagaggacatagactcaacctatcgtacttggtcggcgtaagtcaggtaattacgttacgggcgtacgttaccggttaaggcttaggtactacgaacgacaaggaaacgaccgaaccggtaaacccctaacgtccgtaccgtagtactaccgttagtacggtacgaacgtaacgttacccgttaaaggtttaaccgggtaaacccgggggtttnagtacgagtactacgtagtagtagacgacgtacgactacgtacgtacgtacgtagaacgtactacgtaacgtacgtacgtaacgtacgtacgtagtacgtacgtaacgtaagtacgtacgtacgtaacgtagtacgtagtacgtaacgtactaacgtacgtaacgtaacgtacgtaacgttaacgtaacgactaacgtaacgaacgtaacgtacgtagtacgtaacgtaacgtacgtaacgtaacgtactacgtaacctacaacgtacgtcgtaacg

SEQ ID NO: 157162 - DNA, 756 bp, Homo sapiens
  misc_feature: GYAE6OF01BW49X.19.57.F02.1.454.CMB.1.raw
  modified_base (693)..(693): a, c, t, g, unknown or other
  misc_feature (693)..(693): n is a, c, g, or t
tcagtactctcgtgcacgaccggtgctcgatttagctcgatatagttggggtttgggggcaggagtcagacccagtcaggacacagcatggacatgagggtccccgctcagctccgtggggctcctgctgctctggttcccaggttccagatgcgacatccagatcgacccagttctccattcctttccgtgtctgctatcgtaggtaggagacgagacgtaccaccatctacgtttcgggtcgggacgtacgtacgaggtacgttagttacggcgtccgttcggtttaggcgttaggtactcgaaggactaaggaaacggacccggtaaacccggggaaaccccctaaggtcccttaccgtacggaacttcgttagtgggtacaccgtaacgttaccgttacggttaacgggaaccggggtttcccgggttaccctacggtaacgggtcgacggggtcggtacgtagggtacgggttaacgtcgggtacgggtaaccttaacgttacgttacccgtaccttccgtaccgacccttaacgtccgaaggtaccaccggtcgtcgaacgtacgtacggaagttacgttattttacggtactttaattttcgttacgaactaacgtacttacccgtaacctttccccgttaccgtacgttaccggttacggggacgggtaacggtaacgggtacgnggtaacgacgtacggaacgtacggtacggtcgtacgtcgtacggaccctaatgttccctacgg

SEQ ID NO: 157163 - DNA, 713 bp, Homo sapiens
  misc_feature: GYAE6OF01EJ82U.19.57.F02.1.454.CMB.1.raw
  modified_base (354)..(354): a, c, t, g, unknown or other
  misc_feature (354)..(354): n is a, c, g, or t
  modified_base (632)..(632): a, c, t, g, unknown or other
  misc_feature (632)..(632): n is a, c, g, or t
tcagtactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttcgtgtctgcatcgtggtaggagacagacgtccaactatctacgttggtcgggacgagtacgaggattagttacggacgtcgttcggttaggcgttaggtactcgaacgacaaaggaacgaccggtaacccgggaaaaccccctaagccttaccgtagtatccgtagtgggtacnctacttaccgtaaggtttacggaacggttccgggtaccctagtaacggttcgacggcgacgtagtcggacttcggtaggtactagtcttaccgacgtctccgactacgtacgacgactacgcgtacgacaacggtacgtaggtaaagttcttttacggaactttaacttttttacgttacgtaaccgaacggttaaccggttaacccttaacccgttacccccttttaccccgtcggtttacccggttacggggaccgggtaacgggttaaacccggngggttaaccggagtaaccgtaacgacgggttaccgtaacggtgggttaccgtactaccgaaccctagtccgtttcgtaccg

SEQ ID NO: 157164 - DNA, 790 bp, Homo sapiens
  misc_feature: GYAE6OF01BUHTH.19.57.F02.1.454.CMB.1.raw
  modified_base (494)..(494): a, c, t, g, unknown or other
  misc_feature (494)..(494): n is a, c, g, or t
tcagtactctcgtgcacgaccggtgctcgatttagctcgatataggttggggtttgggggggagtcagacccagtcaggacacagcatggacatggacgggtccccgctcagctccgtggggctcctgctgctcgtcggttcccaggttccagatgcgacatccagatcgacccagtcctcctattccttccgtgtctgcattcgtggtaaggagacaggtactaccaacctatctacgttcggggtccgggacgaggtacgaaggtattagttacgggcgtacgttacgggttaggtcgttagggtactacgacgacgaaacggaaacggaccggaaaccgggtaaaccccctagtccgtaccgtagtacttacgtagttggactactacgttcccgttaagtttacgggaacggttccgggttaccctagtacgggtcacggcggacgtacggtgtagtcgtaaggacttagttacttaccgtaccttaccnccggtaacctacgtacgacgtaccgacgtacccgtcgaacgtaacgtaacggtagttaacgttttacgtttacgttaacttttaacgttttacgttttaaccgtaaccgtacgttaacccggtaaccctttaacccgtttacccctttaccccgttccgtttaacccgggtttaccgggaaccgggtaaccgggtaaacggtacgggtaacgggtaactaacggtaacggtaacgtaacggtaccggttgggcggtacgccgtacccgtattacgtttcgttccgttcgttacccg

SEQ ID NO: 157165 - DNA, 711 bp, Homo sapiens
  misc_feature: GYAE6OF01B4XCI.19.57.F02.1.454.CMB.1.raw
  modified_base (106)..(106): a, c, t, g, unknown or other
  misc_feature (106)..(106): n is a, c, g, or t
tcagtactctcgtgcacgaccggtgctcgatttagctcgatatagttgggtttgggggcaggagtcagacccagtcaggacacagcatggacatgagggtccccgntcagctcctggggctcctgctgctctggttcccaggttccagatgcgacatccagatcgacccagtcctccatcttccgtgtctgcatctggtagagacaggacgtcaaccatccgagtttgggaccggggctacggtcgaggtaattagttacggcgtcttacggttaggtacttaggtactacgacgacgaaggtaaaacgaccggaaaccggggaaaacccccctaaggcccgttacctagtaaccttagttaagtcgggtactacctaactaccgttaacggtttagggaaaacgggttccgggttacccctacgtaagggttcaacgggcggactaagggtcgtagtcgtacgggaactagtacttcgaacgtcctaccgacctatacgacgtacacgtacctcggaacctaggaccttaggtaaagttacgtttttacgaacctttaacgttttagtttaccgtaactaaccgttaacggtaccttaacccttacccgtttaccccctacggttaccgttaccgggccggtaacgggaccttagggacgtagacgttacgaacgtcgaactgggtcgtcaacggccacgtcgtgttacg

SEQ ID NO: 157166 - DNA, 825 bp, Homo sapiens
  misc_feature: GYAE6OF01E3LSH.19.57.F02.1.454.CMB.1.raw
tcagtactctcgtgcacgaccggtgctcgatttagctcgatatagttgggtttgggggcaggagtcagacccagtcaggacacagcatggacatgacgggtcccccgctcagcctccgtgggctcctgctgctctcggttcccaggttccagatgcgacactccagactcgaccctacgtcctccacgttcctttccgtgtctgctagttcgtaggtaaggagacgagacgtccactacttcgtaacgttgggtaccgggacgacgtcaaggtacgttaacgttacggccggtacgttaccggtttacggcgttacgggtactacgaaggacaaacggaaaacggtacccggaaaacccggggtaaaaccccccttaacggtacccgttaccgtacgtaacgttacgtttaacggtggttaccgaccgtacgttacccgttaacgggtttacgggtaaaccggttccgggttaccccgtaggtaaaccggttcgacgggtaccggtagtaggtcgaacgttcggagggtaaccgtaggttacctttacccgacgttcccgtaccgacccgtaacgtacgaaccgtacgaccgtcccgttacggacgaaccgtaacgtaaggaaacggttgttcgggttacgtaacttttagtttaacgttacgtttaacgtaactaacgttaatttaagttttaacttaacgtttaaccgggttcggttaaccgggttccgggtaaccggaaacccggtaacgggtaacgggtaacggtagtaacgttaccgagaaaccggtaccgtaacggttggtacgtactcgaacctaccg

SEQ ID NO: 157167 - DNA, 675 bp, Homo sapiens
  misc_feature: GYAE6OF01B7H4B.19.57.F02.1.454.CMB.1.raw
  modified_base (313)..(313): a, c, t, g, unknown or other
  misc_feature (313)..(313): n is a, c, g, or t
tcagtactctcgtgcacgaccggtgctcgatttagctcgatatagttgggtttgggggcaggagtcagacccagtcaggacacagcatggacatgagggtccccgctcagctcctgggctcctgctgctctggttcccaggttccagatgcgacatccagatgacccagtctccatcttccgtgtctgcatctgtaggagacagagtcaccatcacttgtcgggcagtcaggtatagttaggcgctcggttaggctggtatcgagacgaagaacgacgaacgggaaacccctaagcctctgaactcgtatggncactcctacgttaggaaacgtcggggtacccctagtaaggtcaggcggacaggtaggatcgtaggacagtactttcacttactccgctatcgagctagtccgtgaccgaagtacgtagtaagttaactttttcggaactttaaacgtttttacgtttttacgaccgtaaactaccgggttaacccttaaacccgtttacccctttttaccccctagtttaacccgggttttcggggaaacccggggtaaccggggtaaacccgtaaacggggttggtaaacgtaaccgttaagaaaccgggttacgtaaaccggttggtaccgggtacctaacggaccctaacctacgttccgtttacccgg

SEQ ID NO: 157168 - DNA, 822 bp, Homo sapiens
  misc_feature: GYAE6OF01EP9J4.19.57.F02.1.454.CMB.1.raw
  modified_base (264)..(264): a, c, t, g, unknown or other
  misc_feature (264)..(264): n is a, c, g, or t
tcagtactctcgtgcacgaccggtgctcgatttagctcgatataggttggggtttgggggcagggagtcagacccagtcaggacacagcatggacatggacgggtccccgctcagctcctggggctctgctgctctggttcccaggttccagatgacgacacgtccaggactacgaccccagttcctcccattcccttcggtgtctgacatctaggtaaggagtaacgaggactaccaacctattaccgacgtttacggcgggntaagtcgaaggtactagttacggcgacgtttacggttaggcttaggtactaccgagaacgaaggaaacgaccggtaacccgggaaaccccctaaggccttaccgtgtaacttacgtagtgggtcacttacttccgtaaacggttacggtaaccggttaccggtaccctaggtaacggttacgacggcggtacgaggtacggtagtacggtacggaacgtagtaccgtttccacgttaccgtccgtactagtaccgacgtcgtacggccgtacgtaaccggaacgttaaccggtaaggtaaacgtttacgttttacgtaactttaaacgttttttctttaaccgggtaacctaaacgtaaccggttaccgtttaaaccgttccccgtttaccccgtacggtttaacgggttaccgggaccgggggtaaacggtaaccgggtaaagggtaaccggtaacgtaaccgggtaaacgaacggggttaacccgaaacgggtttccgggttaacgggtaccgtacccgttaaacccggttaaccgttaccttaaccgtttaccgg

SEQ ID NO: 157169 - DNA, 734 bp, Homo sapiens
  misc_feature: GYAE6OF01CLGRA.19.57.F02.1.454.CMB.1.raw
  modified_base (105)..(105): a, c, t, g, unknown or other
  misc_feature (105)..(105): n is a, c, g, or t
tcagtactctcgtgcacgaccggtgctcgatttagctcgatatagttgggtttgggggcaggagtcagacccagtcaggacacagcatggacatgagggtccccnctcagctcctgggctcctgctgctctggttcccaggttccagatgcgacatccagatcgacccagtcctccattccttccgtgtctcgctatcgtaggaggacgacgtaagacgtaccaacacgttcctaacgtttcgggtccgggaccgaggttaccgaggtattaacgttacgggtccgtcgttacggttaggtccgttaggttactacggacgacgaaggaaacggaccgaaacccgggtaaacccctaacgtccgtaccgtgtactacgtagtcggtccgactacgtacccgttagggttaacggtacgggtccgggtaccctacggttaacgggtaccgacggtcggacgttaggtcgtacggttaccgagggtaacctagtactttaccgacctcgttacccacgacttaccggacaccgtaccgtcgacgtaacgacgttacgtaggtaacttttcgttacgttaacttttaacggtttcttttacgaactaaccgtacttacccctaaccgttccctttccctacgttacggtaccgggaacggttacggaacgtcggtacgtcgtaaccgtacggtaacgtcggtatacggtacggtctaccgactacgtcttcgttccg

SEQ ID NO: 157170 - DNA, 778 bp, Homo sapiens
  misc_feature: GYAE6OF01BY5VR.19.57.F02.1.454.CMB.1.raw
  modified_base (103)..(103): a, c, t, g, unknown or other
  misc_feature (103)..(103): n is a, c, g, or t
  modified_base (148)..(148): a, c, t, g, unknown or other
  misc_feature (148)..(148): n is a, c, g, or t
  modified_base (194)..(194): a, c, t, g, unknown or other
  misc_feature (194)..(194): n is a, c, g, or t
  modified_base (386)..(386): a, c, t, g, unknown or other
  misc_feature (386)..(386): n is a, c, g, or t
tcagtactctcgtgcacgaccggtgctcgatttagctcgatatagttggggtttgggggagtcaagacccagtcaggacacagcatggacatgagggtccccnctcagctccgtggggctcctgctgctctggttcccaggttccagntgcgacactaccagagtcgaccctagtcctaccattccttccggtntctgctattctaggagagacagacgtacaccgatactacgttggccgggacgtagtaccgaggtaacttacgttaggccgtacgttacgttaaggtcgtaggtaactacaaggtacaaagggaaagtacccggtaaaccgggaaacccccttaacggtacctaccgtaggtaacgttcctaaggttcggtanaccgttaagtaccccgttaaggtttaagggtaaacgggttccggttaccccgtaacgttaacggtacgacggacgtacaaacggtcggattaccggacggtaactaagttacgtttacctacggtacctacccgtactactacgtacgaccgtacgtaccgtacggtaaccaacgtaacgttaacgttaagtttaacttacggaaccttttaaaacgtttcgtttaactaacgtaaccggtaacgttaacctaacccgttacccttacccgtaccgttacggttacggaccggtaaggtaaccgaagtaacggggtactaacgtaccgtaaacggtacgttaacgtcggtctacgaccgttaccgtacctagttaccttggtacccttaacg

SEQ ID NO: 157171 - DNA, 485 bp, Homo sapiens
  misc_feature: GYAE6OF02H8ZX7.19.57.F02.1.454.CMB.1.raw
  modified_base (483)..(483): a, c, t, g, unknown or other
  misc_feature (483)..(483): n is a, c, g, or t
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaacccctaagctcctgatctatggtgcatccactttggaaagtggggtcccctcaaggttcagcggcagtggatctgggacagatttcactctcgccatcagcagcctgcagactgaagatgtggcagtttattattgtcaaacaattattattatacttcgtggacgttcgccaaggaccaaggtggatatcagacaatgtggctgcacntc

SEQ ID NO: 157172 - DNA, 496 bp, Homo sapiens
  misc_feature: GYAE6OF02IE576.19.57.F02.1.454.CMB.1.raw
  modified_base (441)..(441): a, c, t, g, unknown or other
  misc_feature (441)..(441): n is a, c, g, or t
tcagtactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcaggatattaggcgctcgttaggctggtatcagcagaaagcagggaaaccccctaagctcctgatctatggtgcatccactttggaaagtgggtccctcaaggttcagcggcagtggatctgggacagatttcactctcgccatcagcagcctgcagactgaagattttgctaatttattttgtacaactaggctaaacacttttccccctntacctttcggcgtagggaccaggtggagatcaagcgaactgtgctgcacatctcg

SEQ ID NO: 157173 - DNA, 504 bp, Homo sapiens
  misc_feature: GYAE6OF02J0BZZ.19.57.F02.1.454.CMB.1.raw
  modified_base (328)..(328): a, c, t, g, unknown or other
  misc_feature (328)..(328): n is a, c, g, or t
  modified_base (391)..(391): a, c, t, g, unknown or other
  misc_feature (391)..(391): n is a, c, g, or t
  modified_base (409)..(409): a, c, t, g, unknown or other
  misc_feature (409)..(409): n is a, c, g, or t
  modified_base (429)..(429): a, c, t, g, unknown or other
  misc_feature (429)..(429): n is a, c, g, or t
  modified_base (438)..(438): a, c, t, g, unknown or other
  misc_feature (438)..(438): n is a, c, g, or t
  modified_base (448)..(448): a, c, t, g, unknown or other
  misc_feature (448)..(448): n is a, c, g, or t
  modified_base (466)..(466): a, c, t, g, unknown or other
  misc_feature (466)..(466): n is a, c, g, or t
tcagtactctcgtgcacgaccggtgctcgatttagctcgatatagttgggtttgggggtcgaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcaggatattaggcgctcgttaggctggtatcagcagaagcagggaaaccccctagctcctgatctatggtgcatccactttggaaagtcgggtcccncgtaaggttcagcgcagtggatcgtggacagatttcactctcgccatcagcagcctgcagacngaatatttgctaactttnttttgctaacagtctaaccnctttccccntactttcggngaggaccaggtggtacgntaccaagccgtaactgtcggctgaccactactcttacg

SEQ ID NO: 157174 - DNA, 501 bp, Homo sapiens
  misc_feature: GYAE6OF02HHU47.19.57.F02.1.454.CMB.1.raw
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaaccccctaagctcctgatctatggtgcatccactttggaaagtggggtcccctcaaggttcagcggcagtggatctgggacagatttcactctcgccatcagcagcctgcagactgaagattttgctaactttattttgtcaactaggcttaacacctttccccctctactttccggcggtaggaccaaggtggagatcgaagcgaactgtgctgcaccatctgtctc

SEQ ID NO: 157175 - DNA, 594 bp, Homo sapiens
  misc_feature: GYAE6OF02FVWZ3.19.57.F02.1.454.CMB.1.raw
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaaccccctagctcctgatctatggtgcatccactttggaaagttcggggtcccctgaaggttcagcggcagtggatcgtgggacagatttcactctcgccatcagcagcctgcagactgaagtattttacgactaactttatttttagtactaaacgtaggtaccttaaacctacccttttccccctactaaccgttttccgggaccggtacgggtaacccgaagggttggacgtaacgtacgaaacggtaccggtaaaccgttggttacgggtaccgttacggtacctaacccgtaagttcccgttacgttcctttacccg

SEQ ID NO: 157176 - DNA, 564 bp, Homo sapiens
  misc_feature: GYAE6OF02IC4QZ.19.57.F02.1.454.CMB.1.raw
  modified_base (325)..(325): a, c, t, g, unknown or other
  misc_feature (325)..(325): n is a, c, g, or t
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcaggatattaggcgctcgttaggctggtatcagcagaaagcagggaaaccccctaagctcctgatctatggtgcatccactttggaaagtggggtccctnaaggttcagcggcagtggatcgtgggacagatttcactctcgccatcagcagcctgcagactgaagtattttgactaactttatttttgtactaactaggtaccttaacctaccttttaccccctctaccgttttccgggaccgggtagggaacccaagggtcggagtagtaccgaaaggaccggtaaacgttggtacggtcttcggacctaaccctattccgttcggttcctttaccg

SEQ ID NO: 157177 - DNA, 555 bp, Homo sapiens
  misc_feature: GYAE6OF02IVRUW.19.57.F02.1.454.CMB.1.raw
tcagtactctcgtgcacgaccggtgctcgatttagctcgatatagttgggtttggggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcaggatagttaggcgctcgttaggctggtatcagcagaaagcagggaaacccctaagctcctgatctatggtgcatccatttggaaagtggggtccctgaaggttcagcggcaggtggatcgtgggacagtatttcactctcgccatcagcagcctgcagactgaagtattttgacttaactttatttttacgacaacgtaggtacctaaacctacctttccccctagtaccgtttcgggacggtacgggaacctaagggtcggagattcgaaaggccgtaaacgttggtacggctacggaccaacctacgtccgttggttccttaccg

SEQ ID NO: 157178 - DNA, 574 bp, Homo sapiens
  misc_feature: GYAE6OF02JCNLM.19.57.F02.1.454.CMB.1.raw
  modified_base (326)..(326): a, c, t, g, unknown or other
  misc_feature (326)..(326): n is a, c, g, or t
tcagtactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcaggatattaggcgctcgttaggctggtatcagcagaaagcagggaacccctaagctcctgatctatggtgcatccactttggaaagtgggtccctnaaggttcagcgcagtggatctgggacagatttcactctcgccatcagcagcctgcagactagaagtattttgactaactttatttttcgtactaaacgtaggtaccttaaaccgtaccttttccccctacttaccgttttccgggaccgggtaacggggtaacccgtaaggggttaggacgtaacgtaccgaaaggtaccgtaaacgttggtacggtccttcggacctaacccgtacttccgttacgg

SEQ ID NO: 157179 - DNA, 597 bp, Homo sapiens
  misc_feature: GYAE6OF02I330R.19.57.F02.1.454.CMB.1.raw
  modified_base (326)..(326): a, c, t, g, unknown or other
  misc_feature (326)..(326): n is a, c, g, or t
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaacccctaagctcctgatctatggtgcatccactttggaaagtcggggtccctnaaggttcagcggcagtggatcgtgggacagatttcactctcgccatcagcagcctgcagactgaagtattttgacttaactttatttttgtactaacgtaggtacttaaaccgtaccctttttaccccccttactaccgttttccgggaccgggtaacgggtaacccgtaaggggttcggacgtacgtaccgaaacggtaccggtaaaccgttggtacgggtaccgttacggacccgtaacccgtacgttccgttacggttccctttaccg

SEQ ID NO: 157180 - DNA, 514 bp, Homo sapiens
  misc_feature: GYAE6OF02F3ZGO.19.57.F02.1.454.CMB.1.raw
tcagtactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcaggatattaggcgctcgttaggctggtatcagcagaaagcagggaaaccccctaagctcctgatctatggtgcatccactttggaaagtggggtcccctcaaggttcagcggcagtggatcgtgggacagatttcactctcgccatcagcagcctgcagactgaagtattttgctaactttatttttgtacaacaggtcctaaactacctttccccctctacctttcggcggtacgggaccagggtcggagtatcaagcgaacgtgtcggctgcacctatctcg

SEQ ID NO: 157181 - DNA, 555 bp, Homo sapiens
  misc_feature: GYAE6OF02GAQRV.19.57.F02.1.454.CMB.1.raw
tcagtactctcgtgcacgaccggtgctcgatttagctcgatatagttgggtttggggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcaggatattaggcgctcgttaggctggtatcagcagaaagcagggaaacccctaagctcctgatctatggtgcatccatttggaagtggggtcccctgaaggttcagcggcaggtggatcgtgggacagtatttcactctcgcatcagcagcctgcagactagaagtattttgacttaactttattttcgactaacgtacgtaccttaacctacccttttaccccctctaccgttttacgggcggtacgggtaccaagggtgacgtacgtacgaaacggccgtaaacgtggtacggtcctacgcctaaccagttcctgttaccttaccg

SEQ ID NO: 157182 - DNA, 605 bp, Homo sapiens
  misc_feature: GYAE6OF02H5PY1.19.57.F02.1.454.CMB.1.raw
tcagtactctcgtgcacgaccggtgctcgatttagctcgatatagttagggtttggggcaggagtcagacccagtccacggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggatattaggcgctcgttaggctggtatcagcagaaagcagggaaaccccctaagctcctgatctatggtgcatcctactttggaaagtcggggtccctcaaggttcagcggcagtggatcgtgggacagtatttcacttctcgcatcagcagcctgcagactgaagtattttgctaactttattttgtactaaactaggtaccttaaaccgtacctttttcccccctacgttaacccgtttttcgggacccgggtaacggggtaaccctaaagggggttacgggtaacgtaacgttaacccgtaaaagggaccggtaaaccgttcgggttacgggtccttacgggacctaacccgtattcccgtttcgg

SEQ ID NO: 157183 - DNA, 514 bp, Homo sapiens
  misc_feature: GYAE6OF02HNC95.19.57.F02.1.454.CMB.1.raw
  modified_base (326)..(326): a, c, t, g, unknown or other
  misc_feature (326)..(326): n is a, c, g, or t
tcagtactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaacccctagctcctgatctatggtgcatccatttggaaagtgggtccctnaaggttcagcggcagtggatcgtgggacagatttcactctcgccatcagcagcctgcagctgaagtatttgctaacttattttgacaactaggtactaacctacctttcccctactaccgtttcggacggtacgggaccagggtcggagtatacaaggcgaacgtggtacggctagccactatcgtcg

SEQ ID NO: 157184 - DNA, 546 bp, Homo sapiens
  misc_feature: GYAE6OF02H9CKG.19.57.F02.1.454.CMB.1.raw
tcagtactctcgtgcacgaccggtgctcgatttagctcgatatagttgggtttggggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaacccctaagctcctgatctatggtgcatccactttggaaagtcggggtccctagaaggttcagcggcagtggatcgtgggactagtactttcactctcgctatcagcagctgcagtactgaagtatttgactaactttatttttgacaacgtagtacctaaaccgtacctttccccctacgtaccgtttcgggacggtacgggaaccgtaagggtggagtacgtacgaaggaccgtaacgtggtacgctggacacctagtcttcgtcttacg

SEQ ID NO: 157185 - DNA, 577 bp, Homo sapiens
  misc_feature: GYAE6OF02GMGSR.19.57.F02.1.454.CMB.1.raw
  modified_base (326)..(326): a, c, t, g, unknown or other
  misc_feature (326)..(326): n is a, c, g, or t
tcagtactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcaggatattaggcgctcgttaggctggtatcagcagaaagcagggaaacccctaagctcctgatctatggtgcatccactttgaaagtgggtccctnaaggttcagcggcagtggatcgtgggacagatttcactctcgccatcagcagccttcagactgaagtattttcgactaactttatttttcgactaactaggaccttaacctaccttttacccccctctaaccgttttccgggaccggtaacggggtaacctaaggggtcggaacggtaacgttccggaaaggccgtaaacgttcggttaggaccgttacggaccctaaccgtacgttacgtcgtttacccg

SEQ ID NO: 157186 - DNA, 612 bp, Homo sapiens
  misc_feature: GYAE6OF02I04ZC.19.57.F02.1.454.CMB.1.raw
  modified_base (315)..(315): a, c, t, g, unknown or other
  misc_feature (315)..(315): n is a, c, g, or t
tcagtactctcgtgcacgaccggtgctcgatttagctcgatataggtttggggtttgggggcaggacgtcagacccgagtccaggactacagcatggacatgagggtcccgctcagctcctgggctcctgctggctctggttcccaggtttccagatgcgacataccagatgacccagtctccatcttccgtgtctgcgatctgtaggagacgagagtcaccatcacttgtccgggcgagtcaggattattaggcgctcgttaggctggtatcgagcagaagcagggaacccctagctcgtgatctagtaggtancatccacttaggaaagtcgggtaccctacgaacggttcacggcggacgaggtggactacgtggactagagtttcacttctacgacagtcagcacgcctagcagactaggaagtatttacgacttaactttattttagtactaacgtacggtaccttaaacctaccttttaccccctacgttaccgtttaccgggaccggtaacgggtaccgtagggttacggaacggtacgtaccgtaaggtccgttaacgtcggttacggtccgttacggacccgtaaccgtacgttccgttacgg

SEQ ID NO: 157187 - DNA, 618 bp, Homo sapiens
  misc_feature: GYAE6OF02GTZKP.19.57.F02.1.454.CMB.1.raw
  modified_base (326)..(326): a, c, t, g, unknown or other
  misc_feature (326)..(326): n is a, c, g, or t
tcagtactctcgtgcacgaccggtgctcgatttagctcgatatagttgggttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaaccccctaagctcctgatctatggtgcatccactttggaaagtcggggtccctnaaggttcagcggcagtggatcgtgggacagtatttcactctcgccatcagcagcctgcagacttgaagtattttgacttaactttatttttgtactaacgtaggtaccttaaccgtacccttttccccctacgttacccgttttaccgggaccgggtaaccggggtaaccctaaacggggttcgggaacggtacgttaccggaaacggtaccggtaaaccgttgggtaccgggtaccgttacgggacccgtaacccgttaacgtttccctttacggttacccttttacccgg

SEQ ID NO: 157188 - DNA, 601 bp, Homo sapiens
  misc_feature: GYAE6OF02FZ5T1.19.57.F02.1.454.CMB.1.raw
tcagtactctcgtgcacgaccggtgctcgatttagctcgatatagttgggtttggggggagtcagacccagtcaggacacagcatggacattagggtccccgctcagctcctggggctcctgctgctctggttcccaggttccagatgcgacatccagatgacccagtctccatcttccgtgtctgcatctgtaggagacagagtcaccatcacttgtcgggcagtcaggatattaggcgctcgttaggctggtatcagcagaagcagggaaccccctaagctcctgatctatggtgcatccactttggaaagtggggtcccctcaaggttcagcggcagtggatcgtgggacagatttcactctcgcatcagcagcctgcagactagaagtattttgactaaactttatttttcgtacaacgtaggtaccttaaacctaccttttccccctacttaaccgttttccgggaccggggtaacgggtaacccgtaaacggggttcgggaacgtattaccggaaacggtaccggtaaacgttcgggttacgggtaccttacggacctaacccgtagttaccgttcggtttaccttccgtaaccg

SEQ ID NO: 157189 - DNA, 584 bp, Homo sapiens
  misc_feature: GYAE6OF02HYX1W.19.57.F02.1.454.CMB.1.raw
  modified_base (300)..(300): a, c, t, g, unknown or other
  misc_feature (300)..(300): n is a, c, g, or t
  modified_base (327)..(327): a, c, t, g, unknown or other
  misc_feature (327)..(327): n is a, c, g, or t
tcagtactctcgtgcacgaccggtgctcgatttagctcgatatagttgggtttggggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcaggatattaggcgctcgttaggctggtatcagcagaaagcaagggaaaccccctaagctcctgatctatggtncatccactttggaaagtggggtccctnaaggttcagcgcagtggatcgtgggacagatttcactctcgccatcagcagcctgcagactgaagtattttgactaactttattttgtactaactaggtacttaaccgtaccttttaccccctctaaccgtttccgggacgggtaacgggaacccgtaagggttcggaacgtacgtacgaaacggtaccggtaaacgtcggttacggtccgttacggacccgtaacccgtaacgttaccgttacggttcctttaccg

SEQ ID NO: 157190 - DNA, 585 bp, Homo sapiens
  misc_feature: GYAE6OF02HJLKW.19.57.F02.1.454.CMB.1.raw
  modified_base (324)..(324): a, c, t, g, unknown or other
  misc_feature (324)..(324): n is a, c, g, or t
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcaggatattaggcgctcgttaggctggtatcagcagaaagcagggaaacccctaagctcctgatctatggtgcatccactttggaaagtggggtccctnaaggttcagcggcagtggatcgtgggacagatttcactctcgccatcagcagcctgcagactgaagtattttgactaacttttattttgtactaacgtaggtccttaaacctaccttttccccctactaaccgttttccgggaccgggtaacgggtaaccctaaaggggttcgggaacgtaacttaccgaaaggtccgtaaacgttggtacgggtaccgttcggacccgaacccgtaagttccgttacggttcctttaccg

SEQ ID NO: 157191 - DNA, 512 bp, Homo sapiens
  misc_feature: GYAE6OF02F3NHM.19.57.F02.1.454.CMB.1.raw
tcagtactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaaccccctaagctcctgatctatggtgcatccactttggaagtgggtcccctcgaaggttcagcggcagtggatcgtgggacagtatttcactctcgccatcagcagcctgcagactgaagtattttgactaactttatttttgtactaactaggtactaactacctttcccctctactttcggcggacgggaccaggtggagatacaagcgtaactgtggctcgcacctatctcg

SEQ ID NO: 157192 - DNA, 570 bp, Homo sapiens
  misc_feature: GYAE6OF02F47CT.19.57.F02.1.454.CMB.1.raw
tcagtactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcaggatattaggcgctcgttaggctggtatcagcagaaagcagggaaaccccctaagctcctgatctatggtgcatccactttggaaagtgggtccctcaaggttcagcggcagtggatcgtgggacagatttcactctcgccatcagcagcctgcagactgaagtattttgacttaactttatttttcgtactaaacaggtactaaactaccttttaccaacccttctaccgttttccgggaccgggtaacgggtacccgtaagggtcggaacggacttaccggaaacggtccgtaaacgttgggtacggtaccgttacggaccgtacccgtagttaccg

SEQ ID NO: 157193 - DNA, 555 bp, Homo sapiens
  misc_feature: GYAE6OF02GEK0E.19.57.F02.1.454.CMB.1.raw
  modified_base (324)..(324): a, c, t, g, unknown or other
  misc_feature (324)..(324): n is a, c, g, or t
tcagtactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcaggatattaggcgctcgttaggctggtatcagcagaagcaggaacccctagctcctgatctatggtgcatccactttggaaagtgggtcccctnaaggttcagcggcagtggatcgtgggacagtatttcactctcgccatcagcagcctgcagactgaagtattttgactaactttattttgactaacaggtacctaacctacctttaccccctctaccgttttcggacgggtaacgggtaccgtaagggtcggtaacgtaacgttacgaaacggtccgtaaacgttggtacggccgttacgaccgtaccgtagtccttaccgg

SEQ ID NO: 157194 - DNA, 592 bp, Homo sapiens
  misc_feature: GYAE6OF02FMBRC.19.57.F02.1.454.CMB.1.raw
  modified_base (398)..(398): a, c, t, g, unknown or other
  misc_feature (398)..(398): n is a, c, g, or t
tcagtactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagatcaccatcacttgcgggcagtcaggatattaggcgctcgttaggctggtatcagcagaagcacgggaacccctaagctcctgatctatggtgcatcctatttggaaagtcgggtccctcgtaaggttcagcggcaggtggatcgtgggacagtatttcactctcgctatcagcagcctgacagactagaatnttttagacttaactttattttacgtacctaaacacggtacctaaaccgttacccttttacccccgtacttaacccgttttccgggaccgggtaacggggtaacccgtaaggggttacggaacggaacttaaccggtaaacggtaccgtaaacgtggttacggaccttacggacctacccgtacgttcgttaccg

SEQ ID NO: 157195 - DNA, 578 bp, Homo sapiens
  misc_feature: GYAE6OF02GJ4QW.19.57.F02.1.454.CMB.1.raw
  modified_base (329)..(329): a, c, t, g, unknown or other
  misc_feature (329)..(329): n is a, c, g, or t
tcagtactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcaggatattaggcgctcgttaggctggtatcagcagaagcagggaaaccccctaagctcctgatctatggtgcatcctactttggaaagtggggtccctnaaggttcagcggcagtggatcgtgggacagatttcactctcgccatcagcagcctgcagactgaacgtattttcgacttaacttttatttttacgtactaaacgtacggtacttaaaccttacccttttccccccttactaaccgttttccgggacgggtaacggggtaccctaagggttcggacgtacgtaccgaaacggtccgtaacgttggtcgggtaccttacggacctaccgtattccgttacg

SEQ ID NO: 157196 - DNA, 561 bp, Homo sapiens
  misc_feature: GYAE6OF02FFJB3.19.57.F02.1.454.CMB.1.raw
tcagtactctcgtgcacgaccggtgctcgatttagctcgatatagttgggtttgggggcaggattcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcaggatattaggcgctcgttaggctggtatcagcagaagcagggaaacccctaagctcctgatctatggtgcatccactttggaaagtcggggtccctcgaaggttcagcggcagtggatcttggacagatttcactctcgcatcagcagcctgcagactgaagtattttgctaactttatttttgtactaacaggtaccttaaacctaccttttacccccttcgtaccttttcgggaccgggtaacgggtacccgtaagggtaggacgtaacgtacgaaacggtaccgtaacgttggtcggaccttacggacctacccgtattccgttacg

SEQ ID NO: 157197 - DNA, 618 bp, Homo sapiens
  misc_feature: GYAE6OF02GWYU1.19.57.F02.1.454.CMB.1.raw
  modified_base (198)..(198): a, c, t, g, unknown or other
  misc_feature (198)..(198): n is a, c, g, or t
  modified_base (302)..(302): a, c, t, g, unknown or other
  misc_feature (302)..(302): n is a, c, g, or t
tcagtactctcgtgcacgaccggtgctcgatttagctcgatatagttgggtttggggggagtcagacccagtcaggacacagcatggacatgagggtccccgctcagctcctggggctcctgctgctctggttcccaggttccagatgcgacatccagatgacccagtctccatcttccgtgtctgcatctgtagganacagagtcaccatcacttgtcgggcagtcaggatagttaggcgctcgttaggctggtatcagcagaaagcgaacgggaaacccctaagctcctgatctatggtncatccactttaggaagtcgggtccctgaggttcagcggtcgaggtggactcgtgggacagtatttcactctcgacatcagcacgcctgcagactgaagtatttcgacttaacttttattttgtactaacgtacggtaccttaaccctacccttttaccccctacttaccggttttaccgggaccgggtaacgggtaaacccgtaaggggttcggaacggtacgtaccggtaaacggtaccggtaaacggttcggttacgggtcccgttacggaccctaacccgtaagtttcccgttacggttcccttttaacccgg

SEQ ID NO: 157198 - DNA, 583 bp, Homo sapiens
  misc_feature: GYAE6OF02F4UF5.19.57.F02.1.454.CMB.1.raw
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagccaccatcacttgtcgggcgagtcaggatattaggcgctcgtaggctggtatcagcagaaagcacgggaaacccctagctcctgatctatggtgcatccatttggaaagtcggggtcccctgaaggttcaggcggcaggtggatcgtgggacagtatttcactcgtcgcatcagcagcctgcagactgaagttgtttagacttaacttttattttcgtactaaacgtaggtaccttaacttacccttttccccctacgttaccgtttccgggaccggtaacgggaaccgtaagggtcggaacggtacgtaccgaaacggtccgtaaacgttggtacggtcgtacggacctacccgtattaccggttcgttaccttacccg

SEQ ID NO: 157199 - DNA, 614 bp, Homo sapiens
  misc_feature: GYAE6OF02FHQQL.19.57.F02.1.454.CMB.1.raw
  modified_base (292)..(292): a, c, t, g, unknown or other
  misc_feature (292)..(292): n is a, c, g, or t
  modified_base (389)..(389): a, c, t, g, unknown or other
  misc_feature (389)..(389): n is a, c, g, or t
  modified_base (408)..(408): a, c, t, g, unknown or other
  misc_feature (408)..(408): n is a, c, g, or t
tcagtactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttggtcgggcgagtcaggatattaggcgctcgttaggctggtatcagcagaagcaagggaaacccctagctcctnatctatggtgcatccacgtttaggaaacgttcggggtccctgaacggttcaggcggcaggtggatcgtgggacagtactttcactctcgcatcagcncgctgcagactggaaagtnttttacggacttaacttttagttttacgtactaaacgtacggtaaccttaaaccttacccttttacccccttacgtaccgttttaccgggaccggggtaacgggaacccgtaggggtacggtaacggtaacgttaccggaaacggtaccggtaaacggttggttacgggaccttaggacccgtaacccgttacttccgtttaccgg

SEQ ID NO: 157200 - DNA, 648 bp, Homo sapiens
  misc_feature: GYAE6OF02F74BU.19.57.F02.1.454.CMB.1.raw
tcagtactctcgtgcacgaccggtgctcgatttagctcgatatagttgggtttggggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaacccctaagctcctgatctatggtgcatccactttggaaagtcggggtccctcaaggttcagcggcagtggatcgtgggacagatttcactctcgccatcagcacgcctgcagactagaaagtagttttagaccttaaacttttattttttacgtacctaaacgtacgggtaccttaaaccgttacccctttttaccccccttaccgttaacccgtttttccggggaccgggtaacggggtaacccgtaaaggggttcgggtaacggtaacgttaaccggaaaacgggtacccggtaaaccggttcgggttacgggtacccgttacggacccgtaacccgttaagttcccgtttacggtttaccctttaacccg

SEQ ID NO: 157201 - DNA, 539 bp, Homo sapiens
  misc_feature: GYAE6OF02I02VL.19.57.F02.1.454.CMB.1.raw
  modified_base (403)..(403): a, c, t, g, unknown or other
  misc_feature (403)..(403): n is a, c, g, or t
tcagtactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcaggatattaggcgctcgttaggctggtatcagcagaaagcaacgggaaacccctaagctcctgatctatggtgcatccagtttggaacgtcgggtcccctgaaggttcagcggcaggtggatcgtgggacagtatttcgactctcgcctatcgagcagcctgcagctagaatntttgactaactttattttcgacaacgtagtactaactacctttcccacttacgtttccggacggtacggtaccgtaggtggtaacgtatacgaaggtacgtaacgtggtcggctacgacgtacctagtccgttacg

SEQ ID NO: 157202 - DNA, 595 bp, Homo sapiens
  misc_feature: GYAE6OF02GUMKY.19.57.F02.1.454.CMB.1.raw
  modified_base (181)..(181): a, c, t, g, unknown or other
  misc_feature (181)..(181): n is a, c, g, or t
  modified_base (202)..(202): a, c, t, g, unknown or other
  misc_feature (202)..(202): n is a, c, g, or t
  modified_base (240)..(240): a, c, t, g, unknown or other
  misc_feature (240)..(240): n is a, c, g, or t
  modified_base (249)..(249): a, c, t, g, unknown or other
  misc_feature (249)..(249): n is a, c, g, or t
  modified_base (261)..(261): a, c, t, g, unknown or other
  misc_feature (261)..(261): n is a, c, g, or t
  modified_base (288)..(288): a, c, t, g, unknown or other
  misc_feature (288)..(288): n is a, c, g, or t
  modified_base (299)..(299): a, c, t, g, unknown or other
  misc_feature (299)..(299): n is a, c, g, or t
  modified_base (570)..(570): a, c, t, g, unknown or other
  misc_feature (570)..(570): n is a, c, g, or t
tcagtactctcgtgcacgaccggtgctcgatttagctcgatatagttgggtttgggggtcgaggagtcagaccagtcaggacacagcatgacatgagggtcccgctcagctcctggggctcctgctgctctcggttcccaaggttccagatgcgacatcagatgaccagtctcatcttcgngtctgcatctggtaggagacngagtcacatcacgttggtcggcgagtcaggatattagngctgttagntggtatcagcanaagcgaggtaaacccctagctcgtagntcgtaatggtnacatacctgtttacggaaaggtccgggtaccctcaaggttcagcggcagtggactagtggaaacggtactttccagtaccgttcacgactacgaacgcacgtcgtagcgaagacgtaacggtaaggtacttttagacttaacgttttatttttacggacaagtacgtaccgtaacttaccctttacccgtactaccttagggtaacccgagggtaaccctagggtaggtaacgtaacggtaactacggtaacgtaacgtaggtcggttacncggtacctaccgtacgttacttcgg

SEQ ID NO: 157203 - DNA, 581 bp, Homo sapiens
  misc_feature: GYAE6OF02HBB15.19.57.F02.1.454.CMB.1.raw
tcagtactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcaggatattaggcgctcgttaggctggtatcagcagaagcagggaacccctagctcctgatctatggtgcatccactttggaaagtcggggtcccctcaaggttcagcggcgagtggatcgtgggacaggtatttacactctcgccatcagcagcctgcagactgtaagtatttgactaactttatttttgtacaacgtacggtactaacctacctttaccccccttagttaacccgttttccgggaccgggtaacggggtaccctaaggggtcggtaacgtacgtaccgaaacggtaccggtaaaccgttggttacgggcttacggaccctaacccgtagttccgttaccg

SEQ ID NO: 157204 - DNA, 546 bp, Homo sapiens
  misc_feature: GYAE6OF02F8TJG.19.57.F02.1.454.CMB.1.raw
  modified_base (323)..(323): a, c, t, g, unknown or other
  misc_feature (323)..(323): n is a, c, g, or t
  modified_base (411)..(411): a, c, t, g, unknown or other
  misc_feature (411)..(411): n is a, c, g, or t
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgcgggcgagtcaggatattaggcgctcgttaggctggtatcagcagaaagcagggaaacccctaagctcctgatctatggtgcatccactttggaaagtgggtccctnaaggttcagcggcagtggatcgtggacagtatttcactctcgcatcagcagcctgcagactgaagtattttgacttaactttattttntactaaacacggtacttaactaccttttccccctactaccgttttccggacggtacgggaaccgtaagggtggagagtacgaaacggtaccgtaaacgtgttaggccgtagccaccgtatccgttagttccttac

SEQ ID NO: 157205 - DNA, 540 bp, Homo sapiens
  misc_feature: GYAE6OF02G91MA.19.57.F02.1.454.CMB.1.raw
tcagtactctcgtgcacgaccggtgctcgatttagctcgatatagttgggtttggggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcaggatattaggcgctcgttaggctggtatcagcagaaagcagggaaaccccctaagctcctgatctatggtgcatccactttggaaagtcggggtcccctagaaggttcaggcggcaggtggatcgtgggacagtatttcactctcgccatcagcagcctgcacgactagaagtattttgacttaaactttatttttgacaactaggacttaaacctaccttttccccctataccgtttcgggacggtaacggaaccaagggtggagactacgaaacgcgtaacgtggtgctggcctaccattctgtcttacg

SEQ ID NO: 157206 - DNA, 584 bp, Homo sapiens
  misc_feature: GYAE6OF02GDCAF.19.57.F02.1.454.CMB.1.raw
  modified_base (302)..(302): a, c, t, g, unknown or other
  misc_feature (302)..(302): n is a, c, g, or t
  modified_base (405)..(405): a, c, t, g, unknown or other
  misc_feature (405)..(405): n is a, c, g, or t
tcagtactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatagttaggcgctgttaggctggtatcagcagaaagcaaggaaacccctaagctcctgatctatggtncatcctacgtttggaaacgtcggggtccctcgaagttcagcggcagtggatcgtgggacagtatttccacttctcgccatcacgcagcctgcagactgaagtntttcgactaactttattttgactaacgaggtactaaacctaccttttaccccctcttaaccgtttccgggacgggtaaccgggtaaccgtaacgggttaggaacgtaacgttacgaaacgggtaccgtaaacgttcggtacgggtacctacggtacccaccgttacgttccgttaccgg

SEQ ID NO: 157207 - DNA, 850 bp, Homo sapiens
  misc_feature: GYAE6OF02G7GSL.19.57.F02.1.454.CMB.1.raw
tcagtactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctggaggagacagagtcaccatcacttggtcgggcgagtcgaggatagttaggcgctcgttaggctggtatcagcagaaagcgaacgggaacccctaagcctcctgactctagtggtgacacttacctacgtttagggaaacgggttccgggggttaccccctacggtaaacgggtttaccgaacgggtccgggtacgtaagggtacgggtaaacgttaccggttacgggggtaaacccgtaagggtaacctttttacccgaaccgtttcccgtacccggtacccttaaacgttaccccgtaacgggtaccctaaaccggtcccggttacggaacccggtaaccggggtaaacccttttaaggggaaaacgttttaacgtttttttaaccggtaaacccgttttaaaacgtttttttaaccgttttttttacggtaaaacccgttaaaacccgggtaaacgggttaacccgttttaaaacccttttaaccccccgttttttacccccccgttaccgtttaacccgggtttttacccggggaaccggggttaaacccggggtaacccggtaaggggtacggaaacggtaacgtaacgaacgggtacccggtaacgttagggtccgggtactcggaccctaaccgttgtaccgtttaccg

SEQ ID NO: 157208 - DNA, 545 bp, Homo sapiens
  misc_feature: GYAE6OF02JGX76.19.57.F02.1.454.CMB.1.raw
  modified_base (200)..(200): a, c, t, g, unknown or other
  misc_feature (200)..(200): n is a, c, g, or t
  modified_base (417)..(417): a, c, t, g, unknown or other
  misc_feature (417)..(417): n is a, c, g, or t
  modified_base (431)..(431): a, c, t, g, unknown or other
  misc_feature (431)..(431): n is a, c, g, or t
tcagtactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggngacagagtcaccatcacttgcgggcagtcaggatattaggcgctcgttaggctggtatcagcagaaagcaacgggaacccctaagctcctgatctatggtgctatccacgtttaggaaacgtcggggtcccctagtaacgggttcaggcggacagtcggattcgtagggactagtactttccacttcgtacgcatcagcagcctgcagactgaagtntttagactactttntttgacaactaggactaactccttccctactacgttcggcgtaggtaccgtaggtacggagtactacgtaacggcgtaacgtggacggtcgtcgaccgtacctacgttcgtacg

SEQ ID NO: 157209 - DNA, 545 bp, Homo sapiens
  misc_feature: GYAE6OF02GH3Q6.19.57.F02.1.454.CMB.1.raw
  modified_base (469)..(469): a, c, t, g, unknown or other
  misc_feature (469)..(469): n is a, c, g, or t
tcagtactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcagtcaggatattaggcgctcgttaggctggtatcagcagaaagcaagggaaacccctaagctcctgatctatggtgcatccactttgggaaaagttcggggtcccctcgtaaggttcaggccggcagtggattcgtggggacaggtatttccaacttctccgccattcagcagcctgcagactagaagtattttgactaactttatttttgactaagacggtccttaaactcctttccccctntacctttacggcgtacgggtaccaggtgacgatacgaagtcgtaacgttggtacgacgtcgacaccgtatcttacg

SEQ ID NO: 157210 - DNA, 572 bp, Homo sapiens
  misc_feature: GYAE6OF02J1TFT.19.57.F02.1.454.CMB.1.raw
  modified_base (544)..(544): a, c, t, g, unknown or other
  misc_feature (544)..(544): n is a, c, g, or t
tcagtactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtccaccatcacttgtcgggcagtcaggatattaggcgctcgtaggctggtatcagcaagaagcaacgggaaccccctaagctcctgactctatggtgcatccacgtttggaaacgtcggggtcccctcgaaggttcaggtcggctaggtgtagtcgtagggacaggtacttcgactctcgcctatcgagccagtcctgactagacgtagaacgttatttagacttaactttattttacgtacaacgtacggtacttaaccttacctttcccccttagtacccgtttacggacgtacgggtaaccgtagggtagacgtacttacgaacgtcgttacgngtacggctacgacctaccgtatcgttcg

SEQ ID NO: 157211 - DNA, 762 bp, Homo sapiens
  misc_feature: GYAE6OF02HW9GY.19.57.F02.1.454.CMB.1.raw
  modified_base (201)..(201): a, c, t, g, unknown or other
  misc_feature (201)..(201): n is a, c, g, or t
tcagtactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtagganacagacgtcaccatcacgtttggcgggcgagtcagggtattattaggcgtcttcggttaggctggtatcagcaagaaagccgaacgggaaaccccctagcctacctgtactctagtggtacgctacttaccgtacgttaggaacggttccgggttacccctaggtaacggttccgaacggcggtacgaggtcggtacgtcggtacgggaactacgttacgtttacaccgttaccgtaccggaccctaacgtcctaacggccgtaaacggtcccgttagaccgaacggtacgttaaggtaaacgttttacgttttacgaaccttttaaacgtttttacgttttacgtaaccgtaaaccggttacggttaacccttttaaaccccgttccccgtttttaacccccgttaccggttaacccgggttttaccggggaacccgggttaacggggttaaccccggtaaaggggtttacggaacggttaacttaaccgggaacgtaacccggtaagttcgggtacggtaccctagggtaaccctacccgttacgtttccgttaaccgg

SEQ ID NO: 157212 - DNA, 793 bp, Homo sapiens
  misc_feature: GYAE6OF02FRFCV.19.57.F02.1.454.CMB.1.raw
tcagtactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcggttaggctggtatcagcagaagcaacgggaaacccctagctcctgatctagtggtgacacttcctacgttttagggaaacggttcgggggttaccccctagtaaacgggttccgaaggtccgggacgtaggtagggtacgttcggttagggggactaaggttaactttttacccgacctttccgtacccggtaccctacttccgaacggacccgtaaccggtcccgttaggacccgaagggtaacccgtttaagggtaaaacggtttacgttttttacgggaacctttaaaaccgtttttttagttttttttacggtaacccttaaaaccggttaacggggttacccttttaaaaccccgtttacccctttttttacccccccgttaacgtttaaccccggtttttacccgggggaaccgggggttaccggggtaaacccggttaagggggtacgggtaaacggtaaccgttaaccggaaacgggtacccggttaacgttcggggtacggtccgtacggaccctaccgttacgttccgtttaccg

SEQ ID NO: 157213 - DNA, 579 bp, Homo sapiens
  misc_feature: GYAE6OF02G4B0V.19.57.F02.1.454.CMB.1.raw
  modified_base (301)..(301): a, c, t, g, unknown or other
  misc_feature (301)..(301): n is a, c, g, or t
  modified_base (360)..(360): a, c, t, g, unknown or other
  misc_feature (360)..(360): n is a, c, g, or t
  modified_base (383)..(383): a, c, t, g, unknown or other
  misc_feature (383)..(383): n is a, c, g, or t
tcagtactctcgtgcacgaccggtgctcgatttagctcgatatagttgggtttggggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatagttaggcgtctcgttaggctggtatcagcagaagcaacgggaaacccctagctcctgatctatggtnctactcctagtttaggaaggtcggggtcccctagaacggttcaggcggcagtggatcgngggtacagtattcactctcgcancagacagctagcagacgtagaagtattttcgacttaacgttttattttacgtaacaactaggtaccttaaaccttcccttttccccctcgttacgtttccgggacggtacggtaaccgtaagggtaggacgactaccgaaggtacccgtaagtcggtcggtactacggaccaacgtacgttccgttgttcttaccg

SEQ ID NO: 157214 - DNA, 564 bp, Homo sapiens
  misc_feature: GYAE6OF02GAWNG.19.57.F02.1.454.CMB.1.raw
  modified_base (357)..(357): a, c, t, g, unknown or other
  misc_feature (357)..(357): n is a, c, g, or t
tcagtactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttcgtgtctgcatctgtaggagacagatcaccatcacttggtcgggcagtcaggattattaggcgctcgttaggctggtatcagcagaaagcacgggaaacccctaagctacctgatctatggtgcatccactttagggaaacgtcgggtcccctgaaggttcagcggcaggtgatcgngggacagtatttcactctcgacctatcgagccagcctgacagactagtaatattttgacttaactttattttagacctaaagtacggtaccttaaacttcccttttaccccgtattaccgtttcggaccgggtaacggaccgtaggtggaagtacgtacgtaacgacggttaacgtgttacggcttacggacaccgtagttcttcgg

SEQ ID NO: 157215 - DNA, 599 bp, Homo sapiens
  misc_feature: GYAE6OF02IDGSJ.19.57.F02.1.454.CMB.1.raw
  modified_base (436)..(436): a, c, t, g, unknown or other
  misc_feature (436)..(436): n is a, c, g, or t
tcagtactctcgtgcacgaccggtgctcgatttagctcgatatagttgggtttggggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatagttaggcgctcgttaggctggtatcagcagaaagcagggaaaccccctaagctacctgatctatggtgcatcctacgtttggaaagtcggggtccctcgaaggttcaggcggcagtggatcgagggacaagtattcactctcgccatcagcagcctgacagactgaagtattttgacttaactttagtttttacgctaaacnggtacttaaacctacccttttccccctacttaccgttttacgggaccgggtaacgggtaaccgaaggggttcgacgtaacgtaccgaaacggtccggtaaacgttcggttaccggaccgttcggacccgtaacccgtagttcccgttacggttacctttaccg

SEQ ID NO: 157216 - DNA, 596 bp, Homo sapiens
  misc_feature: GYAE6OF02IZQ4L.19.57.F02.1.454.CMB.1.raw
  modified_base (307)..(307): a, c, t, g, unknown or other
  misc_feature (307)..(307): n is a, c, g, or t
  modified_base (404)..(404): a, c, t, g, unknown or other
  misc_feature (404)..(404): n is a, c, g, or t
tcagtactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatccacttggcgggcgagtcaggatagttaggcgctcgttaggctggtatcagcaagaacgcacgggaaacccctaagctcctgatctagtggtncactcctacttaggaaacggtcgggtcccctgtaacggttcaggcggcaggtcggatcgtaggacagtactttcacttctccgactagtcagcgacncctgacagtactagtaagttagtttcgtacttaacttttcgttttagaccgtaacgtacggtacttaacctaccctttacccctcttaccgtttccggacgggtacgggtacccgagggttacggacggtaacgttacgaacggtaccgtaacggtggtccggtactcggtacccaccttacgtcttaccgg

SEQ ID NO: 157217 - DNA, 564 bp, Homo sapiens
  misc_feature: GYAE6OF02GTYEH.19.57.F02.1.454.CMB.1.raw
  modified_base (558)..(558): a, c, t, g, unknown or other
  misc_feature (558)..(558): n is a, c, g, or t
tcagtactctcgtgcacgaccggtgctcgatttagctcgatatagttgggtttgggggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttggtcgggcgagtcaggatagttaggcgctcgttaggctggtatcagcagaaagcacgggaaacccctaagctcctgatctatggtgcatcctacgtttaggaaacggttcggggtcccctacgaaggttcacggcggcaggtggatcgtgggacagtattcactctcgccatcagcacgcctgcagactagaagttatttcgacttaacttttatttttacgtactaacgtacggtacttaaaccgtacccttttcccctacttaccgttttcgggacggtacggtaaccgtaagggtacgagatacgaaggtcgtaacgtggtgtctcgccacgctcgtntcttcc

SEQ ID NO: 157218 - DNA, 743 bp, Homo sapiens
  misc_feature: GYAE6OF02F91J8.19.57.F02.1.454.CMB.1.raw
  modified_base (181)..(181): a, c, t, g, unknown or other
  misc_feature (181)..(181): n is a, c, g, or t
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtntctgcatctgtaggagacagagtcaccatcacgttggtcgggcgagtcaggattagttaggcgtctcggttaggcttggtatcgagcaaggaaacgcgaacggaaaccccctaagcctcgtagacttacgtagtggtcgtactactaccgtaacgttttagggaaacggttccgggggtaccccttacggtaaacgggtttcgaacgggtccgggtacgtaacggttgggtaacgttcggtacgggtaactaacgttaacttttaccgtaccgttccgtaccggtaccctaacgtaccgacgtaccgacggtcccgtagtaccgaacggtaacgttacggtaaagtttagttttacgtaacctttaacgtttttacgttttacgacctaaacgtacggttaccttaaacccttcccgttttacccccttacgttaccggtttaccgggtaccgggtaaacggtaaccgtaagggtacggacgtaacgtaaccggtaaaccggtacgttcgggtacggtcctaacgacctaccgttagtaccttcggttaccttcgtaacccg

SEQ ID NO: 157219 - DNA, 723 bp, Homo sapiens
  misc_feature: GYAE6OF02J21BA.19.57.F02.1.454.CMB.1.raw
  modified_base (106)..(106): a, c, t, g, unknown or other
  misc_feature (106)..(106): n is a, c, g, or t
  modified_base (534)..(534): a, c, t, g, unknown or other
  misc_feature (534)..(534): n is a, c, g, or t
  modified_base (716)..(716): a, c, t, g, unknown or other
  misc_feature (716)..(716): n is a, c, g, or t
tcagtactctcgtgcacgaccggtgctcgatttagctcgatatagttgggtttgggggcaggagtcagacccagtcaggacacagcatggacatgacgggtccccnctcagccttccgtgggctcctgctgtcctcgttcggtcccaggttccagatcgcgactactccgagtacgtaccgaccgtacgtcctacctacttccgttcgtcgtcgtcgactacgtcgtaggacggacgacgtacgtacctccacgtacgtaccgtacgttcgggacggtacgtacgtacggagttacgttacgggtcgtcgttccgttaggtacgcgttagaccagtacgaacgaacggaccacggtaaacccgtactcgtccttgtaacgtacgttcggtacgtacgtaccgtacgttacgttaccggttgggtaaccggtaccgtccgtacgtacgtacgcggagtcggtacgtgtaacgtccgtaggtaacgtacttagtcccgttaccacgttcgacgcgtacgtacgaacctcgtaccgngtacgaacgttacgtacgtttagttaacttacggtttaacctacgtttactttacaccggacttaccgtacttacccgttacccgtcgtttaccgacgggttaccgtaacgggagtaccgagtactacggactaaggaccgactaaccggcgtacgacctctaaccgttcgtctaccggttntaccccg

SEQ ID NO: 157220 - DNA, 603 bp, Homo sapiens
  misc_feature: GYAE6OF02I7XXE.19.57.F02.1.454.CMB.1.raw
  modified_base (299)..(299): a, c, t, g, unknown or other
  misc_feature (299)..(299): n is a, c, g, or t
tcagtactctcgtgcacgaccggtgctcgatttagctcgatatagttgggtttggggcaggagtcagacccagtcaggacacagcatggacatgagggtccccgctcagctcctggggctcctgctgctctggttcccaggttccagatgcgacatccagatgacccagtcctccattcttccgtgtctgcatctgtaggagacaggagtcaccagtccacttggtcgggcagtcaggattagttaggcgctcgtagcgtggtatcagcaagaagcgaacgggaaacccctagccttcngactctagtggtcgacactacctacgtttaggaacggttcgggtccctagaaggttcaggcgagagtcggtatcgtggactagtacttcgactcgtcgacatcgacgcacgtcgtgacacgactagtaacgttagtttacgacttaacgtttactttttagaccgtaagtaccgtaccttaaaccgttaccctttaccctacgttacgtttaccgggacggtacgggtaacctagggtacggagtaacgtaacaacggtaccgtaacgtggttacggcctacgtacaccgttacgtccgttacg

SEQ ID NO: 157221 - DNA, 664 bp, Homo sapiens
  misc_feature: GYAE6OF02FRH7Q.19.57.F02.1.454.CMB.1.raw
  modified_base (299)..(299): a, c, t, g, unknown or other
  misc_feature (299)..(299): n is a, c, g, or t
tcagtactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctggtaggagacagagtcaccatcacttggtcgggacgagtcaggatagttaggcgcttcggttaggctggtatcgagcaagaacgcgacggaaacccctagctccngtactcgtagtggtgctactccgtacgtttaggaacggtccgggtccctagacggttcgaggtcggacgaggtgagtcgtaggactaggtactttccacgttcctcgacctataccgacgccgacgtccgttacgaccgtagtaccgttaggtaaagtttacttttacggtaactttaacgtttttagttttaccgtacgtaaacgtacggttaacccttaacccgtttaccccttttaccccgttaccgttaccggtttaccgggaccgggtaacgggtaaccgtagggtacggtaacgtacgtaaccggaacggtaccggtacgttcggtacggtcgtacgacctacgttcgttacgttaccg

SEQ ID NO: 157222 - DNA, 591 bp, Homo sapiens
  misc_feature: GYAE6OF02G8NNG.19.57.F02.1.454.CMB.1.raw
  modified_base (316)..(316): a, c, t, g, unknown or other
  misc_feature (316)..(316): n is a, c, g, or t
  modified_base (376)..(376): a, c, t, g, unknown or other
  misc_feature (376)..(376): n is a, c, g, or t
  modified_base (384)..(384): a, c, t, g, unknown or other
  misc_feature (384)..(384): n is a, c, g, or t
  modified_base (403)..(403): a, c, t, g, unknown or other
  misc_feature (403)..(403): n is a, c, g, or t
tcagtactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtcctccatccttccgtgtctgcatctgtaggagacagagtcaccatcacgttggtcgggcgagtcgaggtattattagggcgctcggttaggctggtatcagcaagaagcgaacgggaaacccctagcctcctagatctagtggtncactcctacgtttaggaacggttcgggtacccctagaaggttcaggcgcgagtggatcgnggacagtnttcactctcgacatcagcncgccgtgcagactaggtaacttagtttcacttaacttttattttacggactaacgtacgttacctaaacccttaccctttccccctacttaccgtttccgggacggtacgggtaaccgtagggtacggtagtaacgtaccgaacggtaccgtaacgttaggcggtactcgaccgacctatccgttacg

SEQ ID NO: 157223 - DNA, 672 bp, Homo sapiens
  misc_feature: GYAE6OF02I03G3.19.57.F02.1.454.CMB.1.raw
tcagtactctcgtgcacgaccggtgctcgatttagctcgatatagttgggtttggggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaaccatcacttggtcgggcgagtcaggatagttaggcgctcgtaggctggtatcagcagaaagcacgggaacccctaagctcctgatctagtggtgcactcctactttagggaacgtcggggtcccctagaacggttcaggcggcgagtggactcgtagggacaggtactttaccacgttccgtccgacacgtacgacgaccacgtccgtagacgaacgtaacgtacggtaaagttacgttttacgaccgtttaaactttttacgtttttacgtacccgtaaacgtacggtaccttaaacccttacccctttttacccccgtaccgtttacccgtttaccggggaccgggtaaaccggggtacccgaagggttcggaacgtacgttaaccggaacggtaccgttaacggtcggttacggaccgttaccggaccgtaccctagttccttacggttcctttaacccgg

SEQ ID NO: 157224 - DNA, 679 bp, Homo sapiens
  misc_feature: GYAE6OF02JCUMD.19.57.F02.1.454.CMB.1.raw
  modified_base (301)..(301): a, c, t, g, unknown or other
  misc_feature (301)..(301): n is a, c, g, or t
  modified_base (643)..(643): a, c, t, g, unknown or other
  misc_feature (643)..(643): n is a, c, g, or t
tcagtactctcgtgcacgaccggtgctcgatttagctcgatatagttgggtttggggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgcgggcagtcaggatagttaggcgctcgttaggctggtatcagcagaaacgcgacggaaacccctaagctcctgactctatggtncatcctagtttaggaacgtcggggttccctagtaacggttcgacggcggacaggtggactcgtagggactagtactttccgacttccgtacgcctacgtaccacgccgtacgcccgttagaccgtaacgtacgttacggtaaagttacgttttacggacctttaaactttttacgtttttactaccgtaaacgtaacggtacctttaaacccgttaccccgttttacccccgttacgttaacccgttttaccgggggaccgggttaaccggggtaaaccggttaagggttacgggtacgtaacgtaccgaaacggtaccggtaaacgtcggtcgggtacccnggtacccaccgtagtttaccgttcgttacgttaccc

SEQ ID NO: 157225 - DNA, 654 bp, Homo sapiens
  misc_feature: GYAE6OF02IUHFS.19.57.F02.1.454.CMB.1.raw
  modified_base (297)..(297): a, c, t, g, unknown or other
  misc_feature (297)..(297): n is a, c, g, or t
  modified_base (349)..(349): a, c, t, g, unknown or other
  misc_feature (349)..(349): n is a, c, g, or t
tcagtactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatcgacccagtctccatcttccgtgtctgcatctgtaggagacagagtcaccatcacgttgtacgggcagtcaggtatagttaggcgctcgtaggctggtatcagcagaagcgaacggaaacccctaagctccgtgactntagtgtgcatcctagtttaggaacggtcggggtccctagacggttcagcggntaggtggtatcggtagggactaggtacttcgacctaccgtccgaccgtaacgtccgtaaacgtccgtaacggtcccgttaggaccgtaacggtaacggttacggtaaaacggttagttttacgtaccttaaaccgtttttaacgttttcgtaacctaaaccgtaggttaacccttaaccgttacccttttccccgttacgtaccgttttccgggaaccgggtacggtaacccgtaagggtcggagtacgtacggaacgtacgtacgtacgtcggtacgtcgacctacgtatcgttgtcgttaccg

SEQ ID NO: 157226 - DNA, 831 bp, Homo sapiens
  misc_feature: GYAE6OF02GFQTO.19.57.F02.1.454.CMB.1.raw
tcagtactctcgtgcacgaccggtgctcgatttagctcgatatagttgggtttgggggagtcagacccagtcaggacacagcatggacatgagggtccccgctcagctcctgggctcctgctgctctggttcccaggttccagatgcgacatccagatgacccagtctccatcttccgtgtctgcatctgtaggagacagagtcacatcacttgtcggcagtcaggatagttaggcgctcgttaggctggtatcagcaagaagccgaacgggaaaccccctagctcctgactctagtggtcgactactcctacgtttaggaaacggttccggggtaccccttacgtaaacggtttcgaacggtcggactaggtacggacttcggtacgggaactaagtacttttaccgaaccgttccgtccggacctaacgttaccgaacggaccgtaacggtccccttacggaccgtaacggtaaacttacgggtaaaacgtttcgtttttaaccggtaaccttttaaaacgttttttacggttttttaacgtaacccgttaaaaaccggttaaccgggtttacccttaaaaccccgttttacccccgttttttacccccccgtttaacgtttacccggttttttacccgggggaaaccggggtaaaccgggttaaaacccggttaaacgggggttaacgggtaacgttaaccgttaaaccgggtaaaacggtaacccggttaaacgggtttccgggtttaccgggtaacccgtttacgggaacccctttaaaccgttaaccgtttacccggttttaccggtttacccttttaaccccgg

SEQ ID NO: 157227 - DNA, 591 bp, Homo sapiens
  misc_feature: GYAE6OF02HRBME.19.57.F02.1.454.CMB.1.raw
  modified_base (268)..(268): a, c, t, g, unknown or other
  misc_feature (268)..(268): n is a, c, g, or t
  modified_base (311)..(311): a, c, t, g, unknown or other
  misc_feature (311)..(311): n is a, c, g, or t
  modified_base (362)..(362): a, c, t, g, unknown or other
  misc_feature (362)..(362): n is a, c, g, or t
  modified_base (370)..(370): a, c, t, g, unknown or other
  misc_feature (370)..(370): n is a, c, g, or t
tcagtactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatcgtgtaggagacagacgtccaccatcacttggtcgggcgagtcgaggatagttaggcgctcgttaggctggtatcngcagaagcgaacgggaaccccaaggcctcctgatctagtggtncatccagtttaggaaggtcgggtccctagacggttcagcggcaggtgatgnggacagtnttacactccgtcgccatcgagcagcctgacacgtactagaagttatttcgtactaactttttattttcgactaaaccgtagccctttaaacctacccttttccccactttaccgggttcggaccgggtaaccgggtaacgtagggttacgaacggtctaaccggaaagtaccggtaaacgtgggtacggtccttacggacctaaccgtagttcccttacgg

SEQ ID NO: 157228 - DNA, 737 bp, Homo sapiens
  misc_feature: GYAE6OF02G4SB0.19.57.F02.1.454.CMB.1.raw
tcagtactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctggtaggagacagacgtcaccatcacgttgtcgggcgaggtcaggtatagttaggcgctcgttaggcgtggtatcagcagaagcaacggaacccctaagctcctgatctagtggtgctactcctacgtttagggaaacggtccggggttcccctacgtaacggttcgaacggtccggcgtacgggtggtaactcggttacgggaactagggtacttttaccgtaacctttcccgccggtacccctagttaccgacggaccgtacgtcccgttcggaccgaacgtaaccggttaaggaacgtttaacgtttttacggacccttttaaagtttttacttttttaggacccgtaaacgtacggttacccttaaaccgttaccccttttaccccgtacctttaccgggtttaccgggaccgggtaacggggtaacccggttaaggggttcggaaacggttccttaaccggaaacggtaccgggttaaaccgttcggttacgggtacccggttacgtaaccgtacccggttacttaccgttttacccgg

SEQ ID NO: 157229 - DNA, 635 bp, Homo sapiens
  misc_feature: GYAE6OF02HI92S.19.57.F02.1.454.CMB.1.raw
  modified_base (412)..(412): a, c, t, g, unknown or other
  misc_feature (412)..(412): n is a, c, g, or t
tcagtactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtcctccatccttccgtgtctgcatctggtaggagacagagtcaccatccacttcggtcgggcgagtcaggattattaggcgctcgttaggctggtatcagcagaagcaagggaaacccctagcctcctgactctatggtcgctatcctacgtttaggaaacggtcggggtccctacgaaggttcaggcggacaggtggagtcgtcggactagtattcacttctcgctactcgagcacgtccngcacgagtagaagttactttacgacttaacttttattttcgtactaaacgacggtaccttaaccgtccccttttacccctaccgttaccgttttacccggacggggtaaccgggtaaccggtagggtaacgggtaacgtaacgtaccggaaacggtaccggtaaccgttagggttacgggtcgttaaccggtaccgtaccccgttaggttacccgtttaccgg

SEQ ID NO: 157230 - DNA, 610 bp, Homo sapiens
  misc_feature: GYAE6OF02GRQ6H.19.57.F02.1.454.CMB.1.raw
  modified_base (190)..(190): a, c, t, g, unknown or other
  misc_feature (190)..(190): n is a, c, g, or t
  modified_base (202)..(202): a, c, t, g, unknown or other
  misc_feature (202)..(202): n is a, c, g, or t
  modified_base (450)..(450): a, c, t, g, unknown or other
  misc_feature (450)..(450): n is a, c, g, or t
tcagtactctcgtgcacgaccggtgctcgatttagctcgatatagttgggtttgggggcaggagtcagacccagtcaggacacagcatggacatgagggtcccccgctcagctcctggggctcctgctgctctggttcccaggttccagatgcgacatccagatgacccagtctccatcttccgtgtctncatctgtagganacagagtcacatctacttgtcgggacgtagtcaggattagttagggcgcttcgttaggctggtatcgagcaagaagcgaacgggaaacccctaagcctctagtctagtagtggtcgctactacctacgtttacggaaacggttcgggttacccctacgtaagggttcacggcggacgtaggtcggtagtcgtagggaactgtacttccacgtctcgcctatcaggcagtccagcacgactgaagtttntttacgacttactttaatttcggactaacggtactacgttaacccttcctttcccctacgttacgtttaccggacggtaacgaccggtaggtacggagaacgtaccgaacggtacggtaacgttcggtacgtccgtacgtaaccctcgtactcgttaccg

SEQ ID NO: 157231 - DNA, 728 bp, Homo sapiens
  misc_feature: GYAE6OF02IYLXX.19.57.F02.1.454.CMB.1.raw
tcagtactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatcgacccagtctccattcttccgtgtctgcatctgtaggagacagagtcacatcacttgcgggcgagtcaggtatagtaggcgtcgtcggttaggctaggtatcgaagcgaagaaacggccgaaccgggtaaaacccctaggacctccgtagacttactagtcggtcactactacctaacgtttaggaacggttccgggtaccctaggtaacggttcgaggtaccggcgtaaggtcggtacgttacggacgggtaactaacggttaactttcctaaccgttcctaccggtacctaacgtacgaaccgtccgaacgtcccgttaagacgtaacggtaccgtaaaggttaaacgtttacttttaacgtaaccgttttaaacgttttacgtttttaagaacccgttaaacggttacgttaaccttaaccccgttaccccttttaccccgtaccgtttaacccggttaccgggtaaccggggtaaccgtaaccggtacggtaacggtaacgtactaaccggtaacgaacgttaacgtggtacgctacgaccaccgtagttaccgttaccg

SEQ ID NO: 157232 - DNA, 770 bp, Homo sapiens
  misc_feature: GYAE6OF02F5RC9.19.57.F02.1.454.CMB.1.raw
  modified_base (315)..(315): a, c, t, g, unknown or other
  misc_feature (315)..(315): n is a, c, g, or t
tcagtactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctggtaggagacagagtcaccatccacttggtcgggcgagtcaaggtatagttaggcgctcgttaggctggtatcgagcagaaagcgaacgggaaaccccctaagcctctgatctagtggtcnctactcctacgtttagggaaacggttcgggtacccctacgtaaggttccgacggcggtataggtggtacgtcggtaggggaactaggtactttccgaccgttctaccggtaccctacgttaccgagtaccgtaacgtcccgttacgaccgtaacggtaaccgttaaggtaaacgggtttaactttttaacggtaaccttttaaacgttttttagtttttttaacggtaaccgtaaaaccgtacgggtttaaccctttaaacccgttacccccgttttttacccccgttaccgtttaacccggtttaccgggtaccggggtaaaccggggtaacccggttaacggggttaggtaaccggtaaaccgttaaccggtaaaacgggtacccggttaaaccggtttcggggtaccggtacgttaccggaacccgtaacctttacggtttacccgttaccg

SEQ ID NO: 157233 - DNA, 752 bp, Homo sapiens
  misc_feature: GYAE6OF02HR6M4.19.57.F02.1.454.CMB.1.raw
  modified_base (394)..(394): a, c, t, g, unknown or other
  misc_feature (394)..(394): n is a, c, g, or t
tcagtactctcgtgcacgaccggtgctcgatttagctcgatatagttggggtttgggggagtcagacccagtcaggacacagcatggacatgagggtccccgctcagctcctggggctcctgctgctctggttcccaggttccagatgcgacatccagatcgacccagtctccattcttccgtgtctgcatctgtaggagacagagtcacatctagttcggcggcgagtcaggattagttaggcgtcgttcgttaggctggtatcgagacaagaagaccgaacggaaacccctagcctcctgattcgtagtggtacgcactacctagtttagggaaacggttccgggtaccctaggtaacggttccgagggcgacgtaggttcggtactacggnggtactaagttactttaccacgttcgtaccgacctagtacgacggactcggaccgtagaccgtaacgtaggtaacgtaaggtttacttttacgtaacgtttaacgttttttagttttaacgtacgtaaacgtacggtttaacccttaaacccgttttccccgtttaaaccccccgttgttaaacccgggtttcggggtaacccggggttaaacggaaaccgggttaacggtacgggtaacgttaaccgggtaaccgtaaacggtacccgggttaacgttaccggggtaccgtaccggttcccgtaacccggtaaaccttccgggttttacgtttaccccgttaccgttttaaccccgg

SEQ ID NO: 157234 - DNA, 717 bp, Homo sapiens
  misc_feature: GYAE6OF02JBZ0I.19.57.F02.1.454.CMB.1.raw
  modified_base (164)..(164): a, c, t, g, unknown or other
  misc_feature (164)..(164): n is a, c, g, or t
  modified_base (198)..(198): a, c, t, g, unknown or other
  misc_feature (198)..(198): n is a, c, g, or t
  modified_base (201)..(201): a, c, t, g, unknown or other
  misc_feature (201)..(201): n is a, c, g, or t
  modified_base (294)..(294): a, c, t, g, unknown or other
  misc_feature (294)..(294): n is a, c, g, or t
tcagtactctcgtgcacgaccggtgctcgatttagctcgatatagttgggtttgggggagtcagacccagtcaggacacagcatggacatgagggtccccgctcagctcctgggctcctgctgctctggttcccaggttccagatgcgacatccagatgacccngtcctccatcttccgtgtctgcatctggtagganacngagtcacctatcacgttggcgggcagtcaggtatagtaggcgtcttcggttagctggtactcagcagaagcgaacgggtaacccctagctccngtaactctacgtggtacgcctaacgttcccttaaggtttcgggaaaccgggtttccggggtacccccttaaggtaaacggggtttccaaggggcccggtataaacggggtttcggaaacgttttcggggacgggtaacctaggtttaaccgtttaccgcccgttactccggtacctagttaccgaacgacgtaaccgtccctacggtacgaacgttaaccggtaggtaaagtttacgtttcgaaccgttttaacgtttaactttttcggaaaccaacggttacgtaaccttacccttaccccgttttacccgtaccgtttcggttaaccggcgggttaaacggaccggttaggcgtagtcgacgtacggtaaccgagttcggaacgttccacggtacctacgtagtacgtttctacccgtacg

SEQ ID NO: 157235 - DNA, 673 bp, Homo sapiens
  misc_feature: GYAE6OF02JF2LN.19.57.F02.1.454.CMB.1.raw
  modified_base (201)..(201): a, c, t, g, unknown or other
  misc_feature (201)..(201): n is a, c, g, or t
tcagtactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtagganacagagtcaccatcacttggtcgggcgagtcaggtatagttaggcgtctcggttaggcttaggtatcagcaagaaagcgaacgggaaacccctaagcctcctgactctagtggtcgctactcctagtttagggaaacggttcggggtacccctacgtaacgggttcaacggcggacgtaggtgggtactcggtagggaactaggttacttttccacttcgtccgcctacgtcacggacacgtccgtgaccgtaagtaccgttaggtaaacttacgttttacgtaaccttaaacgttttttattttacggtaacctaaacggttaaccggtaacctttaaaccctacccttttacccccgtactttacccggttttacggggaaccgggtacgggtaaccgtaagggttcggaacgtaacgtaccgaacggtaccgtaagttcggcggtacgtcgacctacctagttcttacg

SEQ ID NO: 157236 - DNA, 760 bp, Homo sapiens
  misc_feature: GYAE6OF02H2JC7.19.57.F02.1.454.CMB.1.raw
  modified_base (203)..(203): a, c, t, g, unknown or other
  misc_feature (203)..(203): n is a, c, g, or t
  modified_base (319)..(319): a, c, t, g, unknown or other
  misc_feature (319)..(319): n is a, c, g, or t
  modified_base (409)..(409): a, c, t, g, unknown or other
  misc_feature (409)..(409): n is a, c, g, or t
tcagtactctcgtgcacgaccggtgctcgatttagctcgatatagttgggtttgggggcgaggagtcagacccagtcaggacacagcatggacagtgagggtccccgctcagctcctggggctcctgctgctctggttcccaggttccagatgcgacatccagatgacccagtctccatcttccgtgtctgcatctgtagganacagagtcaccatctacttggcgggcgagtcaggtatagttaggcgtcttcgttaggcttggtatcagcaagaaagcgaacgggaaacccccctaagcctcctagatctagtggtnctactcctaacgtttagggaacggttccggggtccctagtaacggttcgaacgcggtacgaggtggtacttcgtacgggtaactaacgtnttttaccgaaccttcgttaccgacctaacttaccgaacgtacgaacgtcccgttagaccgaggtaaccgtaaggtaacgtttaacgtttttacgacccgttttaaactttttaactttttaccggttaactaaaccggtacggttaacccttaaaaccctttaccccgtttttcccccgttacgttaacccgggttttaccgggacccggggttaaacgggtacccggtaaaggggttccgggtaaacgtaaccgttaaccggtaaacgggtaacccgttaaaccggttcgggttaccgggtaccggttaccgtaacccggttaaaccgttcgtttaacccggtttaccgg

SEQ ID NO: 157237 - DNA, 807 bp, Homo sapiens
  misc_feature: GYAE6OF02HEESN.19.57.F02.1.454.CMB.1.raw
tcagtactctcgtgcacgaccggtgctcgatttagctcgatatagttgggtttgggggcaggagtcagacccagtcaggacacagcatggacatgagggtccccgctcagctcctgggctcctgctgctctggtccaggttccagatgacgacatccagatcgaccagtactccatcttccgtgtctgactatctgtaggagacagagtcaccgatcagttcggacggcgagtcaggatagtagacgctcgtagcgtaggactcgagacagaacgacgaacggaaacccctaagcgtccgtaggtactcgttacgtggtacgtaccgtactaccgtaacggttttaacgggaaacggttccgggtaccccgttacggtaaacggttacggtaacggaccggtacgtacggttacggtacgtaccggttagggaaacttaggtaactttaccgtacgttaccgtccgaaccgtacgttcgaacgtacgaaccgtacgtacggaactaaccggtaacgtacggtaaaagtttccgttttaacgtaacccggtttaaattttacgttttttaaccggaacgttaaaccgtaaccggtttaaaccgtaaccccttaacccgtttttaccccgttaaccgtttacccgtttaaaccggggtaccggggtaaacccgggtttaaccggtaaagggttacgggggtaaaacctaacggttaccgggtaaaccggttccgttaaaaccggtttgggttaacccggtcggttaaaccgtacccccgtaaacggttacccgttaccgttttacccgg

SEQ ID NO: 157238 - DNA, 588 bp, Homo sapiens
  misc_feature: GYAE6OF02IBIU1.19.57.F02.1.454.CMB.1.raw
  modified_base (388)..(388): a, c, t, g, unknown or other
  misc_feature (388)..(388): n is a, c, g, or t
  modified_base (397)..(397): a, c, t, g, unknown or other
  misc_feature (397)..(397): n is a, c, g, or t
  modified_base (407)..(407): a, c, t, g, unknown or other
  misc_feature (407)..(407): n is a, c, g, or t
tcagtactctcgtgcacgaccggtgctcgatttagctcgatatagttgggtttggggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggtatattaggcgctcgttaggctggtatcagcagaaagcaacgggaaaccccctaagctcctgatctatggtcgcatcctactttaggtaacgtcggggtcccctgaaggttcaggcggcagtggatctagggacagtattcacttctcgcatcagcngcctgcganacgtgaagtnttttcgacttaactttagtttttacgacctaacgtacggtaccttaacccttacccttttccccctctaccgtttccgggacggtacgggtaacccgtagggtacggagtaactaccggtaagtaccgtaacgtggttacggtccgtacggcctaaccgtattccgttacgttccttaccc

SEQ ID NO: 157239 - DNA, 697 bp, Homo sapiens
  misc_feature: GYAE6OF02GDJ7R.19.57.F02.1.454.CMB.1.raw
  modified_base (372)..(372): a, c, t, g, unknown or other
  misc_feature (372)..(372): n is a, c, g, or t
tcagtactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatcgacccagtctcatcttccgtgtctgcatctggtaggagacagacgtcacctatctacgttggtcgggcgtagttcgaggtattagttaggcgtcttacgttaggctggtactcagtcaagaacgcgtaaccgggaaacccctagctctagatctagtgtagtctactcctagttacggaacgtccgggtccctagtaagtcaggccgngagtggacttgtaggaactagtactttccgacttccgtacgccctaatccgtacgccgtagttcccgtagaccaaggtaccttaggtaaacgtttccgttttacggaaccttttaaaccgtttttaggtttttaaccaacgttaaacccgtacgttaacccgtttaaacccttacccgtttttcccccgtaagttacccgttttaccgggaccggtaaccgggttaaccgtagggtacggtaacgtaccggttaacgtaaacggacccggttaacgttaccgggtcggttacctacggtaccctaacccgttagtccctttaccg

SEQ ID NO: 157240 - DNA, 708 bp, Homo sapiens
  misc_feature: GYAE6OF02FKQ60.19.57.F02.1.454.CMB.1.raw
  modified_base (201)..(201): a, c, t, g, unknown or other
  misc_feature (201)..(201): n is a, c, g, or t
tcagtactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtagganacagagtcaccatcacttggtcgggcgagtcaggatattaggcgctggttaggctggtatcatacagaagcaacggaacccctaagctctgatctagtggtgcacgtcctacgtttaggaacgttcggggtacccctacgtaacggttcgacggcggtactaggtggacgttacgtaggggtacgtaggttacttttccacgttccgtaccgcctaacgtccgtacggaccgtacgtcccgtacggaccgtaaggtaaccgttagggttaaacgttcgtttttaacgacctttaaaacgtttttcgttttttacgtaaccgtaaaccggtaacggttacccttaaacctttacccccgttttacccccgttacgtttaccgggtttaccgggaacggggtaccgggtaaccgtacgggttacgggaacgttaacgtaaccggtaaacggtaccggtaaacggttcggtacggtaccgtaccggacctaaccggtcttacgttaccgg

SEQ ID NO: 157241 - DNA, 796 bp, Homo sapiens
  misc_feature: GYAE6OF02H04XS.19.57.F02.1.454.CMB.1.raw
  modified_base (212)..(212): a, c, t, g, unknown or other
  misc_feature (212)..(212): n is a, c, g, or t
  modified_base (290)..(290): a, c, t, g, unknown or other
  misc_feature (290)..(290): n is a, c, g, or t
tcagtactctcgtgcacgaccggtgctcgatttagctcgatatagttgggtttggggcaggagtcagacccagtcaggacacagcatggacatgagggtccccgctcagctccgtggggctcctgctgctctggttcccaggttccagatgcgacatccagatcgacccagtcctccattccttccgtgtctgcatctagtaggagacgagngtccactatctacgttcggcggacgagtacgaaggtattaggttagggccgtacgttacggttagggcgttaggtacncgagacgtaaagaaacggaccggaaccgggtaaaacccccctaagtcccgttaccgtaagtacttcgtttaacgtcgggactacctacgttaccgttaaacggttttaaggaaaccggggtttcccgggttaccccttaaggtaaacgggttccgaacgggtcgggtacctaagggttacgggaacgtttacggaacggggtacctaaacggtttactttacccgtaaccgtccgtaccgacctaacgtaccgagacctaccgcacgtacgacgtaacgtagttaagtttaccgtttagttaactttaacgttttacgtttacgtaacgtaaacgttaacgtaccctttaaacccgttacccctttaccccgttacgtttaacccggtttcgggaaccgggttaacgggtaacgtagggtaacggtaacggtaacgtaaccggttacggaacggttaaccgttcggtacgtccgttaaccgaccgttacgttaccgttagttcccg

SEQ ID NO: 157242 - DNA, 808 bp, Homo sapiens
  misc_feature: GYAE6OF02FGJKJ.19.57.F02.1.454.CMB.1.raw
  modified_base (270)..(270): a, c, t, g, unknown or other
  misc_feature (270)..(270): n is a, c, g, or t
  modified_base (788)..(788): a, c, t, g, unknown or other
  misc_feature (788)..(788): n is a, c, g, or t
tcagtactctcgtgcacgaccggtgctcgatttagctcgatataggttggggtttggggggagtcagacccagtcaggacacagcatggacatgacgggtccccgctcagctcgtggggctcctgctgctctcggtccaggttccagatggcgacatccagatcgacccagtctccattccttccgtgtctgctatctgtaggagacagacgtccacatcctacgttcggcggcagtcaggtatagtaggcgtctcggtagtctggtacncagacgaagaacgaccgaacccgggtaaacccctagccttacctagtacttactaagtcggttacgacttaaccgtaccgtttaacggtttaacgggtaaaccgggtttccccgggggttacccctaacggggttaaccgggttccgaacgggtcccgggtacgtacggggtttacggaacgttccgggtaacggaacggttacgtttaacctttacccgacccggtttaccgcccggtaccctaacgtaccgacggtacccgaaccggtcccgtacgtacgtaaacggttaccgtaaacggtaaagtttttcgtttaaccgaacctttttaaacggttttacgtttaccgtaaacctaaacggttacccgttaacctttaaaccccttaccccggttttacccccgtaacggttaccgggttaccggggaaccgggtaaaccggtaaccggtaagggtcgggtaactacgaacggtaacgacggtacggttcggccgtacggacgtacctaccgttntaccgtttcgtaccttaccg

SEQ ID NO: 157243 - DNA, 556 bp, Homo sapiens
  misc_feature: GYAE6OF02GJJB1.19.57.F02.1.454.CMB.1.raw
  modified_base (468)..(468): a, c, t, g, unknown or other
  misc_feature (468)..(468): n is a, c, g, or t
tcagtactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaagcacggaacccctagctctgatcatggtcgcatcctacgtttggaaacgttcggggtcccctagtaacggttcaggcggatgtggatcgtaggactagtactttcactctcgcctatcacgcacgtccagcagactaggaatagtttcgacttaacttttgttttacgactaacgtaggtacctactaccctttcccctnttaccgttcggacggtacggtaaccgagggtagagtactacgaacggcgtaacgttggtacgcgtacggacctaccgtactgttaccg

SEQ ID NO: 157244 - DNA, 668 bp, Homo sapiens
  misc_feature: GYAE6OF02H16QX.19.57.F02.1.454.CMB.1.raw
  modified_base (106)..(106): a, c, t, g, unknown or other
  misc_feature (106)..(106): n is a, c, g, or t
  modified_base (185)..(185): a, c, t, g, unknown or other
  misc_feature (185)..(185): n is a, c, g, or t
  modified_base (432)..(432): a, c, t, g, unknown or other
  misc_feature (432)..(432): n is a, c, g, or t
tcagtactctcgtgcacgaccggtgctcgatttagctcgatatagttgggtttgggggcaggagtcagacccagtcaggacacagcatggacatgagggtccccgntcagctcctggggctcctgctgctctggttcccaggttccagatgcgacatccagatcgacccagtctccatcttccgngtctgactatcgtggtaggacgactagacgtccaaccattccacgtttggaccgggtacagtcgaaggtatagttaggacgcttcggttaaggcgttaggtactcgagcaagaaagccgaacggggaaacccccctaaaggcctaccgtgacgttacgtaagtcggtcgacctacgtaccttaggtttacggaaacgggttcgggtccctacgtagttcgagtggctagtgactcgaggtacagttntacgactctacgctagcgtagcagtccgtgacctagtactacggtaagtttctttagtacttacgtttatttcgtagtaacgtaacgttacgtaaaccttcccttaccccgttagttacccgttcggtaccgggtaacggtaccggtaacgggtcggtaacgtaacgtaccggtaacggtaccggtaaacgttcgggttacgtaccggtacgtaccgtacgttacgtcgtttaccg

SEQ ID NO: 157245 - DNA, 610 bp, Homo sapiens
  misc_feature: GYAE6OF02F0S2C.19.57.F02.1.454.CMB.1.raw
  modified_base (433)..(433): a, c, t, g, unknown or other
  misc_feature (433)..(433): n is a, c, g, or t
tcagtactctcgtgcacgaccggtgctcgatttagctcgatatagtttgggtttgggggcaggagtcagacccagtcaggacacagcatggacatgagggtccccgctcagctccgtggggctcctgctgctcgttcggttcccaggttccagatgcgacatccagatcgacccagtcctccactcctttccgtgtctgcatctggaggacgacagagtccaccatctacgttggtcgggacgagtcgaaggtattagttacggcgtcgttacggttaggcttggtatcaagacaagaacggacgaaccgggtaaacccctagtcctccgtagacttcgtagtcggtgctaactcgtaagttagggaacgtcgggtaccctagtagtcagtcgacgaggtgatcgaggatagtacttcacgtctcgactacancgactacgcctgatacggtataagttacgttatttagtacctttaattttagttttcgaactaacgtacgtaacctaaccttcccgttaccctacgttacggttcggacgggtagtaaccgtggtacgagtacgtacgacgtaccgtagttcggagttaccgacactacgtctctcg

SEQ ID NO: 157246 - DNA, 1032 bp, Homo sapiens
  misc_feature: GYAE6OF02HPNUJ.19.57.F02.1.454.CMB.1.raw
  modified_base (102)..(102): a, c, t, g, unknown or other
  misc_feature (102)..(102): n is a, c, g, or t
  modified_base (200)..(200): a, c, t, g, unknown or other
  misc_feature (200)..(200): n is a, c, g, or t
tcagtactctcgtgcacgaccggtgctcgatttagctcgatatagttgggtttgggggagtcagacccagtcaggacacagcatggacatgagggtccccgntcagctcctgggctcctgctgctctggttcccaggttccagatgcgacatccagatgacccagtctccatcttccgtgtctgcatctggtaggagacngagtccaaccatcacttcggtacgggcgagtcgtaggattacgtttaggccgtccgttcggttaggcttacggttatccgaacggacaacggaaaaggccgaaaccggggtaaacccccccttaaaggcccgtacccgttagtaaccgttcgttaagttcgggtacggtacctacgtttacccgtaaaccggtttttaggggaaaaccgggtttccggggggttacccccttaaccggtaaacggggtttaccgaacgggtcccgggtaccttaaggggttacgggtacgttaccgggttagggggtaaacctacgggttaaaccttttaccggaacccgtttcccgttacccgggtaccccttaagttacccgaaccggtaccccgtaacgggtaccccgttagggaaccgtaaacggttaacccgggtaacggttaaacggtttaacggtttttaaccggtaacccgttttaaacgggtttttttttaacgtttttaacccgggttaaacccttaaacccgggtaacgggttaaaccccgtttttaaaccccgtttaccccccgttttttaacccccccgtaaccgggtttttaaacccggtttttaccccgggggaacgggggttaaaaccggggttaaacccccgggttaaagggggttaaccggggttaaccggttaaaccgtttaaacccgggtaaacccgggttaaaccggggttaaacccggtttcgggggttaacccgggttaaccgttaccccgggtaaacccttaacccccggttaaccggtttaaccgggtttttcccgttaaaccccgttttaacccgg

SEQ ID NO: 157247 - DNA, 988 bp, Homo sapiens
  misc_feature: GYAE6OF02JL28T.19.57.F02.1.454.CMB.1.raw
tcagtactctcgtgcacgaccggtgctcgatttagctcgatatagttgggtttgggggagtcagacccagtcaggacacagcatggacatgagggtccccgctcagctcctgggctcctgctgctctggttcccaggttccagatgcgacatccagatcgacccagtctccatcttccgtgtctgcatctagtaggagacgagacgtcaaccatacacgttggtacgggacgagtaccgtaagggtaacttaagttacggaccgtcgttacgttacggcgttaggtaacgtacgtacgacgtaaaggtaaaacggaccgtaaaccggggtaaaacccccttaaggtacccgttacccgttaaggtaaccttacgttaacggttacgggtacgtacctaacgttaccgttaacggtttaacgggtaaaaccgggttccgggggttaaccccttaacgggttaaacgggttaccgtaacggggtacccgggtaacggtaacgggtttacgggtaacgttaccgggtaacgggaaacgttaacggttaacgttttacccgtaaccggttaccgtaacccgtacccgtaacgtaacccgttaacggtaacccgtaacgggtacccgttagggtaaaccgtaaacgggttaaaccggttaaacgggttaaaacggtttaaccggtttttaacggtaaaacccgtttttaaaacgttttaacggttttttaaccggaaaccgttaaaaccgggttaaaccgttaaccgtttaaaaccccgttaccccgtttttaacccccggtaaccgtttaaccgggtttaacccggggtaaaccgggggttaaaccggtaaaccgggttaaacgggttaccgggtaacgttaaccgttaacccgtaaacgggtacccgttaaacggtacgggttaacgtaccgtaacggttaacccgtaaaccggttaccgtttaaccggttaccgttaaccgttaacccgg

SEQ ID NO: 157248 - DNA, 720 bp, Homo sapiens
  misc_feature: GYAE6OF02FQC7C.19.57.F02.1.454.CMB.1.raw
  modified_base (517)..(517): a, c, t, g, unknown or other
  misc_feature (517)..(517): n is a, c, g, or t
tcagtactctcgtgcacgaccggtgctcgatttagctcgatatagttgggtttggggggagtcagacccagtcaggacacagcatggacatgagggtccccgctcagctcctggggctcctgctgctctggttcccaggttccagatgcgacatccagatgacccagtctcatcttccgtgtctgcatcgtgtaggagacagagtccaccatcctacttcggcgggcgtagtacgagggacttagttacggccgtcgttcggttaggcgttggtatacgtagacgtaacggaaaggaccgaaaccgggtaaacccctaacgtccctaccggttagacgttacgttaagtcgggtcgacgtaccgtacgttacgtttaagggtaaacgggttccggggtacccctaggtacggttacgacggaccggtacgtacggtggtacgtacgtagggtaccgtagtacgtttaccgacttccgtccgtacctactcgaatccgtacggtacctcgtacgaacncgtagtaacgtttgttacgtactttaacgttttactttacgtactaacggtacggttacctaaccgttacccctttaccccgtacgttaccgttaccgggtaaccggtacggtaaccggtaagggtcggactacggtacgtaacggcgttaacggtcggtacgtaccgtcgtacctacgtacgttccgttacggttctacccg

SEQ ID NO: 157249 - DNA, 755 bp, Homo sapiens
  misc_feature: GYAE6OF02IIC5N.19.57.F02.1.454.CMB.1.raw
  modified_base (103)..(103): a, c, t, g, unknown or other
  misc_feature (103)..(103): n is a, c, g, or t
  modified_base (144)..(144): a, c, t, g, unknown or other
  misc_feature (144)..(144): n is a, c, g, or t
  modified_base (150)..(150): a, c, t, g, unknown or other
  misc_feature (150)..(150): n is a, c, g, or t
  modified_base (698)..(698): a, c, t, g, unknown or other
  misc_feature (698)..(698): n is a, c, g, or t
tcagtactctcgtgcacgaccggtgctcgatttagctcgatatagttggggtttgggggagtcagacccagtcaggacacagcatggacatgagggtccccgntcagctcctgggctcctgctgctctggttccaggttccagntgcganatccagtatcgacctagtctaccagtccttcgtgtactgacattcgtagtaggagacgaggtactaccaacctattaccgtacgtttcgggacgggtaccgtagtacgaggtaacttagttacgggccgtcgttcggttaaggcgttagtaactcgacgacaaggaaacgtacgaaaccgggtaaaaccccctagtccctaccgttaggtacttcgtaggttcggtagtcctaacgttaccccgtaaggttttaacggggtaaccgggttcccgggggttaccccttacgggtaacggttccgaacgggtccggtagtacgggtagtaacgttcgggtaacgggtactaacgttacgtttacacccggttctcccggaacttaccgtcgaacggtccgtacgtacccgtagtaaccgagtaccgtaacgtaagtttacgtttactaacgtttaacgttttcgtttaacgacctaacgtacgtaaccttaacccttcccgttaccctcggttaacggtcgtaaccgggaactacggtaggtagacgtanacgtaacggtactaggtacgtacgcgttaccgctaaccgtcgtcgttcgtcttaccg

SEQ ID NO: 157250 - DNA, 800 bp, Homo sapiens
  misc_feature: GYAE6OF02JLRZX.19.57.F02.1.454.CMB.1.raw
  modified_base (225)..(225): a, c, t, g, unknown or other
  misc_feature (225)..(225): n is a, c, g, or t
  modified_base (741)..(741): a, c, t, g, unknown or other
  misc_feature (741)..(741): n is a, c, g, or t
tcagtactctcgtgcacgaccggtgctcgatttagctcgatatagttgggtttggggcaggagtcagacccagtcaggacacagcatggacatgagggtccccgctcagctcctggggctcctgctgctcgtcggttccctaggttcccagatgcgaccatacccgaggactcgaacccctagtcctacacttccgttccgtcgtctgacacttctggtaagganacgagagttccaccctaatcctacgttggtacgggccgtaaggtcgaaggtacttagtacggcgtcgtcggttaggtccgttggtactactacggaacgaggaaagaccgaaacccgggtaaacccccgtaacgcttaacccgcggtaactacgtaggtacgggttcgacgtaacttcccgttaaggttttacgggaaacggttcccggggtaccccttaaacgtaaggggttacccgtacggacggggtacccgtaaggttcggtaaccgtacgggttacgggaacggttacgttaccgtttccaccgtttcctacggacccgtaactcggaacccggtcgaccggtacctcggaacgttaacggtaacccgttaggttaaacgtttacttttaccggaaccttttaacgttttaacggtttccaaacgttaacgtacccggtttaaacacccgtttaaccctttccccgttacttaaccggttcgggaacggtacggtaaaccgaggttacggngtaaccgtaagaccgtaacgttacgaggttacggaccttgacccgattacgtccgtacg

SEQ ID NO: 157251 - DNA, 1032 bp, Homo sapiens
  misc_feature: GYAE6OF02FX4BY.19.57.F02.1.454.CMB.1.raw
  modified_base (105)..(105): a, c, t, g, unknown or other
  misc_feature (105)..(105): n is a, c, g, or t
tcagtactctcgtgcacgaccggtgctcgatttagctcgatatagttgggtttgggggcaggagtcagacccagtcaggacacagcatggacatgaggtccccgntcagctcctggggctcctgctgctctggttcccaggttccagatgcgacatccagatcgacccagtcctccattccttccgtgtctgacagttctaggtacggagacaggtaacgttccaacccgtattaccgtaccgttttcggggtaccgggtaccggagttacccgaagggtatttaacgttacgggtccggtacctttacgggtttaacgggccgtttagggttaactcccgaaaggtaccgtaaaggtaaaaccgccggtaaaaccggggtaaaaccccccccttaaaggtcccttaaccccgttaggtaacttacccgtaaggttacgggtccggaactaacccgtttacccgtaacggtttttaacggggaaaacgggttccccgggggttaccccccttaacggttaaacgggggttttccgaaccggggtacgggtacccgttaagggttacgggtaacgtttacgggtacgggggtaaaccttaagggtttaaccgtttttacccgaacccggttttccggtaaccgttaaccctaacggttaaccgtaaccggtacccggtaaaccggtcccggttaaacgtaaccccggtacgggttaaaccggttaacgggtttaaaacgttttaacggttttttaacccggttaaacgttttaaccccgtttttttaaagtttttttaaccggaaacgtttaaacccgggtttaaccggttaaccttttaaaaccgtttacccccccgttttttaccccgtaaccgttaacccggggtttttaaccgggacccgggtttaaccggggtaaccgtaaccgggggtttaccgaaggttaccggaaaccggttaaccggaaccgtttaacgggtccggttaaccgttcggtaacccgacccgtttaccacgtttaccgtttacggg

SEQ ID NO: 157252 - DNA, 800 bp, Homo sapiens
  misc_feature: GYAE6OF02GPZVP.19.57.F02.1.454.CMB.1.raw
  modified_base (150)..(150): a, c, t, g, unknown or other
  misc_feature (150)..(150): n is a, c, g, or t
  modified_base (176)..(176): a, c, t, g, unknown or other
  misc_feature (176)..(176): n is a, c, g, or t
tcagtactctcgtgcacgaccggtgctcgatttagctcgatataggttgggtttgggggcaggagtcagacccagtcaggacacagcatggacatgagggtccccgctcagcctcctggggctcctgctgctctgttcccaggttccagntgcgacatccagatcgacccagtccncctatccttcgtgtctgcatctagtaaggacgacagacgtccaaccatacctacttcggcgggacagtcgaaggatagttacggccgtcgtacggttacggtcgtacggttactacgaaggacaaaggaaaacggtaccgaaaccggggtaaaacccccccgttaagtacctccgtacgtaccttaacgtacggttggtacgtaccgtacgttaccgttaaacggtttacggggtaaaccgggttccggggttacccccttaacgtaacgggttcgaaccgggccgggtactacgggttacggaacgttccgggtagggaactacgtacgtttcctaacgtccgtacccgacctactacgtacgaccgtacggtccctacggaccgtaacgtaaccgtaaggtaacgtttaacgttacgtaaccgtttaaccgttttaagttttaccgaacccttaaacggttaacgttaaaccttaacccgtttacccctttaccccgtacgtttaacccggttacgggtaccggtaaacgggaaccggttacggtaggtaacgtccgtaaacgtaaccggtacgtaccgttaaggtacggacgtaccgaccctaacgtccgttcccgttacg

SEQ ID NO: 157253 - DNA, 668 bp, Homo sapiens
  misc_feature: GYAE6OF02FIHFD.19.57.F02.1.454.CMB.1.raw
  modified_base (207)..(207): a, c, t, g, unknown or other
  misc_feature (207)..(207): n is a, c, g, or t
tcagtactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgtacatccagatgacccagtctccatcttccgtgtctgcatctgtaggacacagngtacacctatcgtacttgtccgggacgagtcgaggtatagttacgcgctcgtagctggtatcagtacaagaacgtcaacggaacccctagcctctagatctagtgtacgctactccgtacttaggaacgtcgggtaccctagtaacggttcgacggtcgtacgacgtcgtacgtcgtgggtaacctacggtactttaccgacttaccgtaccgaccgtactacaacggcctacggtacctacgacgtaagtaaccgtagtaacggttactttacgtacccttaacgttttacgtttacgtaacgtaaacgtacgggtacccttaaaccgttaccctttaccccgtagttaccgtttaccgggacggtaacggacccgttaggacggtaacggtaacacgtaaccggtacgttaaccgtacggtacgtacgtaccggtaacctaccgtacgtccgttaaccg

SEQ ID NO: 157254 - DNA, 849 bp, Homo sapiens
  misc_feature: GYAE6OF02GWFFK.19.57.F02.1.454.CMB.1.raw
  modified_base (104)..(104): a, c, t, g, unknown or other
  misc_feature (104)..(104): n is a, c, g, or t
tcagtactctcgtgcacgaccggtgctcgatttagctcgatatagttgggtttgggggggagtcagacccagtcaggacacagcatggacatgagggtccccgntcagctccgtgggctcctgctgctctggttcccaggttccagagtgcgacactccgagactcgacccagtcctccattccgttccgtgtctgctatctaggtaggagacagcgtacaccatcctagttcggcgggcaggtcaggtattagttacggccgtcgttcggttacggcgttcggtatacgaggacaaggaaacgaccggaacccggggaaaaccccctagtcccgtactacgtaactcgttaggtcggtacgcctaacttacccgtaacggttttaacggggaaaccgggtttcccggggtacccccgttaaggtaaccggttacggaacgggtccggaacgtggggtacgtaacgttacggtacgggaacctaaggttacctttacccgaccgtttaccctccggtaaccctagtacccggtacggtacccacgggtcccgttacggaaccgttaacgggtaaccgttaacggttaaacgtttcgtttttaaccgtaaccttttaaacgtttttactttttaccgggaaaccttaaaccggttaccggtttaacccttaaccccgttttaccccgttttccccgttaacgtttaacccggggtttccgggaacccgggttaaaccggaacgggttaacgggtagaacgtaccgtaacggaaacgttaccgggtaacgttccggtacggttcgacccgtaccgtttaccgagttttaccggttcttaccgtttaacccg

SEQ ID NO: 157255 - DNA, 694 bp, Homo sapiens
  misc_feature: GYAE6OF02HBFQC.19.57.F02.1.454.CMB.1.raw
tcagtactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctaggtaggagacagagtcacatcacgttggcgggacgagtcagatagtaggcgcgttcggtaggctaggtatcagacgaagaaacgacgaaccgggaaaccccctagcctacctaggacttacgtagtggtacgacaacttccgtaacgtttagggaaacggttcgggtcccctaacgtaacggttcgacggtcggacgtagtacggtacttacggtacggtaacgtaagttactttacctaccgttccgtaccgtccctaacgttaccgaaacggtccgaaccggtccgttaacgacgtaacgaaccgttaaggtaaacgtttacgttttacgaacctttaaacgtttttgtttaccgaacgtaaacgtacggtaccttaacccttaccctttccccgtaagttaccggtacggacgggtaacggtacgtaagggtcgtaagtcgtaacgaaggtaccgtaacgttggtaccggtacacgtacctacgtactacgttccg

SEQ ID NO: 157256 - DNA, 652 bp, Homo sapiens
  misc_feature: GYAE6OF02I8TQS.19.57.F02.1.454.CMB.1.raw
  modified_base (380)..(380): a, c, t, g, unknown or other
  misc_feature (380)..(380): n is a, c, g, or t
tcagtactctcgtgcacgaccggtgctcgatttagctcgatatagttgggtttgggggggaggtcagacccagtcaggacaacagcatggacatgagggtccccgctcagctccgtggggctcctgctgctctggttcccaggttccagatgcgacactccagtatcgacccagtcctccactcttccgtgtctgcatctgaacgggagacagagtccaacctagtccactttggccggggacgagttccagggattagttacgggcgctcggttaggcgtggtactcgaagcaaggaaacgcgaaccgggaaaccccctagcctcctagtactctagtggtcgctatccgtacgtttacggaacggttcgggtacccgngttccgaacggttcggacgacggtcggaacgtcgtaggtacctagggaacttagactttcacgtccctacgtcccaagtcctaaggccctaaggtcctaggacctaggtaacgtacgttaagtactttacgtactttacgtactttacgtacgtacctaacgtacttacccgtcttaccctcgtacgttcggtaccgaagggtacgtaggtacgtacgtagtacgtccgtagacgtacgtggacctaccgtacgtactcgttactcgttacg

SEQ ID NO: 157257 - DNA, 666 bp, Homo sapiens
  misc_feature: GYAE6OF02F7KG8.19.57.F02.1.454.CMB.1.raw
  modified_base (102)..(102): a, c, t, g, unknown or other
  misc_feature (102)..(102): n is a, c, g, or t
  modified_base (200)..(200): a, c, t, g, unknown or other
  misc_feature (200)..(200): n is a, c, g, or t
  modified_base (308)..(308): a, c, t, g, unknown or other
  misc_feature (308)..(308): n is a, c, g, or t
tcagtactctcgtgcacgaccggtgctcgatttagctcgatatagttgggtttgggggagtcagacccagtcaggacacagcatggacatgagggtccccgntcagctcctggggctcctgctgctctggttcccaggttccagatgcgacatccagatgacccagtctccatccgttccgtgtctgctatctgtagganacagagtcacatcacttggcgggcagtcgaggtattagttaggcgcttcgtaggctaggtatcagcaagaagcgaacggaaacccctagctctgactacgtagtggcnctactcctacgttaggaacggtcgggtaccctagtaacggttcgaggcggtacgtaggtacgacgttacggtagggaactacgtaactttcgacttccgtacgaccctagtacgacgacgacgtccgtacgacgtaacgtaacgtaggtaacgtttaacgtttcgaaacctttaacgttttattttaacggaaccgtaaacgtaacgttaccgttaaaccttccccgttttacccctaacgttaccgggtttaccggaacggtaaaccggtaaccggtaaaggtcggtacgtaaccgtacgaacggtaccgtaacggtggtacgacgttacgctaacgtcgtcgtttacgcctttacg

SEQ ID NO: 157258 - DNA, 726 bp, Homo sapiens
  misc_feature: GYAE6OF02GAF4S.19.57.F02.1.454.CMB.1.raw
  modified_base (188)..(188): a, c, t, g, unknown or other
  misc_feature (188)..(188): n is a, c, g, or t
  modified_base (191)..(191): a, c, t, g, unknown or other
  misc_feature (191)..(191): n is a, c, g, or t
  modified_base (534)..(534): a, c, t, g, unknown or other
  misc_feature (534)..(534): n is a, c, g, or t
  modified_base (701)..(701): a, c, t, g, unknown or other
  misc_feature (701)..(701): n is a, c, g, or t
tcagtactctcgtgcacgaccggtgctcgatttagctcgatatagttgggtttgggggcaggagtcagacccagtcaggacacagcatggacatgagggtccccgctcagctcctggggctcctgctgctcgtcggttccaggttccagatgcgacagtccagatcgaccagtctccatcgttccgtntcngctatcgtagtaggagacgagactccacctatccgtacgtcggtacgggacgacggtacgaaggtaataacgttaggccgtacgttcggttacggtcgtaggtactacgacggacgtaaacggaaacggacccggtaaaccggtaaaacccccgttaaggtacccttaccgtagtaacttacggttacggttcgggtacgacctaacgttaccgtacgtttaacggggtaacggttcccggggttaccctacggtaacggttcgacggtcgtagtacggtaggtacgtcggtaaggtacgactttacgtacctaccgtacgtccgactagtcacgtccgtacncgtacacgacgtacgtagtaacgttagttccaagtttaacttttcgtaactacgtaccgacgtacttaccgttcccgttaacccttacggttaccgttacccgggacggtaacggttactaacgggtcgtaacgtacggaactaacgggtccgtaaggttcgaacgngtacctacaaccgttacttcgtacg

SEQ ID NO: 157259 - DNA, 738 bp, Homo sapiens
  misc_feature: GYAE6OF02HWZ3B.19.57.F02.1.454.CMB.1.raw
  modified_base (105)..(105): a, c, t, g, unknown or other
  misc_feature (105)..(105): n is a, c, g, or t
  modified_base (189)..(189): a, c, t, g, unknown or other
  misc_feature (189)..(189): n is a, c, g, or t
  modified_base (223)..(223): a, c, t, g, unknown or other
  misc_feature (223)..(223): n is a, c, g, or t
  modified_base (718)..(718): a, c, t, g, unknown or other
  misc_feature (718)..(718): n is a, c, g, or t
tcagtactctcgtgcacgaccggtgctcgatttagctcgatatagttgggtttgggggcaggagtcagacccagtcaggacacagcatggacatgagggtccccnctcagctcctgggctcctgctgctctggttcccaggtcagatgcgacactccagactcgacccgagtcctcctattccttcgtntctgccatcgtggtaggacgacagcgtccacctntcctacggttggtccgggatacggtcgaaggtattaacggttggcctacgttgggttacgcgttggtactacgacgacgaagaacgaccggtaaccggtaaacccctaggtccttaccgtaggtaaccttcgtttacgtacgggtctaccgtacgttaccgttacggtttaacgggaaccgggttcccgggtttaccctaaggttaaacgggtcgaccgggtaccgtacgtacggttccgtaggttacccggtacgggtacttaacgttcttacccgtacgttccggttccaaccgttaacccgggttaccgcgtaacgttccgaacgttagacggtacttaaggtacgttttacttacgttaaccgttattttacgtaccgataacggacccttaacgtaccgtttcccttacccggtattacccgggtagaaccgggttaccgtagtacgggtcgtaaactcgaacggtactcccgttaggcgttaaggcccngtacctacgttactcgttac

SEQ ID NO: 157260 - DNA, 512 bp, Homo sapiens
  misc_feature: GYAE6OF02IJ3UO.19.57.F02.1.454.CMB.1.raw
  modified_base (205)..(205): a, c, t, g, unknown or other
  misc_feature (205)..(205): n is a, c, g, or t
  modified_base (227)..(227): a, c, t, g, unknown or other
  misc_feature (227)..(227): n is a, c, g, or t
  modified_base (294)..(294): a, c, t, g, unknown or other
  misc_feature (294)..(294): n is a, c, g, or t
  modified_base (296)..(296): a, c, t, g, unknown or other
  misc_feature (296)..(296): n is a, c, g, or t
  modified_base (302)..(302): a, c, t, g, unknown or other
  misc_feature (302)..(302): n is a, c, g, or t
  modified_base (326)..(326): a, c, t, g, unknown or other
  misc_feature (326)..(326): n is a, c, g, or t
  modified_base (434)..(434): a, c, t, g, unknown or other
  misc_feature (434)..(434): n is a, c, g, or t
  modified_base (509)..(509): a, c, t, g, unknown or other
  misc_feature (509)..(509): n is a, c, g, or t
tcagtactctcgtgcacgaccggtgctcgatttagctcgatatagttgggtttgggggcaggagtcagacccagtcaggacacagcatggacatgagggtccccgctcagctcctggggctcctgctgctctggttccccaggttccagatgcgacatccagatgacccagtctccatcttccgtgtctgcatctgtaggagacngagtcaccatcacttgtcgggnagtcaggatattaggcgctcgtaggctggtatcagcagaaagcaagggaaccccctaagcctcctgntntatggncatccattggaaagtgggcccctnaaggttcagcggcagtggatcgtacgggacagatttccacgtactcgcatcagcagcctgcagactgaagatttgacaactttattttagtcaaactggacttaaccnccttttcccctctaccgtttcggccggtagggaccaggtggagattacagacgatcggtaggctagccacctgtntcg

SEQ ID NO: 157261 - DNA, 768 bp, Homo sapiens
  misc_feature: GYAE6OF02I5UK1.19.57.F02.1.454.CMB.1.raw
  modified_base (177)..(177): a, c, t, g, unknown or other
  misc_feature (177)..(177): n is a, c, g, or t
  modified_base (185)..(185): a, c, t, g, unknown or other
  misc_feature (185)..(185): n is a, c, g, or t
tcagtactctcgtgcacgaccggtgctcgatttagctcgatataggttggggtttgggggcaggagtcagacccagtcaggacacagcatggacatggacgggtccccgctcagcctccgtggggctcctgctgctctcggttcccaggttccagatgacgacatccagatcgaccngtcctccnttccgttccgtgtctgctagttcgtaggtaggacgacaggactcaccactcgtacgttcgggacggtacgtagtacgaggtattaggtcggtcgtcgttcggttacggcgttaggtactagacgacgaacggaacgaccggaaacccggaaacccctagccgtaccgtgtacgttctaggtcgtcgtacgttaccgtaaccggttacggttacgggtaacggttcccggggtaccctacggttaacggttaccggacggcgggtacgtacgggtacggtacgtacgggtacggtacgtaacggttctttaccgtaccttccgccgtaaccgtacgtacgaaccggtccgtacgtccggtacgctaaacggtaccgtttaggtaacgtttactttacggttaacctttaagttttacttaccgaacgtaacgttacccgtacctttacccttacccggttttaccccgttacggtacccggttacggggaaccgggtaccggtaacggttaggcggaaccgttacgtaacggactaaccgggttacgttacgccggttcaaccgacgtactcggttaccttacg

SEQ ID NO: 157262 - DNA, 814 bp, Homo sapiens
  misc_feature: GYAE6OF02IULBW.19.57.F02.1.454.CMB.1.raw
tcagtactctcgtgcacgaccggtgctcgatttagctcgatatagttgggtttgggggcaggagtcagaccccagtcaggacacagcatggacatgagggtccccgctcagctccgtggggctcctgctgctctggttcccaggttccagatgcgacatccagtatcgaccctagtctccattccttccgtgtctgactatctagtaggacgaacagtacgtaccacctatctacgttacggtccgggacgtacgtacgaacggtattagtacggccgtcgttacggttaggaccgttaggtactaccgacgaccgaaaggtaaacggaccggtaaacccgggtaaaacccccgtagtacccgttaccgtacggtaacttacgtacggttacggtcgtacctaacgttccgttaacgtttaacgggtaaaccgggttcccgggtaacccccttagtaaaccgggttaccgaacggtaccgggtacgttacggttcgggtaaccgttacggtacgggtaactaacgttacgtttacccgtacgttcccgttaccgtaacccttagacccggtacgtacccgtcgtaccggtaccgaacgtaccggtacgttaacggtaaagtttcgttttaccgtaacccgtttaaagtttttaccgtttaacgtaccgtaacgttacccggttaacccttaaaccgtttcccctttacccgtactttaaccggttccgggaaccgggtaaccgtaccggtaagggtcgtaacgtcgttaacgaacgtcgtaacgtgactccgagtcctacgtacgttcgtaccg

SEQ ID NO: 157263 - DNA, 744 bp, Homo sapiens
  misc_feature: GYAE6OF02ITUXJ.19.57.F02.1.454.CMB.1.raw
tcagtactctcgtgcacgaccggtgctcgatttagctcgatatagttggggtttgggggcaggagtcagacccagtcaggacacagcatggacatgagggtccccgctcagctcctggggctcctgctgctctggttcccaggttccagatgcgacatccagatgaacccagtcctccattcttccgtgtctgcatcgtggtaggagacagacgtccaacctagtctacgtttcggccgggacgagtaccgagggtattagttacggccgtcgttacggttaacggcttagggtattcgaacgacgaaaggaaacggtaccgaaccggggtaaaaccccctaagccttaccgtgaacgtttcctaagtgggtacgcctaacgttaccctaacggttttacgggaaaggttcccgggttacccctaggtaacgttcgacggaccggtacgtaggtcggaacgttcggtacgggaatacgtactttcgactccgtccgactatccgagcgtacgtcgtcgaacgtaccgtagtaacggtaacgttttactttcgtaaacttttaaacgtttttgtttaaccgggtacctaaacggttaaccggttaacctttaaaccccgttttaccccgttacccccttacgttaaaccggttccgggaaccggtaacgggtaccgtagggtaccgtagacgtacgtaacggacgtaacggttgtacggcttacggaccacgttactcgttacgg

SEQ ID NO: 157264 - DNA, 627 bp, Homo sapiens
  misc_feature: GYAE6OF02JICLR.19.57.F02.1.454.CMB.1.raw
  modified_base (580)..(580): a, c, t, g, unknown or other
  misc_feature (580)..(580): n is a, c, g, or t
  modified_base (619)..(619): a, c, t, g, unknown or other
  misc_feature (619)..(619): n is a, c, g, or t
tcagtactctcgtgcacgaccggtgctcgatttagctcgatatagttgggtttggggggagtcagacccagtcaggacacagcatggacatgagggtccccgctcagctcctggggctcctgctgctctggttcccaggttccagatgcgacatccagactgacccagtctccatcttcgtgtctgcatctgtaggagacagagtcaccatcacttgtcgggcgagtcaggtatattaggcgctcgttaggctggtatcagctagaaacgcgaagggaaaccccctaagctccgtgactctaagtaggtcgctacttaccgaacgtttggaaacggttcggggtacccctacgtaacggtttcaggcggacgtaggtgtactcgagggtacaacgtatttaccaccttcgtaccggtacctacgtactacggtccaacgtccctacgtcgaacgttacgtagtaaacgttattttcggactttaaccgtttagttttcgtaacgaactacggaacttaaccttacccgtttacccctacgtaccgttcgggacgaacggtaaccgtagtcggagttacgngtaacgcggtaatcggtagtactcgactacgtcctcgtntccgttac

SEQ ID NO: 157265 - DNA, 864 bp, Homo sapiens
  misc_feature: GYAE6OF02GFLGV.19.57.F02.1.454.CMB.1.raw
  modified_base (181)..(181): a, c, t, g, unknown or other
  misc_feature (181)..(181): n is a, c, g, or t
tcagtactctcgtgcacgaccggtgctcgatttagctcgatatagttgggtttggggggagtcagacccagtcaggacacagcatggacatgagggtccccgctcagctcctggggctcctgctgctctggttcccaggttccagatgcgacatccagatacaccatctccatcttccgtntctgcatctgtaggacgacagacgtacacctatctacgttcgggtccgggcgtacgtacgaggtacttacgttacggcgtccgttacggttacggcgttggtatacgaaggtaccgaagtaaaacggaccggtaaccccggggtaaaaccccctaggtacccttccgtagtactccgttaaggtcggtacgtactaaccttaccgttacggtttaagggaaacgggttcccggggttacccctaacggtaacggttccggacggtaccggtaggtacggtacggtacgttcggtacgggtaactaaggttactttacccacgtttaccgtacccgtactaccgtacgtaccgaccgttaacccggcccgttaaggtaccttaacgggtaaccggtttaacggtttaaccggtttaaacgtttttacccgaaccgtttttttaaaccgttttttaggttttaaaccctaaccgggttaaaaccgtcccggtttaaacccgtttaacccttttaaccccgtttccccccgtaaaggtttccggggtttaaccccgggaacgggtaaacccggtaacggttaacggggtaccggtaggtaacgtaaccgaacgggttaccgttaaaggtcggtcggtacccgtacggtaaccctggtaccctttccggttaccttcgttaaccccg

SEQ ID NO: 157266 - DNA, 248 bp, Homo sapiens
  misc_feature: GYAE6OF01DIXCW.34.27.C05.1.454.CMB.1.raw
  modified_base (244)..(248): a, c, t, g, unknown or other
  misc_feature (244)..(248): n is a, c, g, or t
tcagtacacgtgatcacgaccggtgctcgatttagacgcgatcgaagggtttggggtgtggtggtctccactcccgccttgacgaggctgattattactgctgctcatgtgcaagtctcaccactgtgactttcggcggagggaccaagttgaccgtcctcagtcagcccaaggctgccccctcggtcactctgttcccaccctcctcatcacgtgtactgagcgggctggcaaggcgcatagnnnnn

SEQ ID NO: 157267 - DNA, 257 bp, Homo sapiens
  misc_feature: GYAE6OF01EFET2.34.27.C05.1.454.CMB.1.raw
  modified_base (247)..(257): a, c, t, g, unknown or other
  misc_feature (247)..(257): n is a, c, g, or t
tcagtacacgtgatcacgaccggtgctcgatttagacgcgatcgaagggtttgggggtggtggtggtctccactcccgccttgacgaggctgattattactgctgctcatgtgcaagtctcaccactgtcgactttcggcggagggaccaagttgaccgtcctcagtcagcccaaggctgccccctcggtcactctgttcccgccctcctcatcacgtgtactgagcgggctggcaaggcgcatagnnnnnnnnnnn

SEQ ID NO: 157268 - DNA, 259 bp, Homo sapiens
  misc_feature: GYAE6OF01AR3I1.34.27.C05.1.454.CMB.1.raw
  modified_base (245)..(259): a, c, t, g, unknown or other
  misc_feature (245)..(259): n is a, c, g, or t
tcagtacacgtgatcacgaccggtgctcgatttagacgcgatcgaagggtttggggtgtggtggtctccactcccgccttgacgaggctgattattacctgctgctcatgtgcaagtctcaccactgtgactttcggcggagggaccaagttgaccgtcctcagtcagcccaaggctgccccctcggtcactctgttcccaccctcctcatcacgtgtactgagcgggctggcaaggcgcatagnnnnnnnnnnnnnnn

SEQ ID NO: 157269 - DNA, 246 bp, Homo sapiens
  misc_feature: GYAE6OF01AGXP7.34.27.C05.1.454.CMB.1.raw
  modified_base (245)..(246): a, c, t, g, unknown or other
  misc_feature (245)..(246): n is a, c, g, or t
tcagtacacgtgatcacgaccggtgctcgatttagacgcgatcgaagggtttgggggtgtggtggtctccactcccgccttgacgaggctgattattactgctgctcatgtgcaagtctcaccactgtgactttcggcggagggaccaagttgaccgtcctcagtcagcccaaggctgccccctcggtcactctgttcccaccctcctcatcacgtgtactgagcgggctggcaaggcgcatagnn

SEQ ID NO: 157270 - DNA, 297 bp, Homo sapiens
  misc_feature: GYAE6OF01EW3ON.34.27.C05.1.454.CMB.1.raw
  modified_base (247)..(247): a, c, t, g, unknown or other
  misc_feature (247)..(247): n is a, c, g, or t
  modified_base (253)..(297): a, c, t, g, unknown or other
  misc_feature (253)..(297): n is a, c, g, or t
tcagtacacgtgatcacgaccggtgctcgatttagacgcgatcgaaggggtttgggggtgtgggtggtctccactcccgccgttgacgaggctgattattactgcctgctcactgtgcaagtctcaccactgtgactttcggcggagggaccaagttgaccgtcctcagtcagccccaaggctgccccctggtccactctgttcccaccctcctcatcacgttgtactgagcgggactggcaaggcncatagnnnnnnnnnnnnnnnnnnnnnnnnnnnnnnnnnnnnnnnnnnnnn

SEQ ID NO: 157271 - DNA, 247 bp, Homo sapiens
  misc_feature: GYAE6OF01CDIY7.34.27.C05.1.454.CMB.1.raw
  modified_base (245)..(247): a, c, t, g, unknown or other
  misc_feature (245)..(247): n is a, c, g, or t
tcagtacacgtgatcacgaccggtgctcgatttagacgcgatcgaagggtttgggggtgtggtggtctccactcccgccttgacgaggctgattattactgctgctcatgtgcaagtctcaccactgtgactttcggcggagggaccaagttgaccgtcctcagtcagcccaaggctgccccctcggtcactctgttcccgccctcctcatcacgtgtactgagcgggctggcaaggcgcatagnnn

SEQ ID NO: 157272 - DNA, 327 bp, Homo sapiens
  misc_feature: GYAE6OF01C222Z.34.27.C05.1.454.CMB.1.raw
  modified_base (263)..(277): a, c, t, g, unknown or other
  misc_feature (263)..(277): n is a, c, g, or t
  modified_base (279)..(327): a, c, t, g, unknown or other
  misc_feature (279)..(327): n is a, c, g, or t
tcagtacacgtgatcacgaccggtgctcgatttagacgcgatcgaaggggtttgggggtgtgggtggtctccaactcccgccgttgacgaggctgattattactgcctgctcactgtgcaagtctcaccactgtgactttcggcgaggaccaagttgaccgtctcagtcacgcccaagggctgccccctggtccacgtctggttcccaccctccgtcatccacggttgtactgaagtcggggactggcaagggcgcagtacgnnnnnnnnnnnnnnnannnnnnnnnnnnnnnnnnnnnnnnnnnnnnnnnnnnnnnnnnnnnnnnn

SEQ ID NO: 157273 - DNA, 257 bp, Homo sapiens
  misc_feature: GYAE6OF01B5ZQX.34.27.C05.1.454.CMB.1.raw
  modified_base (246)..(257): a, c, t, g, unknown or other
  misc_feature (246)..(257): n is a, c, g, or t
tcagtacacgtgatcacgaccggtgctcgatttagacgcgatcgaagggtttgggggtgtggtgggtctccactcccgccttgacgaggctgattattactgctgctcatgtgcaagtctcaccactgtgactttcggcggagggaccaagttgaccgtcctcagtcagcccaaggctgccccctcggtcactctgttcccaccctcctcatcacgtgtactgagcgggctggcaaggcgcatagnnnnnnnnnnnn

SEQ ID NO: 157274 - DNA, 248 bp, Homo sapiens
  misc_feature: GYAE6OF01D6MHJ.34.27.C05.1.454.CMB.1.raw
  modified_base (245)..(248): a, c, t, g, unknown or other
  misc_feature (245)..(248): n is a, c, g, or t
tcagtacacgtgatcacgaccggtgctcgatttagacgcgatcgaagggtttgggggtgtggtggtctccactcccgccttgacgaggctgattattactgctgctcatgtgcaagtctcaccactgtgactttcggcggagggaccaagttgaccgtcctcagtcagcccaaggctgccccctcggtcactctgttcccgccctcctcatcacgtgtactgagcgggctggcaaggcgcatagnnnn

SEQ ID NO: 157275 - DNA, 246 bp, Homo sapiens; identical to SEQ ID NO: 157269
  misc_feature: GYAE6OF01CL0DP.34.27.C05.1.454.CMB.1.raw
  modified_base (245)..(246): a, c, t, g, unknown or other
  misc_feature (245)..(246): n is a, c, g, or t

SEQ ID NO: 157276 - DNA, 258 bp, Homo sapiens
  misc_feature: GYAE6OF01DZTFR.34.27.C05.1.454.CMB.1.raw
  modified_base (244)..(258): a, c, t, g, unknown or other
  misc_feature (244)..(258): n is a, c, g, or t
tcagtacacgtgatcacgaccggtgctcgatttagacgcgatcgaagggtttggggggtgtggtggtctccactcccgccttgacgaggctgattattactgctgctcatgtgcaagtctcaccactgtgactttcggcggagggaccaagttgaccgtcctcagtcagcccaaggctgccccctggtcactctgttcccgcctcctcatcacgtgtactgagcgggctggcaaggcgcatagnnnnnnnnnnnnnnn

SEQ ID NO: 157277 - DNA, 247 bp, Homo sapiens
  misc_feature: GYAE6OF01EF34J.34.27.C05.1.454.CMB.1.raw
  modified_base (245)..(247): a, c, t, g, unknown or other
  misc_feature (245)..(247): n is a, c, g, or t
tcagtacacgtgatcacgaccggtgctcgatttagacgcgatcgaagggtttgggggtgtggtggtctccactcccgccttgacgaggctgattattactgctgctcatgtgcaagtctcaccactgtgactttcggcggagggaccaagttgaccgtcctcagtcagcccaaggctgccccctcggtcactctgttcccaccctcctcatcacgtgtactgagcgggctggcaaggcgcatagnnn

SEQ ID NO: 157278 - DNA, 247 bp, Homo sapiens; identical to SEQ ID NO: 157271
  misc_feature: GYAE6OF01B9SGQ.34.27.C05.1.454.CMB.1.raw
  modified_base (245)..(247): a, c, t, g, unknown or other
  misc_feature (245)..(247): n is a, c, g, or t

SEQ ID NO: 157279 - DNA, 246 bp, Homo sapiens
  misc_feature: GYAE6OF01DDNP3.34.27.C05.1.454.CMB.1.raw
  modified_base (245)..(246): a, c, t, g, unknown or other
  misc_feature (245)..(246): n is a, c, g, or t
tcagtacacgtgatcacgaccggtgctcgatttagacgcgatcgaagggtttgggggtgtggtggtctccactcccgccttgacgaggctgattattactgctgctcatgtgcaagtctcaccactgtgactttcggcggagggaccaagttgaccgtcctcagtcagcccaaggctgccccctcggtcactctgttcccaccctccttatcacgtgtactgagcgggctggcaaggcgcatagnn

SEQ ID NO: 157280 - DNA, 248 bp, Homo sapiens; identical to SEQ ID NO: 157274
  misc_feature: GYAE6OF01AZDJY.34.27.C05.1.454.CMB.1.raw
  modified_base (245)..(248): a, c, t, g, unknown or other
  misc_feature (245)..(248): n is a, c, g, or t

SEQ ID NO: 157281 - DNA, 248 bp, Homo sapiens
  misc_feature: GYAE6OF01B2IX2.34.27.C05.1.454.CMB.1.raw
  modified_base (244)..(248): a, c, t, g, unknown or other
  misc_feature (244)..(248): n is a, c, g, or t
tcagtacacgtgatcacgaccggtgctcgatttagacgcgatcgaagggtttgggggtgtggtggtctccactcccgccttgacgaggctgattattactgctgctcatgtgcaagtctcaccactgtgactttcggcggagggaccaagttgaccgtcctcagtcagcccaaggctgccccctcggtcactctgttcccacctcctcatcacgtgtactgagcgggctggcaaggcgcatagnnnnn

SEQ ID NO: 157282 - DNA, 247 bp, Homo sapiens; identical to SEQ ID NO: 157271
  misc_feature: GYAE6OF01A25BJ.34.27.C05.1.454.CMB.1.raw
  modified_base (245)..(247): a, c, t, g, unknown or other
  misc_feature (245)..(247): n is a, c, g, or t

SEQ ID NO: 157283 - DNA, 271 bp, Homo sapiens
  misc_feature: GYAE6OF01AILFW.34.27.C05.1.454.CMB.1.raw
  modified_base (250)..(271): a, c, t, g, unknown or other
  misc_feature (250)..(271): n is a, c, g, or t
tcagtacacgtgatcacgaccggtgctcgatttagacgcgatcgaagggtttggggggtggtggtggtctcccactcccgccttgacgaggctgattattactgctcgctcatgtgcgaagtctcaccactgtgactttcggccggagggaccaagttgaccgtcctcagtcagcccaaggctgccccctcggtcactctgttcccgccctcctcatcacgtgtactgagcgggctggcaggcgcatagnnnnnnnnnnnnnnnnnnnnnn

SEQ ID NO: 157284 - DNA, 250 bp, Homo sapiens
  misc_feature: GYAE6OF01C1LMS.34.27.C05.1.454.CMB.1.raw
  modified_base (245)..(250): a, c, t, g, unknown or other
  misc_feature (245)..(250): n is a, c, g, or t
tcagtacacgtgatcacgaccggtgctcgatttagacgcgatcgaagggtttgggggtgtggtggtctccactcccgccttgacgaggctgattattactgctgctcatgtgcaagtctcaccactgtgactttcggcggagggaccaagttgaccgtcctcagtcagcccaaggctgccccctcggtcactctgttcccaccctcctcatcacgtgtactgagcgggctggcaaggcgcatagnnnnnn

SEQ ID NO: 157285 - DNA, 245 bp, Homo sapiens
  misc_feature: GYAE6OF01AZTL4.34.27.C05.1.454.CMB.1.raw
  modified_base (245)..(245): a, c, t, g, unknown or other
  misc_feature (245)..(245): n is a, c, g, or t
tcagtacacgtgatcacgaccggtgctcgatttagacgcgatcgaagggtttgggggtgtggtggtctccactcccgccttgacgaggctgattattactgctgctcatgtgcaagtctcaccactgtgactttcggcggagggaccaagttgaccgtcctcagtcagcccaaggctgccccctcggtcactctgttcccaccctcctcatcacgtgtactgagcgggctggcaaggcgcatagn

SEQ ID NO: 157286 - DNA, 273 bp, Homo sapiens
  misc_feature: GYAE6OF01B3DG4.34.27.C05.1.454.CMB.1.raw
  modified_base (250)..(273): a, c, t, g, unknown or other
  misc_feature (250)..(273): n is a, c, g, or t
tcagtacacgtgatcacgaccggtgctcgatttagacgcgatcgaaggggtttggggggtgtggtggtctccactcccgccttgacgaggctgattattactgctgctcatgtgcaagtctcaccactgtgactttcggcggagggaccaaggttgaccgtcctcagtcagcccaaggctcgccccctcggtcactctcgttcccgcctcctcactcacgtgtactgagcgggctggcaaggcgcatagnnnnnnnnnnnnnnnnnnnnnnnn

SEQ ID NO: 157287 - DNA, 261 bp, Homo sapiens
  misc_feature: GYAE6OF01A4G06.34.27.C05.1.454.CMB.1.raw
  modified_base (246)..(261): a, c, t, g, unknown or other
  misc_feature (246)..(261): n is a, c, g, or t
tcagtacacgtgatcacgaccggtgctcgatttagacgcgatcgaagggtttggggggtgtggtggtctccactcccgccttgacgaggctgattattactgctgctcatgtgcaagtctcaccactgtgactttcggcggagggaccaagttgaccgtcctcagtcagcccaaggctgccccctcggtcactctgttcccgccctcctcatcacgtgtactgagcgggctggcaaggcgcatagnnnnnnnnnnnnnnnn

SEQ ID NO: 157288 - DNA, 246 bp, Homo sapiens
  misc_feature: GYAE6OF01D5TXQ.34.27.C05.1.454.CMB.1.raw
  modified_base (245)..(246): a, c, t, g, unknown or other
  misc_feature (245)..(246): n is a, c, g, or t
tcagtacacgtgatcacgaccggtgctcgatttagacgcgatcgaagggtttgggggtgtggtggtctccactcccgccttgacgaggctgattattactgctgctcatgtgcaagtctcaccactgtgactttcggcggagggaccaaactgaccgtcctgagtcagcccaaggctgccccctcggtcactctgttcccaccctcctcatcacgtgtactgagcgggctggcaaggcgcatagnn

SEQ ID NO: 157289 - DNA, 250 bp, Homo sapiens
  misc_feature: GYAE6OF01CBYQY.34.27.C05.1.454.CMB.1.raw
  modified_base (246)..(250): a, c, t, g, unknown or other
  misc_feature (246)..(250): n is a, c, g, or t
tcagtacacgtgatcacgaccggtgctcgatttagacgcgatcgaagggtttggggggtgtggtggtctccactcccgccttgacgaggctgattattactgctgctcatgtgcaagtctcaccactgtgactttcggcggagggaccaagttgaccgtcctcagtcagcccaaggctgccccctcggtcactctgttcccaccctcctcatcacgtgtactgagcgggctggcaaggcgcatagnnnnn

SEQ ID NO: 157290 - DNA, 246 bp, Homo sapiens
  misc_feature: GYAE6OF01EZKED.34.27.C05.1.454.CMB.1.raw
  modified_base (245)..(246): a, c, t, g, unknown or other
  misc_feature (245)..(246): n is a, c, g, or t
tcagtacacgtgatcacgaccggtgctcgatttagacgcgatcgaagggtttgggggtgtggtggtctccactcccgccttgacgaggctgattattactgctgctcatgtgcaagtctcaccactgtgactttcggcggagggaccaagttgaccgtcctcagtcagcccaaggctgccccctcggtcactctgttcccgccctcctcatcacgtgtactgagcgggctggcaaggcgcatagnn

SEQ ID NO: 157291 - DNA, 298 bp, Homo sapiens
  misc_feature: GYAE6OF01DB9X0.34.27.C05.1.454.CMB.1.raw
  modified_base (255)..(298): a, c, t, g, unknown or other
  misc_feature (255)..(298): n is a, c, g, or t
tcagtacacgtgatcacgaccggtgctcgatttagacgcgatcgaagggtttgggggtgtggtggtcgtccactcccgccttgacgaggcctgattattactgctcgctcatgtgcaagttcctcaccactgtgactttcggcggaggaccaagttgaccgtcctcagtcagcccaaggctcgccccctcggtcactcttcgttcccacccgtctcactccacgtgtactgaggcgggctggcaaggcgcatagnnnnnnnnnnnnnnnnnnnnnnnnnnnnnnnnnnnnnnnnnnnn

SEQ ID NO: 157292 - DNA, 245 bp, Homo sapiens
  misc_feature: GYAE6OF01EI8SZ.34.27.C05.1.454.CMB.1.raw
  modified_base (243)..(245): a, c, t, g, unknown or other
  misc_feature (243)..(245): n is a, c, g, or t
tcagtacacgtgatcacgaccggtgctcgatttagacgcgatcgaagggtttgggggtgtggtggtctccactcccgccttgacgaggctgattattactgctgctcatgtgcaagtctcaccactgtgactttcggcggagggaccaagttgaccgtcctcagtcagcccaaggctgccccctggtcactctgttcccaccctcctcatcacgtgtactgagcggctggcaaggcgcatagnnn

SEQ ID NO: 157293 - DNA, 248 bp, Homo sapiens
  misc_feature: GYAE6OF01DQGPV.34.27.C05.1.454.CMB.1.raw
  modified_base (245)..(248): a, c, t, g, unknown or other
  misc_feature (245)..(248): n is a, c, g, or t
tcagtacacgtgatcacgaccggtgctcgatttagacgcgatcgaagggtttgggggtgtggtggtctccactcccgccttgacgaggctgattattactgctgctcatgtgcaagtctcaccactgtgactttcggcggagggaccaagttgaccgtcctcagtcagcccaaggctgccccctcggtcactctgttcccaccctcctcatcacgtgtactgagcgggctggcaaggcgcatagnnnn

SEQ ID NO: 157294 - DNA, 247 bp, Homo sapiens
  misc_feature: GYAE6OF01AYOAV.34.27.C05.1.454.CMB.1.raw
  modified_base (243)..(247): a, c, t, g, unknown or other
  misc_feature (243)..(247): n is a, c, g, or t
tcagtacacgtgatcacgaccggtgctcgatttagacgcgatcgaagggtttgggggtgtggtggtctccactcccgccttgacgaggctgattattactgctgctcatgtgcaagtctcaccactgtgactttcggcggagggaccaagttgaccgtcctcagtcagcccaaggctgccccctggtcactctgttcccacctcctcatcacgtgtactgagcgggctggcaaggcgcatagnnnnn

SEQ ID NO: 157295 - DNA, 282 bp, Homo sapiens
  misc_feature: GYAE6OF01DJX43.34.27.C05.1.454.CMB.1.raw
  modified_base (250)..(282): a, c, t, g, unknown or other
  misc_feature (250)..(282): n is a, c, g, or t
tcagtacacgtgatcacgaccggtgctcgatttagacgcgatcgaagggtttggggggttgtggtggtctccactcccgccttgacgaggctgattattactgctgctcatgtgcaagtctcaccactgtgactttcggcggagggaccaagttgaccgtcctcagttcagcccaaggctgccccctcggtcactctgttcccaccctcctcagtcacgtgtacgtgagcgggctggcaaggcgcatagnnnnnnnnnnnnnnnnnnnnnnnnnnnnnnnnn

SEQ ID NO: 157296 - DNA, 249 bp, Homo sapiens
  misc_feature: GYAE6OF01EQ6SV.34.27.C05.1.454.CMB.1.raw
  modified_base (245)..(249): a, c, t, g, unknown or other
  misc_feature (245)..(249): n is a, c, g, or t
tcagtacacgtgatcacgaccggtgctcgatttagacgcgatcgaagggtttgggggtgtggtggtctccactcccgccttgacgaggctgattattactgctgctcatgtgcaagtctcaccactgtgactttcggcggagggaccaagttgaccgtcctcagtcagcccaaggctgccccctcggtcactctgttcccaccctcctcatcacgtgtactgagcgggctggcaaggcgcatagnnnnn

SEQ ID NO: 157297 - DNA, 248 bp, Homo sapiens; identical to SEQ ID NO: 157293
  misc_feature: GYAE6OF01CCYXF.34.27.C05.1.454.CMB.1.raw
  modified_base (245)..(248): a, c, t, g, unknown or other
  misc_feature (245)..(248): n is a, c, g, or t

SEQ ID NO: 157298 - DNA, 246 bp, Homo sapiens; identical to SEQ ID NO: 157269
  misc_feature: GYAE6OF01BU50V.34.27.C05.1.454.CMB.1.raw
  modified_base (245)..(246): a, c, t, g, unknown or other
  misc_feature (245)..(246): n is a, c, g, or t

SEQ ID NO: 157299 - DNA, 265 bp, Homo sapiens
  misc_feature: GYAE6OF01DFXSR.34.27.C05.1.454.CMB.1.raw
  modified_base (248)..(265): a, c, t, g, unknown or other
  misc_feature (248)..(265): n is a, c, g, or t
tcagtacacgtgatcacgaccggtgctcgatttagacgcgatcgaagggtttggggggtgtggtggtctaccactcccgccttgacgaggctgattattactgctgctcatgtgcaagtctcaccactgtgactttcggcggagggaccaaactgaccgtcctgagtcagcccaaggctgccccctggtcactctcgttcccgccctcctcatcacgtgtactgacgcgggctggcaaggcgcatagnnnnnnnnnnnnnnnnnn

SEQ ID NO: 157300 - DNA, 250 bp, Homo sapiens
  misc_feature: GYAE6OF01A4QOJ.34.27.C05.1.454.CMB.1.raw
  modified_base (245)..(250): a, c, t, g, unknown or other
  misc_feature (245)..(250): n is a, c, g, or t
tcagtacacgtgatcacgaccggtgctcgatttagacgcgatcgaagggtttggggggtgtggtggtctccactcccgccttgacgaggctgattattactgctgctcatgtgcaagtctcaccactgtgactttcggcggagggaccaagttgaccgtcctcagtcagcccaaggctgccccctcggtcactctgttcccgccctcctcatcacgtgtactgagcggctggcaaggcgcatagnnnnnn

SEQ ID NO: 157301 - DNA, 253 bp, Homo sapiens
  misc_feature: GYAE6OF01CMELU.34.27.C05.1.454.CMB.1.raw
  modified_base (247)..(253): a, c, t, g, unknown or other
  misc_feature (247)..(253): n is a, c, g, or t
tcagtacacgtgatcacgaccggtgctcgatttagacgcgatcgaagggtttggggggtgtggtggtctccactcccgccttgacgaggctgattattactgctgctcatgtgcaagtctcaccactgtgactttcggcggagggaccaagttgaccgtcctcagtcagcccaaggctcgccccctcggtcactctcgttcccgcctcctcatcacgtgtactgagcggctggcaaggcgtcatagnnnnnnn

SEQ ID NO: 157302 - DNA, 255 bp, Homo sapiens
  misc_feature: GYAE6OF01A8L9T.34.27.C05.1.454.CMB.1.raw
  modified_base (243)..(255): a, c, t, g, unknown or other
  misc_feature (243)..(255): n is a, c, g, or t
tcagtacacgtgatcacgaccggtgctcgatttagacgcgatcgaagggtttgggggtgtggtggtctccactcccgccttgacgaggctgattattactgctgctcatgtgcaagtctcaccactgtgactttcggcggagggaccaagttgaccgtcctcagtcagcccaaggctgccccctggtcactctcgtcccgccctcctcatcacgtgtactgagcggctggcaaggcgcatagnnnnnnnnnnnnn

SEQ ID NO: 157303 - DNA, 247 bp, Homo sapiens
  misc_feature: GYAE6OF01BYDL9.34.27.C05.1.454.CMB.1.raw
  modified_base (245)..(247): a, c, t, g, unknown or other
  misc_feature (245)..(247): n is a, c, g, or t
tcagtacacgtgatcacgaccggtgctcgatttagacgcgatcgaagggtttggggggtgtggtggtctccactcccgccttgacgaggctgattattactgctgctcatgtgcaagtctcaccactgtgactttcggcggagggaccaagttgaccgtcctcagtcagcccaaggctgccccctggtcactctgttcccgccctcctcatcacgtgtactgagcgggctggcaaggcgcatagnnn

SEQ ID NO: 157304 - DNA, 247 bp, Homo sapiens; identical to SEQ ID NO: 157277
  misc_feature: GYAE6OF01BQEM5.34.27.C05.1.454.CMB.1.raw
  modified_base (245)..(247): a, c, t, g, unknown or other
  misc_feature (245)..(247): n is a, c, g, or t

SEQ ID NO: 157305 - DNA, 267 bp, Homo sapiens
  misc_feature: GYAE6OF01DFWHE.34.27.C05.1.454.CMB.1.raw
  modified_base (248)..(267): a, c, t, g, unknown or other
  misc_feature (248)..(267): n is a, c, g, or t
tcagtacacgtgatcacgaccggtgctcgatttagacgcgatcgaaggggtttgggggtagtggtcggtctccactcccgccttgacgaggctgattattactgctgctcatgtgcaagtctcaccactgtgactttcggcggagggaccaagttgaccgtcctcagtcagcccaaggctgccccctcggtcactctgttcccgcctcctcatcacgtgtaactgagcgggctggcaaggcgcatagnnnnnnnnnnnnnnnnnnnn

SEQ ID NO: 157306 - DNA, 249 bp, Homo sapiens
  misc_feature: GYAE6OF01BZVZ7.34.27.C05.1.454.CMB.1.raw
  modified_base (246)..(249): a, c, t, g, unknown or other
  misc_feature (246)..(249): n is a, c, g, or t
tcagtacacgtgatcacgaccggtgctcgatttagacgcgatcgaagggtttgggggtgtggtggtctccactcccgccttgacgaggctgattattactgctgctcatgtgcaagtctcaccactgtgacttttcggcggagggaccaagttgaccgtcctcagtcagcccaaggctgccccctcggtcactctgttcccgccctcctcatcacgtgtactgagcgggctggcaaggcgcatagnnnn

SEQ ID NO: 157307 - DNA, 253 bp, Homo sapiens
  misc_feature: GYAE6OF01AEJH2.34.27.C05.1.454.CMB.1.raw
  modified_base (249)..(253): a, c, t, g, unknown or other
  misc_feature (249)..(253): n is a, c, g, or t
tcagtacacgtgatcacgaccggtgctcgatttagacgcgatcgaagggtttggggggtgtggtggtctccactcccgccttgacgaggctgattattactgctgctcatgtgcaagtctcaccactgtgactttcggcggagggaccaagttgaccgtcctcagtcagcccaaggctcgccccctcggtcactctcgttcccaccctcctcatcacgtgtactggagcgggctggcaaggcgcatagnnnnn

SEQ ID NO: 157308 - DNA, 250 bp, Homo sapiens
  misc_feature: GYAE6OF01EBMQ3.34.27.C05.1.454.CMB.1.raw
  modified_base (247)..(250): a, c, t, g, unknown or other
  misc_feature (247)..(250): n is a, c, g, or t
tcagtacacgtgatcacgaccggtgctcgatttagacgcgatcgaagggtttggggggtgttggtggtctccactcccgccttgacgaggctgattattactgctgctcatgtgcaagtctcaccactgtgactttcggcggagggaccaagttgaccgtcctcagtcagcccaaggctgccccctcggtcactctgttcccaccctcctcatcacgtgtactgagcgggctggcaaggcgcatagnnnn

SEQ ID NO: 157309 - DNA, 255 bp, Homo sapiens
  misc_feature: GYAE6OF01AWQWL.34.27.C05.1.454.CMB.1.raw
  modified_base (246)..(255): a, c, t, g, unknown or other
  misc_feature (246)..(255): n is a, c, g, or t
tcagtacacgtgatcacgaccggtgctcgatttagacgcgatcgaagggtttggggggtgtggtggtctccactcccgccttgacgaggctgactactactgtcagtcttatgataatgacaatcatgtgatattcggcggagggaccaaactgaccgtcctgagtcagcccaaggctgccccctcggtcactctgttcccgccctcctcatcacgtgtactgagcgggctggcaaggcgcatagnnnnnnnnnn

SEQ ID NO: 157310 - DNA, 265 bp, Homo sapiens
  misc_feature: GYAE6OF01BRIEN.34.27.C05.1.454.CMB.1.raw
  modified_base (257)..(265): a, c, t, g, unknown or other
  misc_feature (257)..(265): n is a, c, g, or t
tcagtacacgtgatcacgaccggtgctcgatttagacgcgatcgaagggtttggggggtgtggtggtctccactcccgccttgacgaggctgattattactgctgctcatgtgcaagtctcaccactgtgtactttcggcggagggaccaagttgaccgtcctcagtcagcccaaggctcgccccctggtctactctcgttccccgccctcctcactcacgtgtacgtgacggcgggtctggcgaaggcgctatagnnnnnnnnn

SEQ ID NO: 157311 - DNA, 253 bp, Homo sapiens
  misc_feature: GYAE6OF01AMAHR.34.27.C05.1.454.CMB.1.raw
  modified_base (219)..(219): a, c, t, g, unknown or other
  misc_feature (219)..(219): n is a, c, g, or t
  modified_base (246)..(253): a, c, t, g, unknown or other
  misc_feature (246)..(253): n is a, c, g, or t
tcagtacacgtgatcacgaccggtgctcgatttagacgcgatcgaagggtttggggggtgtggtggtctccactcccgccttgacgaggctgattattactgctgctcatgtgcaagtctcaccactgtgactttcggcggagggaccaagttgaccgtcctcagtcagcccaaggctgccccctcggtcactctgttcccgccctcctcagtcacgtntactgagcggctggcaaggcgcatagnnnnnnnn

SEQ ID NO: 157312 - DNA, 269 bp, Homo sapiens
  misc_feature: GYAE6OF01EA5YL.34.27.C05.1.454.CMB.1.raw
  modified_base (245)..(245): a, c, t, g, unknown or other
  misc_feature (245)..(245): n is a, c, g, or t
  modified_base (264)..(269): a, c, t, g, unknown or other
  misc_feature (264)..(269): n is a, c, g, or t
tcagtacacgtgatcacgaccggtgctcgatttagacgcgatcgaagggtttggggggtgtggtggtctccactcccgccttgacgaggctgattattactgctgctcatgtgcaagtctcaccactgtgacgtttcggcggagggaccaagttgaccgtcctcagtcacgacccaaggctcgccccctcggtccacttcctcgttccccgccctcctcactcacgttgtacgtggaggccgggntcggacgaaggcacgatgnnnnnn

SEQ ID NO: 157313 - DNA, 263 bp, Homo sapiens
  misc_feature: GYAE6OF01BHAE0.34.27.C05.1.454.CMB.1.raw
  modified_base (228)..(228): a, c, t, g, unknown or other
  misc_feature (228)..(228): n is a, c, g, or t
  modified_base (239)..(239): a, c, t, g, unknown or other
  misc_feature (239)..(239): n is a, c, g, or t
  modified_base (245)..(263): a, c, t, g, unknown or other
  misc_feature (245)..(263): n is a, c, g, or t
tcagtacacgtgatcacgaccggtgctcgatttagacgcgatcgaagggtttgggggtgtggtggtctccactcccgccttgacgaggctgattattactgctgctcatgtgcaagtctcaccactgtgactttcgggcggagggaccaagttgaccgtcctcagtcagcccaaggctgccccctggtcactctgttcccgcctcctcatcacgtgtactgagcgggntggctaaggcncatagnnnnnnnnnnnnnnnnnnn

SEQ ID NO: 157314 - DNA, 269 bp, Homo sapiens
  misc_feature: GYAE6OF01CERAD.34.27.C05.1.454.CMB.1.raw
  modified_base (252)..(252): a, c, t, g, unknown or other
  misc_feature (252)..(252): n is a, c, g, or t
  modified_base (257)..(269): a, c, t, g, unknown or other
  misc_feature (257)..(269): n is a, c, g, or t
tcagtacacgtgatcacgaccggtgctcgatttagacgcgatcgaagggtttggggggtgtggtggtctccactcccgccttgacgaggctgattattactgctgctcatgtgcaagtctcaccactgtgactttcggcggagggaccaagttgaccgtcctcagtcacgcccaaggctcgccccctcggtcactcgtcgtcccgccctcctcatcacgtgtactggaggcggtcgtggacgaacggccganagagnnnnnnnnnnnnn

SEQ ID NO: 157315 - DNA, 279 bp, Homo sapiens
  misc_feature: GYAE6OF01ELJEB.34.27.C05.1.454.CMB.1.raw
  modified_base (166)..(166): a, c, t, g, unknown or other
  misc_feature (166)..(166): n is a, c, g, or t
  modified_base (214)..(214): a, c, t, g, unknown or other
  misc_feature (214)..(214): n is a, c, g, or t
  modified_base (223)..(223): a, c, t, g, unknown or other
  misc_feature (223)..(223): n is a, c, g, or t
  modified_base (258)..(279): a, c, t, g, unknown or other
  misc_feature (258)..(279): n is a, c, g, or t
tcagtacacgtgatcacgaccggtgctcgatttagacgcgatcgaagggtttggggggtgtggtggtctccactcccgccttgacgaggctgattattactgctgctcatgtgcaagtctcaccatgtgtactttcgggcggagggaccaaggttgaccgtcctcngtcagcccgaagctcgccccctcggtccactctcgttcccgccctccncatcacgtntacgtgacggcgggcgtggacgaaggcgacatagnnnnnnnnnnnnnnnnnnnnnn

SEQ ID NO: 157316 - DNA, 244 bp, Homo sapiens
  misc_feature: GYAE6OF02FRZ2Y.34.27.C05.1.454.CMB.1.raw
  modified_base (242)..(244): a, c, t, g, unknown or other
  misc_feature (242)..(244): n is a, c, g, or t
tcagtacacgtgatcacgaccggtgctcgatttagacgcgatcgaagggtttggggtgtggtggtctccactcccgccttgacgaggctgattattactgctgctcatgtgcaagtctcaccactgtgactttcggcggagggaccaagttgaccgtcctcagtcagcccaaggctgcccctcggtcactctgttcccacctcctcatcacgtgtactgagcgggctggcaaggcgcatagnnn

SEQ ID NO: 157317 - DNA, 247 bp, Homo sapiens; identical to SEQ ID NO: 157271
  misc_feature: GYAE6OF02F8NCH.34.27.C05.1.454.CMB.1.raw
  modified_base (245)..(247): a, c, t, g, unknown or other
  misc_feature (245)..(247): n is a, c, g, or t

SEQ ID NO: 157318 - DNA, 244 bp, Homo sapiens
  misc_feature: GYAE6OF02HIENA.34.27.C05.1.454.CMB.1.raw
  modified_base (243)..(244): a, c, t, g, unknown or other
  misc_feature (243)..(244): n is a, c, g, or t
tcagtacacgtgatcacgaccggtgctcgatttagacgcgatcgaagggtttgggtgtggtggtctccactcccgccttgacgaggctgattattactgctgctcatgtgcaagtctcaccactgtgactttcggcggagggaccaagttgaccgtcctcagtcagcccaaggctgccccctcggtcactctgttcccgccctcctcatcacgtgtactgagcgggctggcaaggcgcatagnn

SEQ ID NO: 157319 - DNA, 248 bp, Homo sapiens
  misc_feature: GYAE6OF02G58U1.34.27.C05.1.454.CMB.1.raw
  modified_base (246)..(248): a, c, t, g, unknown or other
  misc_feature (246)..(248): n is a, c, g, or t
tcagtacacgtgatcacgaccggtgctcgatttagacgcgatcgaaggtttgggggtgtggtggtctccactcccgccttgacgaggctgattagttactgctgctcagtgtgcaagtctcaccactgtgactttcggcggagggaccaagttgaaccgtcctcagtcagcccaaggctgcccctcggtcactctgttcccgccctcctcatcacgtgtactgagcgggctggcaaggcgcatagnnn

SEQ ID NO: 157320 - DNA, 249 bp, Homo sapiens
  misc_feature: GYAE6OF02FZA3H.34.27.C05.1.454.CMB.1.raw
  modified_base (243)..(249): a, c, t, g, unknown or other
  misc_feature (243)..(249): n is a, c, g, or t
tcagtacacgtgatcacgaccggtgctcgatttagacgcgatcgaagggtttgggggtgtggtggtctccactcccgccttgacgaggctgattattactgctgctcatgtgcaagtctcaccactgtgactttcggcggagggaccaagttgaccgtcctcagtcagcccaaggctgccccctggtcactctgttcccacctcctcatcacgtgtactgagcgggctggcaaggcgcatagnnnnnnn

SEQ ID NO: 157321 - DNA, 246 bp, Homo sapiens; identical to SEQ ID NO: 157269
  misc_feature: GYAE6OF02IHD0I.34.27.C05.1.454.CMB.1.raw
  modified_base (245)..(246): a, c, t, g, unknown or other
  misc_feature (245)..(246): n is a, c, g, or t

SEQ ID NO: 157322 - DNA, 306 bp, Homo sapiens
  misc_feature: GYAE6OF02IHM0D.34.27.C05.1.454.CMB.1.raw
  modified_base (251)..(252): a, c, t, g, unknown or other
  misc_feature (251)..(252): n is a, c, g, or t
  modified_base (254)..(306): a, c, t, g, unknown or other
  misc_feature (254)..(306): n is a, c, g, or t
tcagtacacgtgatcacgaccggtgctcgatttagacgcgatcgaagggtttggggggtgtggtggtctccactcccgccttgacgaggctgactacctactgtcagtcttatgataatgacaatcatgtgatattcggcggagggaaccaaactgaccgtcctgagtcagcccaaggcctgcccccttggtcactcgtagttcccaccctcctcatcacgtgtactgagcgggctggcaaggcgcatagnncnnnnnnnnnnnnnnnnnnnnnnnnnnnnnnnnnnnnnnnnnnnnnnnnnnnnn

SEQ ID NO: 157323 - DNA, 256 bp, Homo sapiens
  misc_feature: GYAE6OF02HFTL6.34.27.C05.1.454.CMB.1.raw
  modified_base (243)..(256): a, c, t, g, unknown or other
  misc_feature (243)..(256): n is a, c, g, or t
tcagtacacgtgatcacgaccggtgctcgatttagacgcgatcgaagggtttggggtgtggtggtctccactcccgccttgacgaggctgattattactgctgctcatgtgcaagtctcaccactgtgactttcggcggagggaccaagttgaccgtcctcagtcagcccaaggctgccccctggtcactctgttcccgccctcctcatcacgtgtactgagcgggctggcaaggcgcatagnnnnnnnnnnnnnn

SEQ ID NO: 157324 - DNA, 245 bp, Homo sapiens
  misc_feature: GYAE6OF02F6IYM.34.27.C05.1.454.CMB.1.raw
  modified_base (244)..(245): a, c, t, g, unknown or other
  misc_feature (244)..(245): n is a, c, g, or t
tcagtacacgtgatcacgaccggtgctcgatttagacgcgatcgaagggtttgggggtgtggtggtctccactcccgccttgacgaggctgattattactgctgctcatgtgcaagtctcaccactgtgactttcggcggagggaccaagttgaccgtcctcagtcagcccaaggctgccccctcggtcactctgttcccgcctcctcatcacgtgtactgagcgggctggcaaggcgcatagnn

SEQ ID NO: 157325 - DNA, 246 bp, Homo sapiens; identical to SEQ ID NO: 157290
  misc_feature: GYAE6OF02HMRJ6.34.27.C05.1.454.CMB.1.raw
  modified_base (245)..(246): a, c, t, g, unknown or other
  misc_feature (245)..(246): n is a, c, g, or t

SEQ ID NO: 157326 - DNA, 254 bp, Homo sapiens
  misc_feature: GYAE6OF02GX5C8.34.27.C05.1.454.CMB.1.raw
  modified_base (243)..(254): a, c, t, g, unknown or other
  misc_feature (243)..(254): n is a, c, g, or t
tcagtacacgtgatcacgaccggtgctcgatttagacgcgatcgaagggtttgggggtgtggtggtctccactcccgccttgacgaggctgattattactgctgctcatgtgcaagtctcaccactgtgactttcggcggagggaccaagttgaccgtctcagtcagcccaaggctgccccctggtcactctgttcccaccctcctcatcacgtgtactgagcgggctggcaaggcgcatagnnnnnnnnnnnn

SEQ ID NO: 157327 - DNA, 245 bp, Homo sapiens; identical to SEQ ID NO: 157324
  misc_feature: GYAE6OF02FVM9W.34.27.C05.1.454.CMB.1.raw
  modified_base (244)..(245): a, c, t, g, unknown or other
  misc_feature (244)..(245): n is a, c, g, or t

SEQ ID NO: 157328 - DNA, 248 bp, Homo sapiens; identical to SEQ ID NO: 157274
  misc_feature: GYAE6OF02FXNE9.34.27.C05.1.454.CMB.1.raw
  modified_base (245)..(248): a, c, t, g, unknown or other
  misc_feature (245)..(248): n is a, c, g, or t

SEQ ID NO: 157329 - DNA, 245 bp, Homo sapiens; identical to SEQ ID NO: 157324
  misc_feature: GYAE6OF02F74D5.34.27.C05.1.454.CMB.1.raw
  modified_base (244)..(245): a, c, t, g, unknown or other
  misc_feature (244)..(245): n is a, c, g, or t

SEQ ID NO: 157330 - DNA, 252 bp, Homo sapiens
  misc_feature: GYAE6OF02GP7A8.34.27.C05.1.454.CMB.1.raw
  modified_base (245)..(252): a, c, t, g, unknown or other
  misc_feature (245)..(252): n is a, c, g, or t
tcagtacacgtgatcacgaccggtgctcgatttagacgcgatcgaagggtttgggggtgtggtggtctccactcccgccttgacgaggctgattattactgctgctcatgtgcaagtctcaccactgtgactttcggcggagggaccaagttgaccgtcctcagtcagcccaaggctgccccctcggtcactctgttcccgccctcctcatcacgtgtactgagcgggctggcaaggcgcatagnnnnnnnn

SEQ ID NO: 157331 - DNA, 254 bp, Homo sapiens
  misc_feature: GYAE6OF02JW85T.34.27.C05.1.454.CMB.1.raw
  modified_base (246)..(254): a, c, t, g, unknown or other
  misc_feature (246)..(254): n is a, c, g, or t
tcagtacacgtgatcacgaccggtgctcgatttagacgcgatcgaagggtttgggggtggtggtggtctccactcccgccttgacgaggctgattattactgctgctcatgtgcaagtctcaccactgtgactttcggcggagggaccaagttgaccgtcctcagtcagcccaaggctgccccctggtcactctgttcccgcctcctcatcacgtgtactgagcgggctggacaaggtcgcatagnnnnnnnnn

SEQ ID NO: 157332 - DNA, 248 bp, Homo sapiens; identical to SEQ ID NO: 157274
  misc_feature: GYAE6OF02HDGAC.34.27.C05.1.454.CMB.1.raw
  modified_base (245)..(248): a, c, t, g, unknown or other
  misc_feature (245)..(248): n is a, c, g, or t

SEQ ID NO: 157333 - DNA, 252 bp, Homo sapiens
  misc_feature: GYAE6OF02F4KRW.34.27.C05.1.454.CMB.1.raw
  modified_base (244)..(252): a, c, t, g, unknown or other
  misc_feature (244)..(252): n is a, c, g, or t
tcagtacacgtgatcacgaccggtgctcgatttagacgcgatcgaagggtttgggggtgtggtggtctccactcccgccttgacgaggctgattattactgctgctcatgtgcaagtctcaccactgtgactttcggcggagggaccaagttgaccgttcctcagtcagcccaaggctgccccctggtcactctgttcccacctcctcatcacgtgtactgagcgggctggcaaggcgcatagnnnnnnnnn

SEQ ID NO: 157334 - DNA, 298 bp, Homo sapiens
  misc_feature: GYAE6OF02H2849.34.27.C05.1.454.CMB.1.raw
  modified_base (293)..(298): a, c, t, g, unknown or other
  misc_feature (293)..(298): n is a, c, g, or t
tcagtacacgtgatcacgaccggtgctcgatttagacgcgatcgaagggtttgggggtgtggtggtctccactcccgccttgacggggctgctatctgcctccctgaccatctctgggctccaacctgaggacgaggctgattattactgctgctcatgtgcaagtctcaccactgtgactttcggcggagggaccaagttgaccgtcctcagtcagcccaaggctgccccctcggtcactctgttcccgcctcctcatcacgtgtactgagcgggctggcaaggcgcatagnnnnnn

SEQ ID NO: 157335 - DNA, 245 bp, Homo sapiens
  misc_feature: GYAE6OF02G234M.34.27.C05.1.454.CMB.1.raw
  modified_base (244)..(245): a, c, t, g, unknown or other
  misc_feature (244)..(245): n is a, c, g, or t
tcagtacacgtgatcacgaccggtgctcgatttagacgcgatcgaagggtttgggggtgtggtggtctccactcccgccttgacgaggctgattattactgctgctcatgtgcaagtctcaccactgtgactttcggcggagggaccaagttgaccgtcctcagtcagcccaaggctgccccctggtcactctgttcccgccctcctcatcacgtgtactgagcgggctggcaaggcgcatagnn

SEQ ID NO: 157336 - DNA, 254 bp, Homo sapiens
  misc_feature: GYAE6OF02FUJMK.34.27.C05.1.454.CMB.1.raw
  modified_base (245)..(254): a, c, t, g, unknown or other
  misc_feature (245)..(254): n is a, c, g, or t
tcagtacacgtgatcacgaccggtgctcgatttagacgcgatcgaagggtttgggggtgtggtggtctccactcccgccttgacgaggctgattattactgctgctcatgtgcaagtctcaccactgtgactttcggcggagggaccaagttgaccgtcctcagtcagcccaaggctgccccctcggtcactctgttcccgccctcctcatcacgtgtactgagcgggctggcaaggcgcatagnnnnnnnnnn

SEQ ID NO: 157337 - DNA, 256 bp, Homo sapiens
  misc_feature: GYAE6OF02HWWOK.34.27.C05.1.454.CMB.1.raw
  modified_base (244)..(256): a, c, t, g, unknown or other
  misc_feature (244)..(256): n is a, c, g, or t
tcagtacacgtgatcacgaccggtgctcgatttagacgcgatcgaagggtttgggggtgtggtggtctccactcccgccttgacgaggctgattattactgctgctcatgtgcaagtctcaccactgtgactttcggcggagggaccaagttgaccgtcctcagtcagcccaaggctcgccccctggtcactctgttcccacctcctcatcacgtgtactgagcgggctggcaaggcgcatagnnnnnnnnnnnnn

SEQ ID NO: 157338 - DNA, 257 bp, Homo sapiens
  misc_feature: GYAE6OF02GEA58.34.27.C05.1.454.CMB.1.raw
  modified_base (245)..(257): a, c, t, g, unknown or other
  misc_feature (245)..(257): n is a, c, g, or t
tcagtacacgtgatcacgaccggtgctcgatttagacgcgatcgaagggtttgggggtgtggtggtctccactcccgccttgacgaggctgattattactgctgctcatgtgcaagtctcaccactgtgactttcggcggagggaccaagttgaccgtcctcagtcagcccaaggctgccccctcggtcactctgttcccgccctcctcatcacgtgtactgagcgggctggcaaggcgcatagnnnnnnnnnnnnn

SEQ ID NO: 157339 - DNA, 247 bp, Homo sapiens; identical to SEQ ID NO: 157294
  misc_feature: GYAE6OF02HKPIE.34.27.C05.1.454.CMB.1.raw
  modified_base (243)..(247): a, c, t, g, unknown or other
  misc_feature (243)..(247): n is a, c, g, or t

SEQ ID NO: 157340 - DNA, 246 bp, Homo sapiens
  misc_feature: GYAE6OF02HZ9Y9.34.27.C05.1.454.CMB.1.raw
  modified_base (244)..(246): a, c, t, g, unknown or other
  misc_feature (244)..(246): n is a, c, g, or t
tcagtacacgtgatcacgaccggtgctcgatttagacgcgatcgaagggtttgggggtgtggtggtctccactcccgccttgacgaggctgattattactgctgctcatgtgcaagtctcaccactgtgactttcggcggagggaccaagttgaccgtcctcagtcagcccaaggctgccccctggtcactctgttcccaccctcctcatcacgtgtactgagcgggctggcaaggcgcatagnnn

SEQ ID NO: 157341 - DNA, 248 bp, Homo sapiens; identical to SEQ ID NO: 157274
  misc_feature: GYAE6OF02FI889.34.27.C05.1.454.CMB.1.raw
  modified_base (245)..(248): a, c, t, g, unknown or other
  misc_feature (245)..(248): n is a, c, g, or t

SEQ ID NO: 157342 - DNA, 263 bp, Homo sapiens
  misc_feature: GYAE6OF02HTU0J.34.27.C05.1.454.CMB.1.raw
  modified_base (245)..(263): a, c, t, g, unknown or other
  misc_feature (245)..(263): n is a, c, g, or t
tcagtacacgtgatcacgaccggtgctcgatttagacgcgatcgaagggtttgggggggtggtggtggtctccactcccgccttgacgaggctgattattactgctgctcatgtgcaagtctcaccactgtgactttcggcggagggaccaagttgaccgtctcagtcagcccaaggctgccccctggtcactctgttcccgcctcctcatcacgtgtactgagcgggctggcaaggcgcatagnnnnnnnnnnnnnnnnnnn

SEQ ID NO: 157343 - DNA, 250 bp, Homo sapiens; identical to SEQ ID NO: 157284
  misc_feature: GYAE6OF02HBBS5.34.27.C05.1.454.CMB.1.raw
  modified_base (245)..(250): a, c, t, g, unknown or other
  misc_feature (245)..(250): n is a, c, g, or t

SEQ ID NO: 157344 - DNA, 247 bp, Homo sapiens
  misc_feature: GYAE6OF02HKN7W.34.27.C05.1.454.CMB.1.raw
  modified_base (244)..(247): a, c, t, g, unknown or other
  misc_feature (244)..(247): n is a, c, g, or t
tcagtacacgtgatcacgaccggtgctcgatttagacgcgatcgaagggtttgggggtgtggtggtctccactcccgccttgacgaggctgattattactgctgctcatgtgcaagtctcaccactgtgactttcggcggagggaccaagttgaccgtcctcagtcagcccaaggctgccccctcggtcactctgttcccgcctcctcatcacgtgtactgagcgggctggcaaggcgcatagnnnn

SEQ ID NO: 157345 - DNA, 245 bp, Homo sapiens
  misc_feature: GYAE6OF02JD7U9.34.27.C05.1.454.CMB.1.raw
  modified_base (243)..(245): a, c, t, g, unknown or other
  misc_feature (243)..(245): n is a, c, g, or t
tcagtacacgtgatcacgaccggtgctcgatttagacgcgatcgaagggtttgggggtgtggtggtctccactcccgccttgacgaggctgattattactgctgctcatgtgcaagtctcaccactgtgactttcggcggagggaccaagttgaccgtcctcagtcagcccaaggctgcccctggtcactcgtgttcccgcctcctcatcacgtgtactgagcgggctggcaaggcgcatagnnn

SEQ ID NO: 157346 - DNA, 321 bp, Homo sapiens
  misc_feature: GYAE6OF02GDWJV.34.27.C05.1.454.CMB.1.raw
  modified_base (224)..(224): a, c, t, g, unknown or other
  misc_feature (224)..(224): n is a, c, g, or t
  modified_base (254)..(258): a, c, t, g, unknown or other
  misc_feature (254)..(258): n is a, c, g, or t
  modified_base (262)..(264): a, c, t, g, unknown or other
  misc_feature (262)..(264): n is a, c, g, or t
  modified_base (266)..(266): a, c, t, g, unknown or other
  misc_feature (266)..(266): n is a, c, g, or t
  modified_base (268)..(269): a, c, t, g, unknown or other
  misc_feature (268)..(269): n is a, c, g, or t
  modified_base (271)..(272): a, c, t, g, unknown or other
  misc_feature (271)..(272): n is a, c, g, or t
  modified_base (277)..(278): a, c, t, g, unknown or other
  misc_feature (277)..(278): n is a, c, g, or t
  modified_base (280)..(280): a, c, t, g, unknown or other
  misc_feature (280)..(280): n is a, c, g, or t
  modified_base (282)..(321): a, c, t, g, unknown or other
  misc_feature (282)..(321): n is a, c, g, or t
tcagtacacgtgatcacgaccggtgctcgatttagacgcgatcgaagggtttgggggggtggtggtggtctccactcccgccttgacgaggctgattattactgctgctcatgtgcaagtctcgaccactgtgacttttcggcggagggacccaagttgaccgtcctcagtcagcccaaggctgccccctcggtcactctcgttcccgccctcctcatcacgtntactgaggcgggctggcaaggccgcatagnnnnncacnnncntnngnncagcnncncnnnnnnnnnnnnnnnnnnnnnnnnnnnnnnnnnnnnnnnn

SEQ ID NO: 157347 - DNA, 251 bp, Homo sapiens
  misc_feature: GYAE6OF02GUJN6.34.27.C05.1.454.CMB.1.raw
  modified_base (246)..(251): a, c, t, g, unknown or other
  misc_feature (246)..(251): n is a, c, g, or t
tcagtacacgtgatcacgaccggtgctcgatttagacgcgatcgaagggtttggggggtgtggtggtctccactcccgccttgacgaggctgattattactgctgctcatgtgcaagtctcaccactgtgactttcggcggagggaccaagttgaccgtcctcagtcagcccaaggctgccccctcggtcactctgttcccaccctcctcatcacgtgtactgagcgggctggcaaggcgcatagnnnnnn

SEQ ID NO: 157348 - DNA, 247 bp, Homo sapiens; identical to SEQ ID NO: 157271
  misc_feature: GYAE6OF02FSG7T.34.27.C05.1.454.CMB.1.raw
  modified_base (245)..(247): a, c, t, g, unknown or other
  misc_feature (245)..(247): n is a, c, g, or t

SEQ ID NO: 157349 - DNA, 276 bp, Homo sapiens
  misc_feature: GYAE6OF02FFCXP.34.27.C05.1.454.CMB.1.raw
  modified_base (250)..(276): a, c, t, g, unknown or other
  misc_feature (250)..(276): n is a, c, g, or t
tcagtacacgtgatcacgaccggtgctcgatttagacgcgatcgaagggtttgggggtggtggtggtctccactcccgccttgacgaggctgattattacctgctgctcatgtgcaagtctcaccactgtgactttcggccggagggaccaagttgaccgtcctcagtcagcccaaggctgccccctggtcactcgtgttcccgccctcctcatcacgtgtactgagcgggctggcaagggccgcatagnnnnnnnnnnnnnnnnnnnnnnnnnnn

SEQ ID NO: 157350 - DNA, 247 bp, Homo sapiens; identical to SEQ ID NO: 157277
  misc_feature: GYAE6OF02FG8J9.34.27.C05.1.454.CMB.1.raw
  modified_base (245)..(247): a, c, t, g, unknown or other
  misc_feature (245)..(247): n is a, c, g, or t

SEQ ID NO: 157351 - DNA, 248 bp, Homo sapiens
  misc_feature: GYAE6OF02G9N99.34.27.C05.1.454.CMB.1.raw
  modified_base (245)..(248): a, c, t, g, unknown or other
  misc_feature (245)..(248): n is a, c, g, or t
tcagtacacgtgatcacgaccggtgctcgatttagacgcgatcgaagggtttggggggtgtggtggtctccactcccgccttgacgaggctgattattactgctgctcatgtgcaagtctcaccactgtgactttcggcggagggaccaagttgaccgtcctcagtcagcccaaggctgccccctcggtcactctgttcccaccctcctcatcacgtgtactgagcggctggcaaggcgcatagnnnn

SEQ ID NO: 157352 - DNA, 250 bp, Homo sapiens
  misc_feature: GYAE6OF02GDQ0D.34.27.C05.1.454.CMB.1.raw
  modified_base (245)..(250): a, c, t, g, unknown or other
  misc_feature (245)..(250): n is a, c, g, or t
tcagtacacgtgatcacgaccggtgctcgatttagacgcgatcgaagggtttggggggtgtggtggtctccactcccgccttgacgaggctgattattactgctgctcatgtgcaagtctcaccactgtgactttcggcggagggaccaagttgaccgtcctcagtcagcccaaggctgccccctggtcactctgttcccaccctcctcatcacgtgtactgagcgggctggcaaggcgcatagnnnnnn

SEQ ID NO: 157353 - DNA, 299 bp, Homo sapiens
  misc_feature: GYAE6OF02F6WEO.34.27.C05.1.454.CMB.1.raw
  modified_base (294)..(299): a, c, t, g, unknown or other
  misc_feature (294)..(299): n is a, c, g, or t
tcagtacacgtgatcacgaccggtgctcgatttagacgcgatcgaagggtttgggggtgtggtggtctccactcccgccttgacggggctgctatctgcctccctgaccatctctgggctccaacctgaggacgaggctgattattactgctgctcatgtgcaagtctcaccactgtgactttcggcggagggaccaagttgaccgtcctcagtcagcccaaggctgccccctcggtcactctgttcccgccctcctcatcacgtgtactgagcgggctggcaaggcgcatagnnnnnn

SEQ ID NO: 157354 - DNA, 246 bp, Homo sapiens
  misc_feature: GYAE6OF02I882E.34.27.C05.1.454.CMB.1.raw
  modified_base (244)..(246): a, c, t, g, unknown or other
  misc_feature (244)..(246): n is a, c, g, or t
tcagtacacgtgatcacgaccggtgctcgatttagacgcgatcgaagggtttgggggtgtggtggtctccactcccgccttgacgaggctgattattactgctgctcatgtgcaagtctcaccactgtgactttcggcggagggaccaagttgaccgtcctcagtcagcccaaggctgccccctggtcactctgttcccgccctcctcatcacgtgtactgagcgggctggcaaggcgcatagnnn

SEQ ID NO: 157355 - DNA, 269 bp, Homo sapiens
  misc_feature: GYAE6OF02JTKHY.34.27.C05.1.454.CMB.1.raw
  modified_base (231)..(231): a, c, t, g, unknown or other
  misc_feature (231)..(231): n is a, c, g, or t
  modified_base (247)..(248): a, c, t, g, unknown or other
  misc_feature (247)..(248): n is a, c, g, or t
  modified_base (250)..(254): a, c, t, g, unknown or other
  misc_feature (250)..(254): n is a, c, g, or t
  modified_base (256)..(269): a, c, t, g, unknown or other
  misc_feature (256)..(269): n is a, c, g, or t
tcagtacacgtgatcacgaccggtgctcgatttagacgcgatcgaagggttgggggtggtggtggtcgtccactcccgccttgacgaggctgattattactgctgctcatgtgcaagtctcaccactgtgactttcggcggtagggaccaagttgaccgtcctcagtcagcccaaggctgccccctggtcactctcgttcccaccctcctcatccacgtgtactgagcggntggcaggtcgcagtgnncnnnnngnnnnnnnnnnnnnn

SEQ ID NO: 157356 - DNA, 247 bp, Homo sapiens; identical to SEQ ID NO: 157303
  misc_feature: GYAE6OF02GHWIX.34.27.C05.1.454.CMB.1.raw
  modified_base (245)..(247): a, c, t, g, unknown or other
  misc_feature (245)..(247): n is a, c, g, or t

SEQ ID NO: 157357 - DNA, 262 bp, Homo sapiens
  misc_feature: GYAE6OF02H5GOJ.34.27.C05.1.454.CMB.1.raw
  modified_base (245)..(262): a, c, t, g, unknown or other
  misc_feature (245)..(262): n is a, c, g, or t
tcagtacacgtgatcacgaccggtgctcgatttagacgcgatcgaagggtttggggggtgtggtggtctccactcccgccttgacgaggctgattattactgctgctcgtgtgcaagtctcaccactgtgactttcggcggagggaccaagttgaccgtcctcagtcagcccaaggctgccccctcggtcactctgttcccaccctcctcatcacgtgtactgagcggctggcaaggcgcatagnnnnnnnnnnnnnnnnnn

SEQ ID NO: 157358 - DNA, 255 bp, Homo sapiens
  misc_feature: GYAE6OF02H7L4J.34.27.C05.1.454.CMB.1.raw
  modified_base (247)..(255): a, c, t, g, unknown or other
  misc_feature (247)..(255): n is a, c, g, or t
tcagtacacgtgatcacgaccggtgctcgatttagacgcgatcgaagggttgggggtggtggtggtcgtccactcccgccttgacgaggctgattattactgctgctcatgtgcaagtctcaccactgtgactttcggcggagggaccaagttgaccgtctcagtcagcccaaggctcgccccctggtcactctcgttcccgcctcctacatcacgtgtactgagcgggctggacaggcgctatagnnnnnnnnn

SEQ ID NO: 157359 - DNA, 264 bp, Homo sapiens
  misc_feature: GYAE6OF02HUHCX.34.27.C05.1.454.CMB.1.raw
  modified_base (248)..(264): a, c, t, g, unknown or other
  misc_feature (248)..(264): n is a, c, g, or t
tcagtacacgtgatcacgaccggtgctcgatttagacgcgatcgaagggtttgggggtgtggtggtctccactcccgccttgacgaggctgattattactgctgctcatgtgcaagtctcaccactgtgactttcggcggagggaccaagttgaccgtcctcagtcagcccaaggctcgccccctcggtcacctctgttcccgccctcctcactcacgtgtactgagcgggctggcaaggcgcatagnnnnnnnnnnnnnnnnn

SEQ ID NO: 157360 - DNA, 249 bp, Homo sapiens
  misc_feature: GYAE6OF02JGVSZ.34.27.C05.1.454.CMB.1.raw
  modified_base (246)..(249): a, c, t, g, unknown or other
  misc_feature (246)..(249): n is a, c, g, or t
tcagtacacgtgatcacgaccggtgctcgatttagacgcgatcgaagggtttggggggtgtggtggtctccactcccgccttgacgaggctgattattactgctgctcatgtgcaagtctcaccactgtgactttcggcggagggaccaagttgaccgtcctcagtcagcccaaggctcgccccctcggtcactctcgttcccaccctcctcatcacgtgtactgagcggctggcaggcgcatagnnnn

SEQ ID NO: 157361 - DNA, 269 bp, Homo sapiens
  misc_feature: GYAE6OF02GZ30Q.34.27.C05.1.454.CMB.1.raw
  modified_base (140)..(140): a, c, t, g, unknown or other
  misc_feature (140)..(140): n is a, c, g, or t
  modified_base (219)..(219): a, c, t, g, unknown or other
  misc_feature (219)..(219): n is a, c, g, or t
  modified_base (252)..(269): a, c, t, g, unknown or other
  misc_feature (252)..(269): n is a, c, g, or t
tcagtacacgtgatcacgaccggtgctcgatttagacgcgatcgaagggtttggggggtgtggtggtctccactcccgccttgacgaggctgattattactgctgctcatgtgcaagtctcaccactgtgactttcgggnggagggaccaagttgaccgtcctcagtcagccaaggctcgcccctcggtcactctcgttcccaccctcctcatcacgtntacgtgagcgggcgtcggcgaaggcgacatagnnnnnnnnnnnnnnnnnn

SEQ ID NO: 157362 - DNA, 270 bp, Homo sapiens
  misc_feature: GYAE6OF02H3DFU.34.27.C05.1.454.CMB.1.raw
  modified_base (220)..(220): a, c, t, g, unknown or other
  misc_feature (220)..(220): n is a, c, g, or t
  modified_base (251)..(270): a, c, t, g, unknown or other
  misc_feature (251)..(270): n is a, c, g, or t
tcagtacacgtgatcacgaccggtgctcgatttagacgcgatcgaagggtttgggggtgtggtggtctccactcccgccttgacgaggctgattattactgctgctcatgtgcaagtctcaccactgtgactttcggcggaggaccaagttgaccgtcctcagtcagcccaaggctcgccccctcggtcactcctcgttcccgccctcctcactcacgtntactggagcgggctggacaacggcgcatagnnnnnnnnnnnnnnnnnnnn

SEQ ID NO: 157363 - DNA, 270 bp, Homo sapiens
  misc_feature: GYAE6OF02GGFWS.34.27.C05.1.454.CMB.1.raw
  modified_base (250)..(270): a, c, t, g, unknown or other
  misc_feature (250)..(270): n is a, c, g, or t
tcagtacacgtgatcacgaccggtgctcgatttagacgcgatcgaagggtttggggggtgtggtggtctccactcccgccttgacgaggctgattattactgctgctcatgtgcaagtctcaccactgtgactttcggcggagggaccaagttgaccgtcctcagtcagcccaaggctcgccccctggtcactctcgttcccgccctcctcatccacgtgtactgagcgggctggacaaggcgacatagnnnnnnnnnnnnnnnnnnnnn

SEQ ID NO: 157364 - DNA, 302 bp, Homo sapiens
  misc_feature: GYAE6OF02IOZ45.34.27.C05.1.454.CMB.1.raw
  modified_base (259)..(261): a, c, t, g, unknown or other
  misc_feature (259)..(261): n is a, c, g, or t
  modified_base (263)..(263): a, c, t, g, unknown or other
  misc_feature (263)..(263): n is a, c, g, or t
  modified_base (266)..(266): a, c, t, g, unknown or other
  misc_feature (266)..(266): n is a, c, g, or t
  modified_base (268)..(268): a, c, t, g, unknown or other
  misc_feature (268)..(268): n is a, c, g, or t
  modified_base (270)..(270): a, c, t, g, unknown or other
  misc_feature (270)..(270): n is a, c, g, or t
  modified_base (272)..(302): a, c, t, g, unknown or other
  misc_feature (272)..(302): n is a, c, g, or t
tcagtacacgtgatcacgaccggtgctcgatttagacgcgatcgaagggtttggggggtgtggtggtctccactcccgccttgacgaggctgattattactgctgctcatgtgcaagtctcaccactgtgacctttcgggcggagggaccaaggttgaccgtcctcagtcagcccaaggcctgcccccctggtccactctgttccccaccctctcagtccaccgtgtactgacggcggtctggacagggccgcagtagnnntngantngncnnnnnnnnnnnnnnnnnnnnnnnnnnnnnnn

SEQ ID NO: 157365 - DNA, 500 bp, Homo sapiens
  misc_feature: GYAE6OF01BAMYT.43.19.B08.1.454.CMB.1.raw
  modified_base (305)..(305): a, c, t, g, unknown or other
  misc_feature (305)..(305): n is a, c, g, or t
  modified_base (349)..(349): a, c, t, g, unknown or other
  misc_feature (349)..(349): n is a, c, g, or t
  modified_base (362)..(364): a, c, t, g, unknown or other
  misc_feature (362)..(364): n is a, c, g, or t
  modified_base (366)..(366): a, c, t, g, unknown or other
  misc_feature (366)..(366): n is a, c, g, or t
  modified_base (368)..(368): a, c, t, g, unknown or other
  misc_feature (368)..(368): n is a, c, g, or t
  modified_base (370)..(370): a, c, t, g, unknown or other
  misc_feature (370)..(370): n is a, c, g, or t
  modified_base (376)..(376): a, c, t, g, unknown or other
  misc_feature (376)..(376): n is a, c, g, or t
  modified_base (378)..(378): a, c, t, g, unknown or other
  misc_feature (378)..(378): n is a, c, g, or t
  modified_base (380)..(380): a, c, t, g, unknown or other
  misc_feature (380)..(380): n is a, c, g, or t
  modified_base (386)..(386): a, c, t, g, unknown or other
  misc_feature (386)..(386): n is a, c, g, or t
  modified_base (389)..(389): a, c, t, g, unknown or other
  misc_feature (389)..(389): n is a, c, g, or t
  modified_base (391)..(391): a, c, t, g, unknown or other
  misc_feature (391)..(391): n is a, c, g, or t
  modified_base (393)..(393): a, c, t, g, unknown or other
  misc_feature (393)..(393): n is a, c, g, or t
  modified_base (395)..(395): a, c, t, g, unknown or other
  misc_feature (395)..(395): n is a, c, g, or t
  modified_base (397)..(397): a, c, t, g, unknown or other
  misc_feature (397)..(397): n is a, c, g, or t
  modified_base (403)..(403): a, c, t, g, unknown or other
  misc_feature (403)..(403): n is a, c, g, or t
  modified_base (407)..(407): a, c, t, g, unknown or other
  misc_feature (407)..(407): n is a, c, g, or t
  modified_base (409)..(411): a, c, t, g, unknown or other
  misc_feature (409)..(411): n is a, c, g, or t
  modified_base (422)..(422): a, c, t, g, unknown or other
  misc_feature (422)..(422): n is a, c, g, or t
tcagtgtgagtagtcacgaccggtgctcgatttagtgagtcagtaaggggtggcctaaggaagcagcactggtggtgcctcagccatggcctggaccgttctcctcctcggcctcctctctcactgcacagggtcggtgacttcctatgtgctgactcagccaccctcggtgtcagtggccccaggaaagacggccaggattacctgtggggaaccaacattggaagaagaagtgtgcactggtaccagcagaagccaggccaggcccctctgatgatcgtctatgatgatagcgaccggccctnagggactcccgtgacgcgggatcggcgtaaggcgtccaagtagngcagcgcactgcnnngngngngagcgngngngcgatntangngngngngagagngtgngnnngtcgtcgtcgngacgacgagtcgtcgtcgtacacgacgacgacgcgtcgcccgtccgcgtctcgtccgtcctaccctacctccgtctac

SEQ ID NO: 157366 - DNA, 560 bp, Homo sapiens
  misc_feature: GYAE6OF01DB6P9.43.19.B08.1.454.CMB.1.raw
  modified_base (544)..(544): a, c, t, g, unknown or other
  misc_feature (544)..(544): n is a, c, g, or t
tcagtgtgagtagtcacgaccggtgctcgatttagtgagtcagtaaggggctgggcctaaggaagcagcactggtggtgcctcagccatggcctggaccgttctcctcctcggcctcctctctcactgcacagggtcggtgacttcctatgtgctgactcagccaccctcggtgtcagtggccccaggaaagacggccaggattacctggtggggaaccaacattggaagaagaagtgtgcactggtaccagcagaagccaggccaggcccctctgatgatcgtctatgatgatagcgaccggccctgagggatcccgtgacgcgagtcgctggctccaactcgtggcaacgacggcccacccgtggccatcagcagggtcgaacggccgggatggacggccgactattactgtcgagggtgtgggatagtggtggtgagtcacgtccggtcgttcgggcggacggaccgtaaggttcgaccgtcctaagtccacgacccgaacggcctccgcccccgtcggtccacgttccttccgttccccncccctcctccgtaacc

SEQ ID NO: 157367 - DNA, 697 bp, Homo sapiens
  misc_feature: GYAE6OF01C76J0.43.19.B08.1.454.CMB.1.raw
tcagtgtgagtagtcacgaccggtgctcgatttagtgagtcagtaaggggctgggcctaaggaagcagcactggtggtgcctcagccatggcctggaccgttctcctcctcggcctcctctctcactgcacagggtcgtgacttcctatgtgctgactcagccaccctcggtgtccagtcggccccaggaaagacggccaggattaccgtgtggggaaccaacattggaagaagaagtgtgcacgtggtaccagcagaagccaggccacggccctctgactgatcgtctatgatgatagcgaccgcctcgaggactccctgacgcgagtcgctggcctcgaacttcgcggaccaaacgaccggcccaaccgtggacccagtcgaagcgaacgggtcggaacggccggggatacgggacggaccgtaacgttaagtttaccgtgttaccgaggggttaggtagggtaagttaaaggttgggtcggttaggtaacgttacggtaacgttcccgggttccggtttaccggggccggggtaacgggtaacccgttaagggtttccggtaacccggttacccgttaaaggttccccgaaacgggtacccccgtaaacgggtcccgttacccggccccccgttccgggtacccacccgtttaccgttccgtttaccccttccgcccccgttccccgtaacccc

SEQ ID NO: 157368 - DNA, 532 bp, Homo sapiens
  misc_feature: GYAE6OF01BR4IG.43.19.B08.1.454.CMB.1.raw
tcagtgtgagtagtcacgaccggtgctcgatttagtgagtcagtaaggggctgggcctaaggaagcagcactggtggtgcctcagccatggcctggaccgttctcctcctcggcctcctctctcactgcacagggtcggtgacttcctatgtgctgactcagccaccctcggtgtcagtggccccaggaaagacggccaggattacctggtgggggaaccaacattggaagaagaagtgtgcactggtaccagcagaagccaggccaggcccctctgatgatcgtctatgatgatagcgaccggccctcagggatccctgagcgagtcgctggctcaactctggcaacacgccacctggccatcagcagggtcgagcgggatgagcgatatactgtcagtgtgggataagtggtggtgatcagtccggtcgttcgggtcggagggtacaagttcgaccgtctaagtcaacgtccgaaggcctacggccccctaggtccacttcctacgttcccctaccctccctccgtaacc

SEQ ID NO: 157369 - DNA, 533 bp, Homo sapiens
  misc_feature: GYAE6OF01CVW4I.43.19.B08.1.454.CMB.1.raw
  modified_base (348)..(348): a, c, t, g, unknown or other
  misc_feature (348)..(348): n is a, c, g, or t
tcagtgtgagtagtcacgaccggtgctcgatttagtgagtcagtaaggggctgggcctaaggaagcagcactggtggtgcctcagccatggcctggaccgttctcctcctcggcctcctctctcactgcacagggtcggtgacttcctatgtgctgactcagccaccctcggtgtcagtggccccaggaaagacggccaggattacctgtggggaaccaacattggaagaagaagtgtgcactggtaccagcagaagccaggccaggcccctctgatgatcgtctatgatgatagcgaccggcctcagggatccctgacgcgagtcgctggctccaactctggcaacncggccaccctggccatcagcgagggtcgaagccgggatggaggcgactattactgtcaggtgtgggataagtggtggtgatcgagtccggtcgttcgggcggagggacctaagttcgaccgtccgtaagcacgccgaaggcctcggcccccgtcggtccactctcgttccccgccctctctaacc

SEQ ID NO: 157370 - DNA, 568 bp, Homo sapiens
  misc_feature: GYAE6OF01BNLLX.43.19.B08.1.454.CMB.1.raw
  modified_base (273)..(273): a, c, t, g, unknown or other
  misc_feature (273)..(273): n is a, c, g, or t
tcagtgtgagtagtcacgaccggtgctcgatttagtgagtcagtaaggggtggcctaaggaagcagcactggtggtgcctcagccatggcctggaccgttctcctcctcggcctcctctctcactgcacagggtcggtgacttcctatgtgctgactcagccaccctcggtgtcagtggccccaggaaagacggccaggattacctgtgggggaaccaacattggaagaagaagtgtgcactggtaccagcagaagccaggccaggcccctcngatgatcgtctatgatgatagcgaccggccctcgagggactcccgtgagcgagtcgctggctccaactctggcaacacgccaccctggcccatcagcagggtcgaagccgggatggaggccgatatactgtcaggtgtggataagtggtgtgatcagttccggtcttcgggcgggtagggtacctaaggttcgacccgttctaacggtcaacggtccccaaggccgttcgaccccccgttggtacccgtaccttccgttccgttcccccgcccctttccctccgtccttaacccg

SEQ ID NO: 157371 - DNA, 525 bp, Homo sapiens
  misc_feature: GYAE6OF01CW6L5.43.19.B08.1.454.CMB.1.raw
  modified_base (346)..(346): a, c, t, g, unknown or other
  misc_feature (346)..(346): n is a, c, g, or t
tcagtgtgagtagtcacgaccggtgctcgatttagtgagtcagtaagggctgggcctaaggaagcagcactggtggtgcctcagccatggcctggaccgttctcctcctcggcctcctctctcactgcacagggtcggtgacttcctatgtgctgactcagccaccctcggtgtcagtggccccaggaaagacggccaggattacctgtgggggaaccaacattggaagaagaagtgtgcactggtaccagcagaagccaggccaggcccctctgatgatcgtctatgatgatagcgaccggccctcagggatccctgagcgagtcgctggctcaactctggcacncggccacctggccatcagcgagggtcgaagccggggatggaggccgactattactgtcagggtgtgggatagtggtggtgatcgagtccggtcgttcgggcggagggacctaaggttcgaccgtctagtccagcccgaaggctcgccccctgtccactctcgttcccaccctctctacc

SEQ ID NO: 157372 - DNA, 533 bp, Homo sapiens
  misc_feature: GYAE6OF01BR6XQ.43.19.B08.1.454.CMB.1.raw
  modified_base (355)..(355): a, c, t, g, unknown or other
  misc_feature (355)..(355): n is a, c, g, or t
  modified_base (521)..(521): a, c, t, g, unknown or other
  misc_feature (521)..(521): n is a, c, g, or t
  modified_base (526)..(526): a, c, t, g, unknown or other
  misc_feature (526)..(526): n is a, c, g, or t
tcagtgtgagtagtcacgaccggtgctcgatttagtgagtcagtaaggggtggcctaaggaagcagcactggtggtgcctcagccatggcctggaccgttctcctcctcggcctcctctctcactgcacagggtcggtgacttcctatgtgctgactcagccaccctcggtgtcagtggccccaggaaagacggccaggattacctggtgggggaaccaacagttggaaagaagaagtgtgcactggtaccagcagaagccaggccaggcccctctgatgatcgtctatgatgatagccgaccggccctcgagggatcccgtgagcgagtcgctggctccaactcgtggacaacncggccacctggccatcagcgagggtcgaaggccggggatggacggccgtacgttatacgtgtcgaggtgtagggtataagtggtggtgatctagtccggtcgttcggcggaggactagtacgaccgtctagtcacgccaacgctcgcccgtcgcactctcgtcccncctcnctctacc

SEQ ID NO: 157373 - DNA, 592 bp, Homo sapiens
  misc_feature: GYAE6OF01CLRUC.43.19.B08.1.454.CMB.1.raw
  modified_base (275)..(275): a, c, t, g, unknown or other
  misc_feature (275)..(275): n is a, c, g, or t
tcagtgtgagtagtcacgaccggtgctcgatttagtgagtcagtaaggggtggcctaaggaagcagcactggtggtgcctcagccatggcctggaccgttctcctcctcggcctcctctctcactgcacagggtcggtgacttcctatgtgctgactcagcccaccctcggtgtcagtggccccaggaaagcggccaggattacctggtgggggaaccaacagttaggaagaagaagtgtgcactggtaccagcagaagccaggccaggcccctntgatgatcgtctatgatgatacggccgacccggccctcgagggactcccgtgagcgagtcgcgtggctccaactcgtcggacaaccgaccggcccacccgtcggcccagtccaggccgaacggggtacggaacgggccggggagtggacgggccgtaacgttatttacgtgtacgtagggtgtgggtataagtggtggtgatcgacgttccgggtcgttcgggacggtaggaccgtaggttcgaccgtactagcacgcccgaggccgtccgcccctcggtcctcttccgtccgttccccgccctcctcctacgtacc

SEQ ID NO: 157374 - DNA, 551 bp, Homo sapiens
  misc_feature: GYAE6OF01ET119.43.19.B08.1.454.CMB.1.raw
  modified_base (271)..(271): a, c, t, g, unknown or other
  misc_feature (271)..(271): n is a, c, g, or t
  modified_base (347)..(347): a, c, t, g, unknown or other
  misc_feature (347)..(347): n is a, c, g, or t
tcagtgtgagtagtcacgaccggtgctcgatttagtgagtcagtaaggggtggcctaaggaagcagcactggtggtgcctcagccatggcctggaccgttctcctcctcggcctcctctctcactgcacagggtcggtgacttcctatgtgctgactcagccaccctcggtgtcagtggccccaggaaagacggccaggattacctggtgggggaaccaacattggaagaagaagtgtgcactggtaccagcagagccaggccaggccctntgatgatcgtctatgatgatagcgaccggccctcgagggactcccgtgacgcgagtcgctggctccaatctgcacncgccacctgcatcagcgagggtcgaacggcgggatcggaggccgactatacgtgtcgaggtgtagggataagtggtggtgtatcgagttccggtacgttcgggcggtaggacctaagttcgaccgtcgtaagtccacgacccgaaggcctacgccccctcggtcctaccgttccgtccgtaccccgcccttccgtcctcctacc

SEQ ID NO: 157375 - DNA, 747 bp, Homo sapiens
  misc_feature: GYAE6OF01C07AQ.43.19.B08.1.454.CMB.1.raw
  modified_base (278)..(278): a, c, t, g, unknown or other
  misc_feature (278)..(278): n is a, c, g, or t
tcagtgtgagtagtcacgaccggtgctcgatttagtgagtcagtaaggggctgggcctaaggaagcagcactggtggtgcctcagccatggcctggaccgttctcctcctcggcctcctctctcactgcacagggtcggtgacttcctatgtgctgactcagccacctcggtgtcagtcggccccaggaaagacggccaggattaccgtggtggggaaccaacagttaggaagaagaagtgtgcactggtaccagcagaagccaggccacggcccctntgatgatcgtctatgatgatagccgaaccggccctgacgggactcccgtagacggcgtacgtccggcgttggccttaccaaacgtcgtacgggaccaaaccggaccggtacccaccccgtgggcccaactccgaacggtaccggaacggggtacggaaacggtcccgggggagtacgggacggtacccgtaacttacgttacgtggtacggtagggtcggtagggtaagttaagtgggtaggtcgtaatccgtaacggtttcccgggttcggtttaccggggacggggtaacgggtaacccgtaacgggttaccgtaacccggttacccgttaacggtcccgaaccggtaccccggtaaacggtccccggttacccggtcccccccgttccgggttacccctacccggtttacccgttccccgggtttacccccccgtcccccgttaccccgttcccgttaaacccccg

SEQ ID NO: 157376 - DNA, 594 bp, Homo sapiens
  misc_feature: GYAE6OF01B7IXX.43.19.B08.1.454.CMB.1.raw
  modified_base (276)..(276): a, c, t, g, unknown or other
  misc_feature (276)..(276): n is a, c, g, or t
tcagtgtgagtagtcacgaccggtgctcgatttagtgagtcagtaaggggctgggcctaaggaagcagcactggtggtgcctcagccatggcctggaccgttctcctcctcggcctcctctctcactgcacagggtcggtgacttcctatgtgctgactcagccaccctcggtgtcagtggccccaggaaagacggccaggattacctggtggggaaccaacagttggaaagaagaagtgtgcactggtaccagcagaagccaggccaggcccctntgatgatcgtctatgatgatacgccgaccggccctgacgggactcccgtgacgcgagtccgctcggctaccaactcgtggaccaacgccggccaccctggccatcgagcgagggtacgaacggccgggatggacggcgtactattacgtgtcgaggtgtaggatagtggtgtgatcgacgttccggtcgttcgggcggacggacgtaaggttcgaccgtaccgtaagtcgaccgacccgaaggtccctacccggtcccccgtccgggtacctaccgttcccgttccgttaccccctaccccttcccgttcctaacccc

SEQ ID NO: 157377 - DNA, 636 bp, Homo sapiens
  misc_feature: GYAE6OF01DT58P.43.19.B08.1.454.CMB.1.raw
tcagtgtgagtagtcacgaccggtgctcgatttagtgagtcagtaaggggctgggcctaaggaagcagcactggtggtgcctcagccatggcctggaccgttctcctcctcggcctcctctctcactgcacagggtcggtgacttcctatgtgctgactcagccaccctcggtgtcagtggccccaggaaagacggccaggattacctgtgggggaaccaacattggaagaagaagtgtgcactggtaccagcagaagccaggccaggcccctctggatgatcgtctatgatgatagccgaccggccctgagggatccctgagcggagtcgcgtggctccaatctggaccaacgacggccacccgtggcctaatcgaagcgaggggtcgaacggccggggagtggacggaccgtactattacgtgtcgaggtggtcgggataagtgggtggtagtagtcgtaacgtccgggttacgttccggggcgggtacggggacctaagggttacgaaccggttacccgttaagtacccgtacgacccccggaacggtacccgttccggtcccccccgttcgggttaccgtaacccgttccgttacccggtttccccccgtcccccttcccgtccctaacccc

SEQ ID NO: 157378 - DNA, 646 bp, Homo sapiens
  misc_feature: GYAE6OF01EIEQP.43.19.B08.1.454.CMB.1.raw
  modified_base (273)..(273): a, c, t, g, unknown or other
  misc_feature (273)..(273): n is a, c, g, or t
tcagtgtgagtagtcacgaccggtgctcgatttagtgagtcagtaaggggctgggcctaaggaagcagcactggtggtgcctcagccatggcctggaccgttctcctcctcggcctcctctctcactgcacagggtcggtgacttcctatgtgctgactcagccaccctcggtgtcagtggccccaggaaagacggccaggattacctgtggggaaccaacattggaagaagaagtgtgcactggtaccagcagaagccaggccaggcccctntgatgatcgtctatgatgatagcgaccggccctcgagggactccctgacgcgagtcgcgtggctccaactcgtcggactaacgaccggcccacccgtggacccatcgagccgaggggtaccgaaggcccgggggatacgggacggtaccgacttagttaaccgtggtaccgaagggtggttagggattaacggtgggttggtagtatcgaacgttcccgggtacgtttcggggaccggtagggaaccaagggttccgaacccggttacctaaggttccgaacgaccccggaaggtcccgtaccggtccccccgtacgggttcccacccgttccgttaccggttccccccgtcccccttccgtccctaaacccg

SEQ ID NO: 157379 - DNA, 819 bp, Homo sapiens
  misc_feature: GYAE6OF01EIIX6.43.19.B08.1.454.CMB.1.raw
tcagtgtgagtagtcacgaccggtgctcgatttagtgagtcagtaaggggctgggcctaaggaagcagcactggtggtgcctcagccatggcctggaccgttctcctcctcggcctcctctctcactgcacagggtcggtgacttcctatgtgctgactcacgcccacccgttcggtcgtcaggtcggaccccgaaggaaacgaccggccaaggtacttaccgtgggtacggggaacctatcagttagggaaagaagtagtgtacgcacgtacggtaccagacaagaacgccgacggccgacggcccctgtagatgatccgtactagtgagtgtacgtacggacccggtacccggccctacggacgggtaccttccgaggtacgccggtacgtccggtacgtacggaccctaccgtaacgtcgtacggaccaaacggcccggacccgtaacccgtcggaccctacgtaccggaacgggtaccgggtaacggggtacggaaacccggggtaccggggggaagtaccgggaaaccgggtacccgttaaacgtttacggtttaccgggaggttaccgggttagggttagggtaaacgggttaaagttaacgggtggggtagttacgtagttaccgttacgggtttccccgggtagttaccgggggaacccgggttagggtaacccgtaacggttccgtaacccggttacctaaacggtacccgaccgggtacccgtaacggcccgttccccggtacccccgttacggttcccttacccgggttcccttaccccggttccccctacccgtcccgttaaacccc

SEQ ID NO: 157380 - DNA, 671 bp, Homo sapiens
  misc_feature: GYAE6OF01BJ3GT.43.19.B08.1.454.CMB.1.raw
  modified_base (277)..(277): a, c, t, g, unknown or other
  misc_feature (277)..(277): n is a, c, g, or t
tcagtgtgagtagtcacgaccggtgctcgatttagtgagtcagtaaggggtggcctaaggaagcagcactggtggtgcctcagccatggcctggaccgttctcctcctcggcctcctctctcactgcacagggtcggtgacttcctatgtgctgactcagccaccctcggtgtcagtcggccccaggaaagacggccaggattaccgtggtgggggaaccaacattggaaagaagaagtgtgcacgtggtaccagcagaagccaggccaggcccctntgatgatcgtctatgatgatacgcgacccggcctcgagggactcccgtgacgcggagtcgcgtcggcctaccaactcgtaggaccaacgaccgcccacccgtcggaccctagtcacggcgaacgggtacggaacggggccggggagtacgggacggtacccgaacgttacgttacgtggtacgagggtgtacggggtaataggttggtgggtagtagttcgacggttcccggttcgttaccggggcgggaacgggttaccgtaaggtttacggacccgttaccgtaacgtcgtaacgacccggaacggtccctaccgggtccccccgtcggtaccgtaaccgtttccgtaccccgttccccctaccccgttcccttaccctaccgttaaccccg

SEQ ID NO: 157381 - DNA, 656 bp, Homo sapiens
  misc_feature: GYAE6OF01E3FBC.43.19.B08.1.454.CMB.1.raw
  modified_base (176)..(176): a, c, t, g, unknown or other
  misc_feature (176)..(176): n is a, c, g, or t
tcagtgtgagtagtcacgaccggtgctcgatttagtgagtcagtaaggggctgggcctaaggaagcagcactggtggtgcctcagccatggcctggaccgttctcctcctcggcctcctctctcactgcacagggtcggtgacttcctatgtgctgactcacgcccaccctcggtntcagtcggccccaggaaagcggcaggacttaccgtggtacggggaaccaacagttaggaaagaagaagtgtgcacgtggtaccagcagacgccgaggccacggcccctgtgatgatcgtctatgatgatacggccgacccggccctacggaggtcctcccgtaggacgcggtacgtccgcgtcggtcctaccaactcgtacggacctaaccgcccggacccctacccgcggacccacgtaccgacggccggtagggggtaccgaacggggcccgggggtaatcggggaacggtacccgttaagtttatacggtggtaccggtagggtggtaggtaattaggtgggtacgtgacgtcgacgttccgggtacggtcgggacgggtacgtacgtaggtaccgaccgtacgtacgcgaccgaccgacggtcctaccgccccgtgtccctacgttcccgtcccgtcccctccttcccgctacccg

SEQ ID NO: 157382 - DNA, 612 bp, Homo sapiens
  misc_feature: GYAE6OF01CUUWE.43.19.B08.1.454.CMB.1.raw
  modified_base (375)..(375): a, c, t, g, unknown or other
  misc_feature (375)..(375): n is a, c, g, or t
  modified_base (396)..(396): a, c, t, g, unknown or other
  misc_feature (396)..(396): n is a, c, g, or t
tcagtgtgagtagtcacgaccggtgctcgatttagtgagtcagtaagggggctgggcctaaggaagcagcactggtggtgcctcagccatggcctggaccgttctcctcctcggcctcctctctcactgcacagggtcggtgacttcctatgtgctgactcagcccaccctcggtgtcagtcggccccaaggaaagacggccaggacttaccgtggtcgggggaaccaacagttagggaaagaaagaagtgtgacacgttacggtaccagcagaagccgaggccacggccctactgagtgatcggtactagtgatgatacggccgaccggccctaggacgggactcccgtgagcggacgtcgctggcctcactgngcacgacgccaccgtgaccancgagcgagggcgaacggccgggagtcggaacgaccgtacgttactaacgtcggtctaggggtacggtagggtagttaaggtagggtggttacgagtcggtacgttccggtaggttccgggaacggtacggactagggtacacgtaccgtagtccgcgaccggtgtccgtaccgccccgtagtcaccgttcgtacccgtccccaccttcgctaaccg

SEQ ID NO: 157383 - DNA, 692 bp, Homo sapiens
  misc_feature: GYAE6OF01DLHSJ.43.19.B08.1.454.CMB.1.raw
tcagtgtgagtagtcacgaccggtgctcgatttagtgagtcagtaaggggctgggcctaaggaagcagcactggtggtgcctcagccatggcctggaccgttctcctcctcggcctcctctctcactgcacagggtcggtgacttcctatgtgctgactcagccaccctcggtgtcagtcggccccaggaaagacggccaggattaccgtggtacgggggaaccaaacagttaggaaagaaagaagtgtgcactggtaccagcagaagccaggccacggcccctcgtgatgatcgtctagtgatgaataggccggaccggccctgacgggactccctggagcgagtcgcgtcggcctccgaactcgtgaccaacgacggcccacccgtgccatcgagcgagggtcgaacggccgggataggacggaccgtattaagtacgtggtcgtaaggggtgttacggggaattagtgggttacggtagaacgttcgtaacggttcccgggttacggttacgggggacgggtaacggggaaccttaagggttccggaacccgttaaccgtaaacggtcccgaacgggacccccgtaaagggtcccctaaccccgggtccccccgttacgggttacccctaaccgttttcccgtaccccggtttaccccccaacccccttcccttaacccgtaaaccccg

SEQ ID NO: 157384 - DNA, 671 bp, Homo sapiens
  misc_feature: GYAE6OF01BGXIN.43.19.B08.1.454.CMB.1.raw
  modified_base (277)..(277): a, c, t, g, unknown or other
  misc_feature (277)..(277): n is a, c, g, or t
tcagtgtgagtagtcacgaccggtgctcgatttagtgagtcagtaaggggctgggcctaaggaagcagcactggtggtgcctcagccatggcctggaccgttctcctcctcggcctcctctctcactgcacagggtcggtgacttcctatgtgctgactcagccaccctcggtgtcagtcggccccaggaaagacggccaggattaccgtggtgggggaaccaacattggaagaagaagtgtgcactggtaccagcagaagccaggccaggcccctntgatgatcgtctatgatgatagccggaccggccctgagggactcccgtgacgcggagtcgcgtcggctaccaacgtcgtggaccaaccgccgggcccacccgtggacccagtcgacggacgagggtacgaacgggcggggatcgggacggtaccgacttagttacgtgtacgagggtggtagggataaggtggtaggtagacgttcgtacgttccgggttacgttccggggacgggtacgggtaaccgtaaggttaccggtaaccggttacccgtaaacggttccgaaccggtacccgtaacgggtccgtaccccggtccccccgttaccgggtacccctacccggtttcccccggttacccccgcccccttcccgtacccgtaccttaccccg

SEQ ID NO: 157385 - DNA, 739 bp, Homo sapiens
  misc_feature: GYAE6OF01C4TWJ.43.19.B08.1.454.CMB.1.raw
tcagtgtgagtagtcacgaccggtgctcgatttagtgagtcagtaaggggctgggcctaaggaagcagcactggtggtgcctcagccatggcctggaccgttctcctcctcggcctcctctctcactgcacagggtcggtgacttcctatgtgctgactcagccaccctcggtgtcagtcggccccaggaaagacggccaggacttaccgtggtacgggggaaccaacagttaggaagaagaagtgtgcactggtaccagcaagaacgccgacggcctacggcccctcgtagagtgacttcgtactatgtataggataggccgacccggccctacgacgggactcccgtagacgcggacgtcgcgtacggctaccgaacgtcgtcggaccaaccgacccggcccaacccgtcggaccctacgtcgaacggcggaacgggtaccggaacgggcccggggaagtcgggacggtaccggtaacttaagttacgtcgtaccggtagggttggtaacgggtaataaaggttggggttggtagtaacgtccgtacgttcccgggttcgttacggggacgggtaacgggaaccgttaacgggttaccggaaaccgtttaccgtaacggttacccgaacggtaaccccggaacgggttccccgccccggtccccccggttccggtaccgtaccccgttcccggttacccgttaccccccgtaccccttccgtccccgttaaaccccg

SEQ ID NO: 157386 - DNA, 702 bp, Homo sapiens
  misc_feature: GYAE6OF01BDC0D.43.19.B08.1.454.CMB.1.raw
tcagtgtgagtagtcacgaccggtgctcgatttagtgagtcagtaaggggtggcctaaggaagcagcactggtggtgcctcagccatggcctggacccgttctcctcctcggcctcctctctcactgcacgagggtcggtgacttcctatgtgctgactcacgcccacccgtcggtgtcaggtcggaccccgaggaaacgaccggaccgaggtactttaccgtgggtacgggggaaccaacgtagttagggaaagaaaggtaagttgtagacacgtacggtaccagacaggaacgccgaggcccacggcccctgtagatgacttcgtactagtgtagtagaacgtacggcccggtacccggcccgtacggacgggtacctcccgtaggacggaccggtacgtccggacgtcggccctaccgtaacgtcgtacggaccaaccgccggaccccaccggtcggacctacgtcgacggacggacggggtaccggaacggggccgggtagcggacggtaccgtaacttagtcgtggtacggtgggtagtacggtatacggtggtggacgtataccgtcggtcggtaccggtcgggacgggtacggtacctagggtactacccgtacgtagccgaccgtaccgacggtccctacccggcccgtcgtacctcccgttccttccccgtaccccacctcctcctcctaccg

SEQ ID NO: 157387 - DNA, 673 bp, Homo sapiens
  misc_feature: GYAE6OF01A32L1.43.19.B08.1.454.CMB.1.raw
  modified_base (173)..(173): a, c, t, g, unknown or other
  misc_feature (173)..(173): n is a, c, g, or t
  modified_base (454)..(454): a, c, t, g, unknown or other
  misc_feature (454)..(454): n is a, c, g, or t
  modified_base (484)..(484): a, c, t, g, unknown or other
  misc_feature (484)..(484): n is a, c, g, or t
  modified_base (517)..(517): a, c, t, g, unknown or other
  misc_feature (517)..(517): n is a, c, g, or t
tcagtgtgagtagtcacgaccggtgctcgatttagtgagtcagtaaggggtggcctaaggaagcagcactggtggtgcctcagccatggcctggaccgttctcctcctcggcctcctctctcactgcacagggtcggtgacttcctatgtgctgactcagcccaccctcggtntcagtcggccccaggaacgacggccgaggacttaccgtggtacggggaaaccaactagttaggaaagaagaagtgtgactacgtggtaccagacagaacgccgaggcccgacggccccttcgtacgattcgattcgtactagtgatggatacggaccggacccggtcccgtacgaacggtactcccgtaggacgccgaggtccgcgtcggcctaccgactcgtacgaccaccgaccggccctacccgtcggacctactcgacggcgacgggtcgaacgggngggaatccggaggccgtaacttacttacgnggtacgtaggtgtagggataggtcgggtgagtntaccgtacgtccggtcggtacggacgggtacggaccttaggtaccggtaccgttaccgtaaggtccgtaacccgaccggttacggccgtacccgtccccgttcggtacctaccgttcccgttacccgtacccctaccctcctaccgtaccgtaccc

SEQ ID NO: 157388 - DNA, 671 bp, Homo sapiens
  misc_feature: GYAE6OF01C8PFL.43.19.B08.1.454.CMB.1.raw
tcagtgtgagtagtcacgaccggtgctcgatttagtgagtcagtaaggggctgggcctaaggaagcagcactggtggtgcctcagccatggcctggaccgttctcctcctcggcctcctctctcactgcacagggtcgtgacttcctatgtgctgactcacgcccacccgtcggtgtcgaggtccggaccccgaagggaaacgcggccagggtacttaccgtgggtacggggaaaccaagtagtagggaaagaagaagtgtgcacgtgtaccgagacgagaacgccgacggccacggcccctgtagatcgactcgtactagtgtaagtcgagtacgaccggacccgcccgtaggagggtacctccgtaggacgtacgacggtcgaccgtcggacctacccgaatccgacggaccaaccggacccgacccaccggtcggaccctagtacgacgggcggtacggggtaccggacgggaccgggagtacgggacggaccgtacgttacgttacgtacgtacggtagtcggtaggtagtagtggtggtgacgtacgtcgtcggtcgtacgggtacggacggacgtaacggtcgacgtacgtacgaccgacgaccgacggccgtcccgtcccgtacggtcctaccgttccgtccgtcccgccttccgacctacccg

SEQ ID NO: 157389 - DNA, 796 bp, Homo sapiens
  misc_feature: GYAE6OF01B6K23.43.19.B08.1.454.CMB.1.raw
tcagtgtgagtagtcacgaccggtgctcgatttagtgagtcagtaagggtggcctaaggaagcagcactggtggtgcctcagccatggcctggaccgttctcctcctcggcctcctctctcactgcacagggtcggtgacttcctatgtgctgactcacgcccaccctcggtgtcagtcggccccaggaaacgacggccaggacttaccgtaggtacgggggaaacccaactagttaggaaagaagaagtgtgaccacgtggtaaccagcaaggaacgccgacggcccacggccccctacgtgacgtgactcgtactatgtatgtagtaccggccggacccggtccctacgacgggtactcccggagacggacggacgtccgcgtacggcccttacccgaacgtccgtacggaccgaaccgacccgggccccaacccggttcgacccgtacgtacgaacggaccggtacggggtaaccggaacggggcccggggtaacgtacgggaaccgggtaccccgtaaacgtttacgttaccgtacgggttaccggtacggggttagtacggggtaagtaacggttgggttaccggtagtacgtacgtaccggttccgggttacggtttcgggaacccgggtaagggttaaccccggttaaggttccgaaccccggttacgtaacccggttcgacccgtaaccccgggtaaggtccccgtacccgggtccccgtccggttccgtacccgtttcccgtccccgttaaccccctaccccgttccttacccgtaactttaccccg

SEQ ID NO: 157390 - DNA, 739 bp, Homo sapiens
  misc_feature: GYAE6OF01DS0NC.43.19.B08.1.454.CMB.1.raw
  modified_base (350)..(350): a, c, t, g, unknown or other
  misc_feature (350)..(350): n is a, c, g, or t
tcagtgtgagtagtcacgaccggtgctcgatttagtgagtcagtaaggggctgggcctaaggaagcagcactggtggtgcctcagccatggcctggaccgttctcctcctcggcctcctctctcactgcacagggtcggtgacttcctatgtgctgactcacgcccacccgtcggtgtcgagtcggccccaggaaagaccggccaggacttaccgtggtcgggggaaaccaacgtaagttggaagaagaagtgtgcactggtaccagcagaagccaggccaggcccctctagatgatcgtctatgatgatagccgaccggccctcgagggactccctgacgcgtagccgngtcggctacccaactcgtcggaccaacgaccggacccacccgtaggccctaacgtcacggcgacgggtacgaacgggccggggagtaggaacgggcccgtaaacgttacgttaacgttggtacgtaggggttcgggtagggtaagtttaaacggtggggtttagggtaagtacgtttaccgtaacggttcccgggtttaccgttaccgggggtacggggtaaccgggaaccgttaacgggttcggaaccccgttaaccgttaaccgtaccgtaccgggaaccccgtaaacgggtccccgttaccggtccccccccggttacgggtacccctacccggttaccccgtttaccggttcccccccgtcccccttcccgtacccgttaccccg

SEQ ID NO: 157391 - DNA, 286 bp, Homo sapiens
  misc_feature: GYAE6OF01BQT9Z.43.19.B08.1.454.CMB.1.raw
  modified_base (232)..(236): a, c, t, g, unknown or other
  misc_feature (232)..(236): n is a, c, g, or t
  modified_base (238)..(286): a, c, t, g, unknown or other
  misc_feature (238)..(286): n is a, c, g, or t
tcagtgtgagtagtcacgaccggtgctcgatttagtgagtcagtaaaggggaaagggggagagactgaagaacccagcattgcagcagcctccaccatggcctggctcctctgcctcctcaccctcctcagtctcctcacaggtcacgcccaaggctcgccccctggtaccactctgttccccgccctcctcactactcacactggagcgggctggcaaggcgacaataagnnnnngnnnnnnnnnnnnnnnnnnnnnnnnnnnnnnnnnnnnnnnnnnnnnnnnn

SEQ ID NO: 157392 - DNA, 786 bp, Homo sapiens
  misc_feature: GYAE6OF01B00NM.43.19.B08.1.454.CMB.1.raw
  modified_base (282)..(282): a, c, t, g, unknown or other
  misc_feature (282)..(282): n is a, c, g, or t
tcagtgtgagtagtcacgaccggtgctcgatttagtgagtcagtaaggggcgtgggcctaaggaagcagcactggtggtgcctcagccatggcctggaccgttctcctcctcggcctcctctctcactgcacagggtcggtgacttcctatgtgctgactcagccaccctcggtgtcagtcggcccaggaaagacggccaggacttaccgtggtagggggaaccaacattaggaagaagaagtgtagcactggtaccagcagaacgccaggccaggcccctntgatgatcgtctatgatgatacggccgacccggccctcgacggactcccgtagagcgagtcgcgtggcctccaactcgtacgggacccaaccgaccgggcccaaccccgtggaccctaactccacggacgtacgggggtaccgaacgggccggggtatacgggacgggtacccgtaaccgttaagtttacgtcggttacgtaacgggttggttacggggtaagttaaaggttcggggttaggttacgtaacgttacgtacgtttacccgggttaccggttaccggggtaccggggtaacggggtaaacccgttaacggggtttacccggtaaccccggttaaccgttaaacgggttacccgaaaccgggtaccccggttaaaacgggggtccccttaccccgggtcccccccccgtttaccggggttacccccttacccggtttacccttcccgggtttacccccccctccccccgtttacccccgttaccccgttaaaccccg

SEQ ID NO: 157393 - DNA, 712 bp, Homo sapiens
  misc_feature: GYAE6OF01ETU5J.43.19.B08.1.454.CMB.1.raw
  modified_base (307)..(307): a, c, t, g, unknown or other
  misc_feature (307)..(307): n is a, c, g, or t
  modified_base (562)..(562): a, c, t, g, unknown or other
  misc_feature (562)..(562): n is a, c, g, or t
  modified_base (654)..(654): a, c, t, g, unknown or other
  misc_feature (654)..(654): n is a, c, g, or t
  modified_base (701)..(701): a, c, t, g, unknown or other
  misc_feature (701)..(701): n is a, c, g, or t
tcagtgtgagtagtcacgaccggtgctcgatttagtgagtcagtaaggggctgggcctaaggaagcagcactggtggtgcctcagccatggcctggaccgttctcctcctcggcctcctctctcactgcacgagggtcggtgtacttcctatgtgctgactcacgcccacccgtcggtgtcaggtcggaccccgaaggaaacgacggccaaggtacttaccgtgggtacgggggaaaccaacgtagttaggaaagaaagaagtgtgacacgtggtaccagacaagaacgaccgaggccacggccctntacgatcggaattcggtactagtagtacgtaggaagtacgggacccggaccccggacccttacggaacggggtaccttcccgtaggacggtacggtacgtccgacgtcggtacctactaacgtcgtacgaacgaaacccgcggacccctaccgtacggaccatcgacggtacggacgggtacggaacgggacgggtagtacggacggtacctaacgttagtactggacgtagggttggaacgggtaatttacggngggtaggtactagttacgacggttccgggtaccggtcggggaacgggaacgggtaaccgttagtacccggtacgttaaccgagtaccgaacncccggtaagccctccgtccccgttagcctaccgtcttcccctacccnccttcacctac

SEQ ID NO: 157394 - DNA, 606 bp, Homo sapiens
  misc_feature: GYAE6OF01EQ7TQ.43.19.B08.1.454.CMB.1.raw
  modified_base (344)..(344): a, c, t, g, unknown or other
  misc_feature (344)..(344): n is a, c, g, or t
  modified_base (356)..(356): a, c, t, g, unknown or other
  misc_feature (356)..(356): n is a, c, g, or t
  modified_base (379)..(379): a, c, t, g, unknown or other
  misc_feature (379)..(379): n is a, c, g, or t
  modified_base (591)..(591): a, c, t, g, unknown or other
  misc_feature (591)..(591): n is a, c, g, or t
tcagtgtgagtagtcacgaccggtgctcgatttagtgagtcagtaaggggtggcctaaggaagcagcactggtggtgcctcagccatggcctggaccgttctcctcctcggcctcctctctcactgcacagggtcggtgacttcctatgtgctgactcagccaccctggtgtcagtcggccccaggaaagacggccaggattaccgtggtagggggaaccaacagttggaagaagaagtgtgcactggtaccagcagaacgccaggccacggccctcgtgatgatccgtatagtgatagatacggccgacccggccctgacggactccgtgacgcgagtcgcgngctaccactcgngaccacgaccgccaacgtcgcancagcgaggtgaacggccgggatggacgccgtaacttagtacgtgtacgaggttcggtaggtaactaggttggtagtgtactcgtacgttccggtgtccgggaggtacgggactaagttcgacccgtacgtaagtccgaccggaccctaagggcctcccggtaccccctcggtcccgaaccgttcccgtcccgttccccggacccctttaccnccgtacccttacccg

SEQ ID NO: 157395 - DNA, 838 bp, Homo sapiens
  misc_feature: GYAE6OF01BC6K0.43.19.B08.1.454.CMB.1.raw
  modified_base (457)..(457): a, c, t, g, unknown or other
  misc_feature (457)..(457): n is a, c, g, or t
tcagtgtgagtagtcacgaccggtgctcgatttagtgagtcagtaaggggctgggcctaaggaagcagcactggtggtgcctcagccatggcctggaccgttctcctcctcggcctcctctctcactgcacgaggggtcgtgacttcctatgtgctgactcacgcccaccgtcggtgtacacggtcggacccgaaggaaacgaccggccgaggacgttaccgtgggtacggggaaccaagtacgtaggaaagaagtagtgtgacgacgtggtaccagagacggaacgccgaggccgacggccctgtaggatcgactcgtactagtacgtatacgtacgaccgccggtacccgtccgtacggaacgtccgtaccgtacggcgtacgaccggtcgacgtcggtacctacgtacgtcgacggaacgtacccgcccgacgtcgacgtacacgtcgtaacgngggtaccggacgggacggtcgggacgtacgggaccgtagttaaactggttaccgtacggtggggtaacgttaggggtacgggttaaatcggggttacgggtacggttacggtaaccctttcggggtacccggtttaccggggtccgggtttacccggggaaaacgggggttccccgtaaccggggttttaaaccggtcccgggtttaaacccgtaacggggtttacctaaacccggggacccgggttaaccccggttaccggtaccccgtttaccccccggggtaacccttacccggggtcccctttaaacccggtttaccccgtttaccccccgaacccccggttttcccccaaccggtttaaaaccccctttccccggg

SEQ ID NO: 157396 - DNA, 774 bp, Homo sapiens
  misc_feature: GYAE6OF01CNLK4.43.19.B08.1.454.CMB.1.raw
  modified_base (141)..(141): a, c, t, g, unknown or other
  misc_feature (141)..(141): n is a, c, g, or t
  modified_base (421)..(421): a, c, t, g, unknown or other
  misc_feature (421)..(421): n is a, c, g, or t
  modified_base (479)..(479): a, c, t, g, unknown or other
  misc_feature (479)..(479): n is a, c, g, or t
  modified_base (491)..(491): a, c, t, g, unknown or other
  misc_feature (491)..(491): n is a, c, g, or t
  modified_base (516)..(516): a, c, t, g, unknown or other
  misc_feature (516)..(516): n is a, c, g, or t
  modified_base (531)..(531): a, c, t, g, unknown or other
  misc_feature (531)..(531): n is a, c, g, or t
tcagtgtgagtagtcacgaccggtgctcgatttagtgagtcagtaaggggctgggcctaaggagcagcactggtggtgcctcagccatggcctggaccgttctcctcctcggcctcctctctcactgcacgagggtcggtnaccttctatgtgctgactcacgccctacccgtcggtcgtcgacggtccggaccccgaagggaaacgaccggaccgaaggtacttacccggtaggggtaacggggaaacccaacgtaaggttagggaaagtaaaggtaacggttggtcgacgacggttaacgggtaaccaacggacaaggaaccgcccgtaacggccgaccggtcccctcgtagatacgtacgcgttactacgtagagacggtacgacgtacccggaccccgtccgtacggaccggtaccnccggtaggaccggcgtacgccggtgtaccgctaccgtatcgacgacaccgcccgaccnccgcgacgtacncgaaggtcgacgggacggaaccggnggtacgaggacccgngtaaacgtttcgacggtacgtgggtaagggtgttaacgggaatacgggtggtctacggacctcgggtacctttccggggaccgttagggggaccggttaaccggtaaccggttagttccgaaaccgttcggtaaagtcccggaaccccgtaacgacccggtccccgtaacccgggttccccgtaacgttacccgttcccgtttacccgtacccccgtacctttcccccggaatccccgtaacc

SEQ ID NO: 157397 - DNA, 660 bp, Homo sapiens
  misc_feature: GYAE6OF01CQLOY.43.19.B08.1.454.CMB.1.raw
  modified_base (308)..(308): a, c, t, g, unknown or other
  misc_feature (308)..(308): n is a, c, g, or t
tcagtgtgagtagtcacgaccggtgctcgatttagtgagtcagtaaggggtggcctaaggaagcagcactggtggtgcctcagccatggcctggaccgttctcctcctcggcctcctctctcactgcacagggtcggtgactcctatgtgctgactcagccaccctcggtgtcagtcggccccaggaaacgcggccaggacttaccgtggtacgggggaaccaactagttacgggaaagaagtaaggtgtgacacgtggtaccaggacagaacgccgaggccacggcccctagtgatgatcgtatagngatgatcggcgacccgtccgacgacggactccgtaggacgccggagtccggtcgtcggactaccgtacgtctacggaccaccgacgccccaccgttcggacctagtaccgagacggtagggaccgtacgggacgggtatacggacggtacctaacgttacgttaacgtgtaccggtagttagggtacggtaagtaacggtggtagtcgtaactctacggtccggtacgttcgggacggtacgggtaactacgggttacgtccgtaacgtacgaccgtaccgaccgtacggccctaccggccccgttgaccctccgtaccgttcccgtaccccgtcctcctcgtcctaacccg

SEQ ID NO: 157398 - DNA, 794 bp, Homo sapiens
  misc_feature: GYAE6OF01AO3E5.43.19.B08.1.454.CMB.1.raw
tcagtgtgagtagtcacgaccggtgctcgatttagtgagtcagtaagggcgtgggcctaaggaagcagcactggtggtgcctcagccatggcctggaccgttctcctcctcggcctcctctctcactgcacgagggtcgtgacttcctatgtgctgactcacgccaccgtcggtgtcgaggtcgccccgaaggaaacgacggccaggacttaccgtggtacggggaaccaacgagttaggaaagaagaagtgtcgacgacgtacggtaccagaccaaggaacgccgacggaccaccgggcccctacgtgatgacttcgtacgtaagtagagtaggacgtacggcccggacccggtcccgtacggaggtacctcccgtaggacgtcggacgtccggcgttacggacctaccgaacttccgacggaacccgaaccggacccgacccgtacccgtacggaccctacgtaccgaggtaccggaacgggtaccggaaccggggtaccgggagtaccgggaacggtacccggtaactttacgttacgtacggtacggtaaggggttacggagggtaacgttagggttgggttacggttacgtaaccgttacgtacggttcccggggtttactaccgggggaacgggtaccgggtaaccgttaacggttacccggtaacccgttaagtacggtaacccgaaccgggaccccgtacggcccgttaccccggtccccgtaccggtacccacccggtttaccgttccccggttaccccccgccctttacccggtcccctaaccg

SEQ ID NO: 157399 - DNA, 747 bp, Homo sapiens
  misc_feature: GYAE6OF01CIB09.43.19.B08.1.454.CMB.1.raw
  modified_base (738)..(738): a, c, t, g, unknown or other
  misc_feature (738)..(738): n is a, c, g, or t
tcagtgtgagtagtcacgaccggtgctcgatttagtgagtcagtaaggggctgggcctaaggaagcagcactggtggtgcctcagccatggcctggaccgttctcctcctcggcctcctctctcactgcacagggtcggtgacttcctatgtgctgactcagcctaccctcggtgtcagtcggccccaaggaaacgcggccaggtattaccgtggtacgggggaaccaactagttagggaaagaaggaagtgtgctacgtggtaccagcagaagcccgaacggcccaccggtcccctgtaggtactgacgttccggtacctagttgactttaggaacgtaccggacccggtaccccgggcccctacggaaccgggggtaacctcccgggtacggacgggtaccgtacggttccggcgttccggaccctaccgtaaccgtcggtaccggaaccaacccggcccggtacccacccggtcggacccataccgaggtcggacggggtaccggaacgggccggggagttacgggaccgggtaccgtaactttacggttacgtggtcggtaaggggtcggttagggtaagttaggtgggttggtaggtacctttcggtaccgttccgggttcggtaccgggacgggtaacggtaccgttaggtaccgtaccgtaccgtacgccgacgacccggtacgccgtcccgaccccgtcggtcccacgtccttcccgttcccgccccttnccccgtaac

SEQ ID NO: 157400 - DNA, 940 bp, Homo sapiens
  misc_feature: GYAE6OF01A5209.43.19.B08.1.454.CMB.1.raw
tcagtgtgagtagtcacgaccggtgctcgatttagtgagtcagtaaggggctgggcctaaggaagcagcactggtggtgcctcagccatggcctggaccgttctcctcctcggcctcctctctcactgcacgagggtcggtgacttcctatgtgctgactacacgccctacccgtcggtgtctaggtcggaccccgaagggaaacgaccggaccgaaggtaacgttaccgtgggtacgggggaaacccaacgtaagtttagggaaaagaaaggtaaaggtggtagaccgtacgttacggtaccagacgaaaggaacgaccgacgggaccgaccgggacccctccgtagactcgtaacgtccggttactaagtgtagttacgaagtacggtaccggaccccggcccgttacggacgggtacctacccgtaggacggtaccgacggttccggcgtacggtaccgtacctaacgtcgtacggaccaaccggacccgacccgtaccggtacggaccctacgtccgaacggtacgggaacgggtaaccggggaaccgggtccggggtaacgtacggggtaaccgggtacccttaaagtttaccgttaggtaccggttacgacggggtttcgggtaaggggttaactttacggggttacggggttaagggttacgttaaacgttaccgggaccgttttacccgggggttacgggtttaccgggggaccggggtaagggtaaccccggttaaagtttacccgggaaccccggttttaaaccgtaaacgggtacccggtaacccggggtaacccccggaagggtttaccccccgacccccggggttcccccctaacccggggtttaccctaacccccgttttaccccttttaccccccgggttaaacccccccttaccccggtttcccccggtttaaaacctcccccg

SEQ ID NO: 157401 - DNA, 754 bp, Homo sapiens
  misc_feature: GYAE6OF01BI9QP.43.19.B08.1.454.CMB.1.raw
tcagtgtgagtagtcacgaccggtgctcgatttagtgagtcagtaaggggtggcctaaggaagcagcactggtggtgcctcagccatggcctggaccgttctcctcctcggcctcctctctcactgcacagggtcggtgacttcctatgtgctgactcagccaccctcggtgtcacgtggcccaggaaagacggccaggacttaccgtggtagggggaaccaacattaggaagaagaagtgtgcactggtacagcagagaccgaggccacggcccctctgatcgatcgtactagtacgagtgatacggacgacccggtcccgtcggacgggtactacccgtaggacgacggacggtccggtacgttcggaccctaccgtaacgtcgtacgggacccaaaccgaccggtaccccacccgtcggacccacgttaccgacggaccggagggggtacccggaacggggtacccggggagtaccgggaacggtacccgtaacgttaacgttacgtcggtaccggtagggttggacgggttaaagttaacgttgggtcggtaagtacgtcgtacggtccgggttactacggggtaccgggaacgggtaccgtacggtttacgggaacccgtttaccgtaacggtcctaaccggacccgtaaacggcccgttacccggtacccccggttccggtacccttaacccggttcccgttaacccctttccccctaacccgttcccttaccgtaccccgttaaccc

SEQ ID NO: 157402 - DNA, 775 bp, Homo sapiens
  misc_feature: GYAE6OF01DWSSA.43.19.B08.1.454.CMB.1.raw
tcagtgtgagtagtcacgaccggtgctcgatttagtgagtcagtaaggggtgggcctaaggaagcagcactggtggtgcctcagtccatgggcctggaccgttctcctcctcggcctcctctctcactgcacgagggtcggtgacttcctatgtgctgactcgacgccctacccgtggtgtcaggttcggccccaagggaaacgaccggccgaggtacttacccgtgggtaacgggggaacccaacgtagttaggggaaagtaaaggtaaggttcggttcggaccgtacgttaccgggtaaccacggcaaggtacgaccgacggcccacgggtccccctgtacgacgttcgaattcggtactagtgacgttacgagtacggcccggtacccggtcctacggaacggccttccgtaggacggcggtacgtccgacggtcggtacctaccgtaactcggacgtaccaaacgtccgtaccgacccgtggactacgtcgagtacggtagggtaccgcggacggtacgtcggaacgcgtatacgttacgtgtacgtacggtggacgtaacgttaggtcggttaggacgtacgtcgttaaccggtcgttaccgggtcgggaaccgggttacggtaaccgttacggttacccggtaccgttacgttaacccggtccctaacggtacccggtaaccgtcccggttacccctaacccgggttacccgtaccgtacccgttacgttcccgttaaccccctcccgttacctccgtaacctacccgg

SEQ ID NO: 157403 - DNA, 750 bp, Homo sapiens
  misc_feature: GYAE6OF02H4161.43.19.B08.1.454.CMB.1.raw
  modified_base (459)..(459): a, c, t, g, unknown or other
  misc_feature (459)..(459): n is a, c, g, or t
tcagtgtgagtagtcacgaccggtgctcgatttagtgagtcagtaagggtggcctaaggaagcagcactggtggtgcctcagccatgggcctggaccgttctcctcctcggcctcctctctcactgcacagggtcggtgacttcctatgtgctgactcagccaccctcggtgtcagtggccccaggaaagacggccaggattacctggtgggggaaccaacattggaagaagaagtgtgcactggtaccagcagaagccgaggccacggcccctctgatgatcgtctatgatgataggccgaccggccctcgacgggactcccgtgacgcgacgtcgcgtcggcctccaactcgtcggaccaaccgaccggcccacccgtggccctagtcgacggccggtaacggggtaccggaaacggggccgggggtatcgggacggtaccgtaacgttatttacgnggtaccggtagggttcgggtaaggggttaacttaaggggttgggttaggttacgtacgttccggttaccggttcccgggtttaccggttaccgggggaccggggtaaccggggtaaccgttaacgggtttcccggaaaccccggtttaccgtaaccgggtacccgaccggtaccccggaacgggtccccgttaccccgggtccccccggttacgggttaccctaacccgtttcccgttaccccggtttaccccccttaacccccttccccttacccgtacccttaaccccg

SEQ ID NO: 157404 - DNA, 517 bp, Homo sapiens
  misc_feature: GYAE6OF02IC7XF.43.19.B08.1.454.CMB.1.raw
  modified_base (440)..(440): a, c, t, g, unknown or other
  misc_feature (440)..(440): n is a, c, g, or t
  modified_base (507)..(507): a, c, t, g, unknown or other
  misc_feature (507)..(507): n is a, c, g, or t
tcagtgtgagtagtcacgaccggtgctcgatttagtgagtcagtaaggggctgggcctaaggaagcagcactggtggtgcctcagccatggcctggaccgttctcctcctcggcctcctctctcactgcacagggtcggtgacttcctatgtgctgactcagccaccctcggtgtcagtggccccaggaaagacggccaggattacctgtgggggaaccaacattggaagaagaagtgtgcactggtaccagcagaagccaggccaggcccctctgatgatcgtctatgatgatagcgaccggccctcagggatccctgacgcgagtcgctggctccaactctggcaacacggccacctggccatcagcaggtcgaagccgggatggaggccgactatacgtgtcgaggtgtggataagtgggtgtgatcgattccggtnttcggcggagggacctaagtcgaccgtctaagtcacgccaaggctcgcccctgtcactctcgtcccncctctctacc

SEQ ID NO: 157405 - DNA, 541 bp, Homo sapiens
  misc_feature: GYAE6OF02IP046.43.19.B08.1.454.CMB.1.raw
tcagtgtgagtagtcacgaccggtgctcgatttagtgagtcagtaaggggctgggcctaaggaagcagcactggtggtgcctcagccatggcctggaccgttctcctcctcggcctcctctctcactgcacagggtcggtgacttcctatgtgctgactcagccaccctcggtgtcagtggccccaggaaagacggccaggattacctgtgggggaaccaacattggaagaagaagtgtgcactggtaccagcagaagccaggccaggcccctctgatgatcgtctatgatgatagcgaccggccctgagggatccctgacgcgagtcgctggcctccaactctggcaacacggccacctggccatcagcagggtcgaaggcccggggatggaggccgactacttactgtcgaggtgtgggattaagtggtggtgatcatccggttcgttcgggcggtagggacctaagtcgacctcgtacgtcacgacccgaaggcctcggcccctcggtcacctcgtcgttccccacccttcctctacc

SEQ ID NO: 157406 - DNA, 567 bp, Homo sapiens
  misc_feature: GYAE6OF02HDA3I.43.19.B08.1.454.CMB.1.raw
  modified_base (350)..(350): a, c, t, g, unknown or other
  misc_feature (350)..(350): n is a, c, g, or t
tcagtgtgagtagtcacgaccggtgctcgatttagtgagtcagtaaggggctgggcctaaggaagcagcactggtggtgcctcagccatggcctggaccgttctcctcctcggcctcctctctcactgcacagggtcggtgacttcctatgtgctgactcagccaccctcggtgtcagtggccccaggaaagacggccaggattacctgtgggggaaccaacattggaagaagaagtgtgcactggtaccagcagaagccaggccaggcccctctgatgatcgtctatgatgatagcgaccggcctcgagggactccctgacgcgagtcgctggctcaactctggcaacncgccacctgccatcagcagggtcgaagcgggatggaggccgatatacgtgtcgaggtgtgggataagtgggtggtgagtcagttcccgggttcgttcgggcgggacgggacccgtaaggttcggaaccgttccgtaagtcgaacgccccgaagggcctccggtcccccgtcggttcccaccgttccttccgttcccccacccgttcccgtactaccc

SEQ ID NO: 157407 - DNA, 525 bp, Homo sapiens
  misc_feature: GYAE6OF02F3A1A.43.19.B08.1.454.CMB.1.raw
  modified_base (502)..(502): a, c, t, g, unknown or other
  misc_feature (502)..(502): n is a, c, g, or t
  modified_base (514)..(514): a, c, t, g, unknown or other
  misc_feature (514)..(514): n is a, c, g, or t
tcagtgtgagtagtcacgaccggtgctcgatttagtgagtcagtaaggggctgggcctaaggaagcagcactggtggtgcctcagccatggcctggaccgttctcctcctcggcctcctctctcactgcacagggtcggtgacttcctatgtgctgactcagccaccctcggtgtcagtggccccaggaaagacggccaggattacctgtgggggaaccaacattggaagaagaagtgtgcactggtaccagcagaagccaggccaggccccctctgatgatcgtctatgatgatagcgaccggccctcagggatccctgagcgagtcgctggctccaactctggcaacacggccacctggccatcagcgagggtcgaaggccgggatggaggccgactacttactgtcgaggtgtggataagtgggtggtgatcgagtccggtcgttcggcggaggacgtaagtcgaccgtcctagtcagccgaaggctcgcccctcgtcncgtctcgtcccncctcctctacc

SEQ ID NO: 157408 - DNA, 513 bp, Homo sapiens
  misc_feature: GYAE6OF02GRW0K.43.19.B08.1.454.CMB.1.raw
  modified_base (273)..(273): a, c, t, g, unknown or other
  misc_feature (273)..(273): n is a, c, g, or t
  modified_base (350)..(350): a, c, t, g, unknown or other
  misc_feature (350)..(350): n is a, c, g, or t
  modified_base (509)..(509): a, c, t, g, unknown or other
  misc_feature (509)..(509): n is a, c, g, or t
tcagtgtgagtagtcacgaccggtgctcgatttagtgagtcagtaaggggctgggcctaaggaagcagcactggtggtgcctcagccatggcctggaccgttctcctcctcggcctcctctctcactgcacagggtcggtgacttcctatgtgctgactcagccaccctcggtgtcagtggccccaggaagacggccaggattacctgtgggggaaccaacattggaagaagaagtgtgcactggtaccagcagaagccaggccaggcccctntgatgatcgtctatgatgatagcgaccggccctgagggactcccgtgagcgagtcgctggctccaactctggcaacncggccacctgccatcagcagggtcgagccgggatggaggccgatatacgtgtcaggtgtggatagtggtgtgatcgagtccggtcgttcgggcggtacgggactaaggtcgaccgtactagtcacgccgaaggctcgccctgcactctcgtcccgctcnctac

SEQ ID NO: 157409 - DNA, 586 bp, Homo sapiens
  misc_feature: GYAE6OF02J1T22.43.19.B08.1.454.CMB.1.raw
  modified_base (446)..(446): a, c, t, g, unknown or other
  misc_feature (446)..(446): n is a, c, g, or t
  modified_base (579)..(579): a, c, t, g, unknown or other
  misc_feature (579)..(579): n is a, c, g, or t
tcagtgtgagtagtcacgaccggtgctcgatttagtgagtcagtaagggcgtgggccgtaaggaagcagcactggtggtgcctcagccatggcctggaccgttctcctcctcggcctcctctctcactgcacagggtcggtgacttcctatgtgctgactcagccaccctcggtgtcagtggcccccaggaaagacggccaggattacctgtgggggaaccaacattggaagaagaagtgtgcactggtaccagcagaagccaggccaggcccctctgactgatcgtctatgatgatagcgaccggaccctcagggatccccgtgacggcgagtcgctggcctccaactctcggcaacacggccacctcgggccatcgagcctagggcggaagcccggggatggacggcgacgtatacgtgtagaggtgtcgggataagtggtggngtagtacagttaccggtcgttcgggcggtagggaacctaaggttcggacgttaccgtagtccacggtacccgtaagggccttacgacccccgttggaccctacttcctcggtttacccccacccttccccgtntaccccg

SEQ ID NO: 157410 - DNA, 567 bp, Homo sapiens
  misc_feature: GYAE6OF02GCE5J.43.19.B08.1.454.CMB.1.raw
  modified_base (418)..(418): a, c, t, g, unknown or other
  misc_feature (418)..(418): n is a, c, g, or t
  modified_base (556)..(556): a, c, t, g, unknown or other
  misc_feature (556)..(556): n is a, c, g, or t
  modified_base (563)..(563): a, c, t, g, unknown or other
  misc_feature (563)..(563): n is a, c, g, or t
tcagtgtgagtagtcacgaccggtgctcgatttagtgagtcagtaaggggctgggcctaaggaagcagcactggtggtgcctcagccatggcctggaccgttctcctcctcggcctcctctctcactgcacagggtcggtgacttcctatgtgctgactcagccaccctcggtgtcagtggccccaggaaagacggccaggattacctgtgggggaaccaacattggaagaagaagtgtgcactggtaccagcagaagccaggccaggcccctctgatgatcgtctatgatgatagcgaccggccctcgagggactcccgtgagcggagtcggctagggcctccaactcgtggacaacgacggccacctggaccatcacgcagggtcgaaggccggggatcgggagggcccgtaactnttaacgttggtcgaagggttcgttagggacttaagtgggtggtgagtcgagttcccggtgtcgggcgggacgggacctaggttcgaccgtcgtaagcacggccgaaggcctccgcccgttcgcactccgtcttccccnccttccnctac

SEQ ID NO: 157411 - DNA, 580 bp, Homo sapiens
  misc_feature: GYAE6OF02G4NEI.43.19.B08.1.454.CMB.1.raw
tcagtgtgagtagtcacgaccggtgctcgatttagtgagtcagtaaggggctgggcctaaggaagcagcactggtggtgcctcagccatggcctggaccgttctcctcctcggcctcctctctcactgcacagggtcggtgacttcctatgtgctgactcagccaccctcggtgtcagtggccccaggaaagacggccaggattacctgtgggggaaccaacattggaagaagaagtgtgcactggtaccagcagaagccaggccaggcccctctgatgatcgtctatgatgatagcgaccggccctcgagggactccctgacgcgagtcgctggctccaactctggacaacgacgccaccctggccatcagcgagggtcgaaggccgggatggacggccgactatacgtgtcgaggtgtgggattagtggtgtgatcgagttccggtcgttcgggacggtacgggacctaagggttcgaacccgttccgtaagtccgacggacccgaaagggtcctaccggtccccccgttcggtcctaccgttccgttccggttcccccgccccttccctcctaaccc

SEQ ID NO: 157412 - DNA, 530 bp, Homo sapiens
  misc_feature: GYAE6OF02FQ6T8.43.19.B08.1.454.CMB.1.raw
  modified_base (274)..(274): a, c, t, g, unknown or other
  misc_feature (274)..(274): n is a, c, g, or t
tcagtgtgagtagtcacgaccggtgctcgatttagtgagtcagtaaggggctgggcctaaggaagcagcactggtggtgcctcagccatggcctggaccgttctcctcctcggcctcctctctcactgcacagggtcggtgacttcctatgtgctgactcagccaccctcggtgtcagtggccccaggaaagacggccaggattacctgtgggggaaccaacattggaagaagaagtgtgcactggtaccagcagaagccaggccaggcccctntgatgatcgtctatgatgatagcgaccggcctcagggatccctgagcgagtcgctggctccaactctggcaacacggccaccctggccatcagcagggtcgaagccggggatggaggccgactattactgtcaggtgtgggataagtgggtggtgagtcagtccggtcgttcggcggacgggacctaagttcgaccgtctaagtcagcccgaaggcctcggccccgtgtccactctcttccccaccctcctctacc

SEQ ID NO: 157413 - DNA, 564 bp, Homo sapiens
  misc_feature: GYAE6OF02F6XWR.43.19.B08.1.454.CMB.1.raw
  modified_base (275)..(275): a, c, t, g, unknown or other
  misc_feature (275)..(275): n is a, c, g, or t
  modified_base (350)..(350): a, c, t, g, unknown or other
  misc_feature (350)..(350): n is a, c, g, or t
tcagtgtgagtagtcacgaccggtgctcgatttagtgagtcagtaaggggctgggcctaaggaagcagcactggtggtgcctcagccatggcctggaccgttctcctcctcggcctcctctctcactgcacagggtcggtgacttcctatgtgctgactcagccaccctcggtgtcagtggccccaggaaagacggccaggattacctgtgggggaaccaacattggaagaagaagtgtgcactggtaccagcagaagccaggccaggccccctntgatgatcgtctatgatgatagcgaccggccctcagggatccctgagcgagtcgctggctccaactctggcaacncgccacctggccatcagcaggttcgaaggccgggatggaggccgtattacttacgtgtcgaggttgtgggattaagtgggtggtgatcgtagtccgggtcgttcgggcgggacgggtaccaaggttcggaaccgtccgtaagtccgacgcccgaaggtcctccggcccccgtcggtccacgttccgtccgttaccccacccttccctcctaccc

SEQ ID NO: 157414 - DNA, 644 bp, Homo sapiens
  misc_feature: GYAE6OF02HW8ID.43.19.B08.1.454.CMB.1.raw
  modified_base (437)..(437): a, c, t, g, unknown or other
  misc_feature (437)..(437): n is a, c, g, or t
tcagtgtgagtagtcacgaccggtgctcgatttagtgagtcagtaaggggctgggcctaaggaagcagcactggtggtgcctcagccatggcctggaccgttctcctcctcggcctcctctctcactgcacagggtcggtgacttcctatgtgctgactcagccaccctcggtgtcagtgccccaggaaagacggccaggattacctggtacgggggaaccaacagttggaagaagaagtgtgcacgtggtaccagcagaagccaggccaggccccctctgatgatcgtctatgatgataggccgacccggcctcgaggactcccgtggacgcggtagtcgcgtagggcctacccgaacttctggacaacaccggccacccgtgccatcagcgacgggtacgaacgggccgggagtcggacggcccgattattacgngtacgagggtgtagggtattaaggtggtggtacgagttcgtacgttccgggttaccgtttcggggacgggacgggtaacctaagggtttcgaacccgggttcgtaaacggttccaccggacccgtaacggtccctcccggtaccccccgttacgggtcctacccgttcgttacccgtttaccccctacccgttccctaccgtaaccc

SEQ ID NO: 157415 - DNA, 737 bp, Homo sapiens
  misc_feature: GYAE6OF02G8S2N.43.19.B08.1.454.CMB.1.raw
tcagtgtgagtagtcacgaccggtgctcgatttagtgagtcagtaaggggctgggcctaaggaagcagcactggtggtgcctcagccatggcctggaccgttctcctcctcggcctcctctctcactgcacagggtcggtgacttcctatgtgctgactcagccaccctcggtgtcagtggccccaggaaagacggccaggattacctgtgggggaaccaacattggaagaagaagtgtgcactggtaccagcagaagccaggccaggcccctctgatgatcgtctatgatgatagcgaccggccctcgacgggactcccgtgacgcgacgtcgcgtggcctaccaactcgtcggaccaaccgaccggcccacccgtcggacccacgtcacggccgaagggggtccggaaacgggcccgggggtaatcgggaacgggcccgtaacgttaacgttaccgtggttacgtagggttagggttacgggaagttaaaggttggggtagggtaggtacgttcgtacggttccccgggttcgtttcccgggggtaccgggtaacgggggtacccgtaaagggtttaccggaacccggtttacccgtaacggtacccgtaaccgggtacccccggaaacgggttccccgtacccgggtcccccccggttaccgggttacccacccggtttacccgtttcccggtttaccccccggtcccccttccccgttaccccgttaaccccg

SEQ ID NO: 157416 - DNA, 545 bp, Homo sapiens
  misc_feature: GYAE6OF02HUNLI.43.19.B08.1.454.CMB.1.raw
  modified_base (274)..(274): a, c, t, g, unknown or other
  misc_feature (274)..(274): n is a, c, g, or t
tcagtgtgagtagtcacgaccggtgctcgatttagtgagtcagtaaggggctgggcctaaggaagcagcactggtggtgcctcagccatggcctggaccgttctcctcctcggcctcctctctcactgcacagggtcggtgacttcctatgtgctgactcagccaccctcggtgtcagtggccccaggaaagacggccaggattacctgtgggggaaccaacattggaagaagaagtgtgcactggtaccagcagaagccaggccaggcccctntgatgatcgtctatgatgatagcgaccggccctcagggactccctgagcgagtcgctggctccactctggcaacacggccacctggccatcagcgagggtcgaagccggggatggacggccgactattactgtcgaggtgtgggataagtgggtgtgagtcagtccggtcgtcgggcgggtacggacctaaggttcgaccgtctaagtcacggcccgaaggcctcggcccccgtcggtccacctcgtccgttccccacccttcctactacc

SEQ ID NO: 157417 - DNA, 564 bp, Homo sapiens
  misc_feature: GYAE6OF02JNB2T.43.19.B08.1.454.CMB.1.raw
  modified_base (208)..(208): a, c, t, g, unknown or other
  misc_feature (208)..(208): n is a, c, g, or t
  modified_base (360)..(360): a, c, t, g, unknown or other
  misc_feature (360)..(360): n is a, c, g, or t
  modified_base (552)..(552): a, c, t, g, unknown or other
  misc_feature (552)..(552): n is a, c, g, or t
tcagtgtgagtagtcacgaccggtgctcgatttagtgagtcagtaagggctgggcctaaggaagcagcactggtggtgcctcagccatggcctggaccgttctcctcctcggcctcctctctcactgcacagggtcggtgacttcctatgtgctgactcagccaccctcggtgtcagtggccccaggaaagacggccagggattaccngtgggggaaccaacattggaagaagaagtgtgcactggtaccagcagaagccaggccaggcccctctgactgatcgtctatgatgatagcgaccggcctcgagggactcccgtagagcgacggtcgcgttcggcctccaactctaggcaacncggacccacccgtggcccatcacgcagggtcgaacggcccggggatcggacggccgtactagttaacgtgtacgacgggtgtacgggtataaggtcggtggttgacgtgacgttccggtcgttacggcggtaggaccgtaggtcgacgtactaagctagccgaaggctcgccctggtcacgtcgtcgtcccncctcgtactacc

SEQ ID NO: 157418 - DNA, 583 bp, Homo sapiens
  misc_feature: GYAE6OF02FSWNA.43.19.B08.1.454.CMB.1.raw
tcagtgtgagtagtcacgaccggtgctcgatttagtgagtcagtaaggggctgggcctaaggaagcagcactggtggtgcctcagccatggcctggaccgttctcctcctcggcctcctctctcactgcacagggtcggtgacttcctatgtgctgactcagtcaccctcggtgtcagtggccccaggaaagacggccaggattacctgtgggggaaccaacattggaagaagaagtgtgcactggtaccagcagaagccaggccaggccccctctgatgatcgtctatgatgatagccgaccggccctcagggactcccgtgagcgagtcgctggcctccaactctggcaacacgccacctggccatcagcagggtcgaacggccggggatggacggccgaactacgttacgtgtcaggtggtgggatagtgggtggtgatcagtccggtcgttcgggcggacgggtaccgtaagttcggaccgttaccgtaacgtcgacggacccgaaggtccctaccggtccccccgttcggtcctaccgttcccgttcccgttcccccgtcccttccctacctaacccg

SEQ ID NO: 157419 - DNA, 585 bp, Homo sapiens
  misc_feature: GYAE6OF02IVQEQ.43.19.B08.1.454.CMB.1.raw
  modified_base (275)..(275): a, c, t, g, unknown or other
  misc_feature (275)..(275): n is a, c, g, or t
  modified_base (354)..(354): a, c, t, g, unknown or other
  misc_feature (354)..(354): n is a, c, g, or t
tcagtgtgagtagtcacgaccggtgctcgatttagtgagtcagtaaggggctgggcctaaggaagcagcactggtggtgcctcagccatggcctggaccgttctcctcctcggcctcctctctcactgcacagggtcggtgacttcctatgtgctgactcagccaccctcggtgtcagtggccccaggaaagcggccaggattaccctgtgggggaaccaacattaggaagaagaagtgtgcactggtaccagcagaagccaggccaggcccctntgatgatcgtctatgatgatagcgaccggccctacgagggactcccgtgacgcgagtcgctgctcaactcgtggcaacncggccaccgtgccatcagcgagggtccgaaggccgggatcggaggccgattagttacgtgtacgaggttgtagggattaagtggtggtagtatcaacgttccggtcgttacgggacggtacgggaacctaaggttccgaaccgtaccgttaacggtccacggacccgaagggccctcggtccccctaggtccctacttcgttccgttacccccacccttccgtactaaccc

SEQ ID NO: 157420 - DNA, 565 bp, Homo sapiens
  misc_feature: GYAE6OF02HCBI6.43.19.B08.1.454.CMB.1.raw
tcagtgtgagtagtcacgaccggtgctcgatttagtgagtcagtaaggggctgggcctaaggaagcagcactggtggtgcctcagccatggcctggaccgttctcctcctcggcctcctctctcactgcacagggtcggtgacttcctatgtgctgactcagccaccctcggtgtcagtggccccaggaaagcggccaggattacctgtgggggaaccaacattggaagaagaagtgtgcactggtaccagcagaagccaggccaggccccctctgatgatcgtctatgatgatagcgaccggccctcagggactccctgcgcgagtcgctggctccaactcgtggcaacgaccggccacccgtggcccatcagcgagggtccgagccgggatggacggccgactagttactgtcgaggtgtggagtagtggtggtgtagtcgagtccggtcgttcgggcggacgggaccgaaggttcgacccgtaccgtaacgtcgacgcccgaacggcctccgtcccccgtcgtcctaccgtcctccgttcccccacccttccctacctaccc

SEQ ID NO: 157421 - DNA, 806 bp, Homo sapiens
  misc_feature: GYAE6OF02FJKUV.43.19.B08.1.454.CMB.1.raw
tcagtgtgagtagtcacgaccggtgctcgatttagtgagtcagtaaggggctgggcctaaggaagcagcactggtggtgcctcagccatggcctggaccgttctcctcctcggcctcctctctcactgcacagggtcggtgacttcctatgtgctgactcagccaccctcggtgtcagtggccccaggaaagacggccaggattacctgtgggggaaccaacattggaagaagaagtgtgcactggtaccagcagaagccaggccaggcccctctgatgatcgtctatgatgatagccgaccggccctcgagggactcccgtaggacgcggtagtcggctcgggcctacccgaactcgtcggaccaaaccgaccggcccacccgtcgggacccaatccgaacggccgaagggggtaccggaaacgggcccgggggtagttacgggacgggtacccggtaacgttaacgtttaaccgttgggttaccgacggggtttaggttaggggaacgtttaaaggttggggttagggttcgtaagttccgtaacggttccccggggtttaccggtttaccgggggaccggggtaaccgggggtaaacccgttaaacggggttttaccggtaaccccgggtttacccgttaaacgggttcccgaaccgggtacccccggtaaaacggggtccccgttaccccgggtaccccccccggttaccggggtttacccctaaccccggtttcccggtttaccccggtttaccccccccgttaaccccccgtttacccccgttaaccccgttaacccccg

SEQ ID NO: 157422 - DNA, 609 bp, Homo sapiens
  misc_feature: GYAE6OF02GRG57.43.19.B08.1.454.CMB.1.raw
tcagtgtgagtagtcacgaccggtgctcgatttagtgagtcagtaaggggctgggcctaaggaagcagcactggtggtgcctcagccatggcctggaccgttctcctcctcggcctcctctctcactgcacagggtcggtgacttcctatgtgctgactcagccaccctcggtgtcagtggccccaggaaagacggccaggattacctggtgggggaaccaacagttggaagaagaagtgtgcactggtaccagcagaagccaggccaggccccctctgatgatcgtctatgatgatagcgacccggccctcgagggatccctgacgcgagtcgctggctccaactctggacaacgaccggcccacccgtggcccatccacggcgaaggggtccgaacggcccggggatgggacggcccgaacgttaacttacgtgtccgagggttggtagggattaagtgggtggtagagtcgagttccggttcgttcgggcggacgggacctaaggttcgaccgttacgtaacgtcgacgcccgaaggtccgtccgcccccgttcggtcccgtaccttccgttcccgtttcccccaccccgttccctacctaacccc

SEQ ID NO: 157423 - DNA, 600 bp, Homo sapiens
  misc_feature: GYAE6OF02FWPF7.43.19.B08.1.454.CMB.1.raw
  modified_base (346)..(346): a, c, t, g, unknown or other
  misc_feature (346)..(346): n is a, c, g, or t
tcagtgtgagtagtcacgaccggtgctcgatttagtgagtcagtaaggggtggcctaaggaagcagcactggtggtgcctcagccatggcctggaccgttctcctcctcggcctcctctctcactgcacagggtcggtgacttcctatgtgctgactcagccaccctcggtgtcagtggccccaggaaagcggccaggattacctgtgggggaaccaacattggaagaagaagtgtgcactggtaccagcagaagccaggccaggcccctctgatgatcgtctatgatgatagcgaccggccctcagggctccctgagcgagtcgctggctccaactctggcaacncggcccaccgtggccatccagcgaggggtacgaaggcccggggatcggacggcccgtactattacgtcgtcgagggtgtgggataagtgggtaggtgtatcgagttccggtcgttcgggacggtacggggacctaaggttcgacccgttaccgtaggtccgacggcccgaaggtcctaccggccccccgttacggtcctaccgttccgttaccggtttccccccgtccctccccgttaccgtacccttaacccg

SEQ ID NO: 157424 - DNA, 692 bp, Homo sapiens
  misc_feature: GYAE6OF02F7MH3.43.19.B08.1.454.CMB.1.raw
  modified_base (286)..(286): a, c, t, g, unknown or other
  misc_feature (286)..(286): n is a, c, g, or t
  modified_base (502)..(502): a, c, t, g, unknown or other
  misc_feature (502)..(502): n is a, c, g, or t
tcagtgtgagtagtcacgaccggtgctcgatttagtgagtcagtaaggggctgggcctaaggaagcagcactggtggtgcctcagccatggcctggaccgttctcctcctcgcctcctctctcactgcacagggtcggtgacttcctatgtgctgactcagccaccctcggtgtcagtcggccccaggaaagccggccaggacttaccgtggtagggggaaccaacgattagggaagaagaagtggtgacactggtaaccagcaagaagccaggccaggccccctntagatgatccggtctatgatagattaggccgacccggccctgacgggtaactccccgtaggacgaccgggtagttccggcgtacgggtcctcccgaaacgttcgtacggccaaaacgcccggtaccctaacccgtcgggacccactaccggacgaccgtaaggggtacccgaacggggcccgggtaagcgggtaaccggcgtaacctagttaccgngtaccggtacgggttgtaagggtactaaggtgggttcgggatacggtacacggttcccgttgggtaccggtcgggaacggtaccgtaaagttccggacctacgggttactcgaaccggaccgtaacggccgtacccggtcccctacggtcctaccgttcgttcccgtcccccgtaccttccgacgttacc

SEQ ID NO: 157425 - DNA, 754 bp, Homo sapiens
  misc_feature: GYAE6OF02GPGVR.43.19.B08.1.454.CMB.1.raw
tcagtgtgagtagtcacgaccggtgctcgatttagtgagtcagtaaggggctgggcctaaggaagcagcactggtggtgcctcagccatggcctggaccgttctcctcctcggcctcctctctcactgcacagggtcggtgacttcctatgtgctgactcagccaccctcggtgtcagtcggccccaggaagacggccaggattacctggtgggggaaccaacattaggaagaagaagtgtgcactggtaccagcagaagccaggccaggcccctcgtgatgactcgtctagtgtatgagtagccggacccggccctacgacgggtactcccgtaggacgcggtacgtcgccgtcggtccctaccctaacgtcgtacggacgtaaccgaccggcccgtaacccgtcgggaccctaacgtccgaaggacccggaaggggtaccgggaaaccggggacccgggggtaagtacccggggaacgggtacccggtaaacgtttaaccgtttaccggttcggtaccggtaggggttacgggttagggtaacttaaacggggttggggttacgggttacgtaacgttaccggtaacggtttcccgggtttaccggtccggggaccggggtaaccgggtaacccgttaacgggttccgaacccggttacgtaaccgtcggaaccggtacccgaaggtccctacccgggtccccgtcggtacctccgttccgtccccgtacccctacccgtcctaccctaccg

SEQ ID NO: 157426 - DNA, 653 bp, Homo sapiens
  misc_feature: GYAE6OF02FZK9Y.43.19.B08.1.454.CMB.1.raw
  modified_base (330)..(330): a, c, t, g, unknown or other
  misc_feature (330)..(330): n is a, c, g, or t
tcagtgtgagtagtcacgaccggtgctcgatttagtgagtcagtaaggggctgggcctaaggaagcagcactggtggtgcctcagccatggcctggaccgttctcctcctcggcctcctctctcactgcacagggtcggtgacttcctatgtgctgactcagccaccctcggtgtcaggtggccccaaggaagacggccaggattaccgtggtgggggaaccaacattggaagaaggaagtgtgcacgtggtaccagcagaacgccaggccaggccccctctgatgatcgtctatgatgataggccgaccggccctgacgggactcccgnggagggagtcgcgtgctaccaactcgcggcaacgacggccaccgcggaccacgtcacgacggtacgggtaccgagggccggggatcgggacgggccgtactagttacgtcgtacggtagggtggtagggtaagtaggttgggtaggtgtacgtacctacggttccggttacggttcggggacggtaacggggtaccgttaaggttccggtacccggttactaacgggtccgacggtacccgaacgggtcctcccggtacccccggtcgtcccgtaccttccgtttcccggtaccccctacccctaccttccctacttaccccg

SEQ ID NO: 157427 - DNA, 598 bp, Homo sapiens
  misc_feature: GYAE6OF02IFF9C.43.19.B08.1.454.CMB.1.raw
  modified_base (290)..(290): a, c, t, g, unknown or other
  misc_feature (290)..(290): n is a, c, g, or t
  modified_base (363)..(363): a, c, t, g, unknown or other
  misc_feature (363)..(363): n is a, c, g, or t
  modified_base (391)..(391): a, c, t, g, unknown or other
  misc_feature (391)..(391): n is a, c, g, or t
  modified_base (543)..(543): a, c, t, g, unknown or other
  misc_feature (543)..(543): n is a, c, g, or t
tcagtgtgagtagtcacgaccggtgctcgatttagtgagtcagtaaggggctgggcctaaggaagcagcactggtggtgcctcagccatggccctggaccgttctcctcctcggcctcctctctcactgcacagggtcggtgacttcctatgtgcttgactcagcccacccttcggtgtcaggtggccccaggaaagacggccaggattaccgtggtcgggggaaccaacagttgggaagaagaagtgtgcactggtaccagcagaagccaaggccacggcccctcgtgntgatcgtactatgtatggaactacggccggtacccggccctgaacgggactcccgtgacggccggagtccggntacggcctacaaccttcgaggaccaacnccggcccacccgtgaccacgtccgacgacggcgggtacgaacgggtccggggagtcggacggaccgtaacgttacgttacgtgtcgtaggtggtaggtagtagtgggtgtgatgtcgtcgtcgtcggcgggagtactagtcgacgtacgtancgacgcgaagcctacgcccgtacgtccactctaccgtccccacttcctactaccc

SEQ ID NO: 157428 - DNA, 1072 bp, Homo sapiens
  misc_feature: GYAE6OF02GRZL3.43.19.B08.1.454.CMB.1.raw
  modified_base (128)..(128): a, c, t, g, unknown or other
  misc_feature (128)..(128): n is a, c, g, or t
tcagtgtgagtagtcacgaccggtgctcgatttagtgagtcagtaagggcgtgggccgtaaggaagcgagcactggtggtgcctcagccatggcctggaccgtctctcctcggcctcctctctcactncacagggtcggtgacttcctatcgtgctgactcacgccaccctcggtgtccaggttacggccccaaggaaacgaccggccgaaggtacttaaccgtaggtggggggtaaacccaacgtaacgttaggggaaacgtaaacggaaaaggttggtacgacgacggtttacggtaacccgaggacgaacggaaacggccccggaacgggaccccgtaacggggtccccccttacgtacgggtaacgttacggtaacgttccggtttcgttaaacgttggggtactaaggtaacggttaacggtacccgggaacccccggttacccttacccggaaaggggggttacccttccccgtaaggtaccggggttaaccggacgggtttaccccggggcttaccggggtaccgttacccccgtaaacggtttcccgtaggggaaacccctaaccggaaaccgggtccccgtaaccgttaaccggggacccttaacggtaccgaacggtcccgggtaaaggggtttccccgggaaacggggtttacccgggggacgtttaacggggaacccggggtacccggtaaaccgttttaacgtttaacccgttaacgggttcccggaaaggggtttttcgggaaaccggggtagttttaaacgggtcgggtttaaccgggggtttcgtaacggtttacgttaacccggggttaaccgggttttccggtttaaaccggggggtacgggtaaccgggggtaaaccgtttaacgggtttaccggaaaccccggtttaggggttaaacccgtccggttaaccgtaaccccgggggttaaacggtacccggtttacccgggtaccccccgggtttaccggggtaaccttaaccccggttttcccggtaaccccggttttttaccccccgaaccccgttttccggtaaccccgttttaaccccgg

SEQ ID NO: 157429 - DNA, 681 bp, Homo sapiens
  misc_feature: GYAE6OF02H6TVK.43.19.B08.1.454.CMB.1.raw
  modified_base (293)..(293): a, c, t, g, unknown or other
  misc_feature (293)..(293): n is a, c, g, or t
  modified_base (300)..(300): a, c, t, g, unknown or other
  misc_feature (300)..(300): n is a, c, g, or t
  modified_base (311)..(311): a, c, t, g, unknown or other
  misc_feature (311)..(311): n is a, c, g, or t
  modified_base (548)..(548): a, c, t, g, unknown or other
  misc_feature (548)..(548): n is a, c, g, or t
  modified_base (553)..(553): a, c, t, g, unknown or other
  misc_feature (553)..(553): n is a, c, g, or t
  modified_base (557)..(557): a, c, t, g, unknown or other
  misc_feature (557)..(557): n is a, c, g, or t
tcagtgtgagtagtcacgaccggtgctcgatttagtgagtcagtaaggggtggcctaaggaagcagcactggtggtgcctcagccatggcctggaccgttctccctcctcggcctcctctctcactgcacagggtcggtgacttcctatgtgctgactcagccacctcggtgtcagtcggcccaggaacgacggccaggacttacctgggtacgggggaaccaactagttaggaagaacggaagtgtagctacgtcggtaccagactagaacgccgaggaccaggtccccctntagtacnggtactacgtnttactagacgtagactacggaccggtaccccgggcctacggacgggtactccccggtaggacggtacggtacgtccggacgttcgggcctaaccgtaaaccttcggacgggaaccaaaccggtcccgacccgaccggttacgacctaacgtacacggtaccggaaaggggtccgaacgggcgggactcgggaacggtccgaactagttaccgtcgtagtacggtggtagaagttacngggtntagntacgacgttcggtcgtcggacggggtagtaccgtacgtcggtacgtacctagtccgacgtaccggagtccttcgcccgtcgtacctccgttaccgcgttaccccgtcctactaccgcttaaccg

SEQ ID NO: 157430 - DNA, 590 bp, Homo sapiens
  misc_feature: GYAE6OF02FIDDT.43.19.B08.1.454.CMB.1.raw
tcagtgtgagtagtcacgaccggtgctcgatttagtgagtcagtaaggggtggcctaaggaagcagcactggtggtgcctcagccatggcctggaccgttctcctcctcggcctcctctctcactgcacagggtcggtgacttcctatgtgctgactcagccaccctcggtgtcagtggccccaggaaagacggccaggattacctgtgggggaaccaacattggaagaagaagtgtgcactggtaccagcagaagccaggccaggcccctctgatgatcgtctatgatgatagcgaccgccctcagggactcctgagcgagtcgctggctcaactctggcaacgccggccaccctggccatccagccgagggtcgaaggccggggatggacggccgaacttattacgtgtacgaggtgtggggaataaggttggtcgggtgtactcgacgttccggtcgtttcgggacgggtacgggaccctaaggttcgaccggttacctaagtccgacgcccgaaggtcccgtaccgtcccccgtcgtacctaccgttcctccgttacccccacccgttccctacctaccttacccg

SEQ ID NO: 157431 - DNA, 735 bp, Homo sapiens
  misc_feature: GYAE6OF02HTHCZ.43.19.B08.1.454.CMB.1.raw
tcagtgtgagtagtcacgaccggtgctcgatttagtgagtcagtaaggggctgggcctaaggaagcagcactggtggtgcctcagccatggcctggaccgttctcctcctcggcctcctctctcactgcacagggtcggtgacttcctatgtgctgactcagccaccctcggtgtcaggtcggccccaaggaaaagacggccagggacttaccgtggtacgggggaaaccaaactaagttaggaaaggaaagaagtgtgacacgtggtaccagcaagaagccaggccacggccctactgatgatcgtctatgatagatacgcgaacccgcctacgaggtactcccgtagacgagacgtcgacgtcggctacccgaacgtcgtaggaccaaccgcggtaccccaccggttcggacctacgtacgacggacgaaggggtaccggaaacgggccggggaacgtagggaccgggtaccgaacgttaacgtttacggtacggtaccggtagggtacgggtaagggtaagtaaggttagggttggtagtacgtacgtaccggttaccggttccgttacggggtaccgggaacgggtaaccgtaacggttcgtaaccccgttacgttaacgaccgtaccgacccggtaaacggtcccgtcccggtacccccgttaccggttacccgtaccgttacccgttccccggttccccgtcccccgttaccccgtaccgttaaccccg

SEQ ID NO: 157432 - DNA, 719 bp, Homo sapiens
  misc_feature: GYAE6OF02HWAS4.43.19.B08.1.454.CMB.1.raw
tcagtgtgagtagtcacgaccggtgctcgatttagtgagtcagtaaggggctgggcctaaggaagcagcactggtggtgcctcagccatggcctggaccgttctcctcctcggcctcctctctcactgcacgagggtcggtgacttcctatgtgctgactcacgcccaccctcggtgtcaggtcggccccaaggaaacgcggccaggtacttacctgggtacggggaaccaacgtagttaggaagaagtagtgtgactacgtaggtaccaggcagaacgccgacggcccgacggcccctgtcggataggactcgtactagtgactgatacggccgaccggtcctacgacgggtctacccgtaggacggtacgtacgtccgcgttacggcctaacccgtacgttcgcggaacctaaccggaccgtaccccgaccggtcgaccctacgaccgtaaccggcggtaacgggtaccggaacggggtaccgggtagtcgggaaccggtaccgaaactttacgttacgtacggtacgtacgggtagtaacgggttaatgggttacggttagggtacaggttctacccggttccggttcggtacggggacgtaaccgggtactacggttacgtaccgtacgtacgccgaacgtccgaaccggtccctacccggtccccgttggtactcccgttccgtacccttacccccaccttccggtacctaccg

SEQ ID NO: 157433 - DNA, 667 bp, Homo sapiens
  misc_feature: GYAE6OF02I1K6V.43.19.B08.1.454.CMB.1.raw
  modified_base (220)..(220): a, c, t, g, unknown or other
  misc_feature (220)..(220): n is a, c, g, or t
  modified_base (274)..(274): a, c, t, g, unknown or other
  misc_feature (274)..(274): n is a, c, g, or t
  modified_base (327)..(327): a, c, t, g, unknown or other
  misc_feature (327)..(327): n is a, c, g, or t
tcagtgtgagtagtcacgaccggtgctcgatttagtgagtcagtaaggggtggcctaaggaagcagcactggtggtgcctcagccatggcctggaccgttctcctcctcggcctcctctctcactgcacagggtcggtgacttcctatgtgctgactcagccaccctcggtgtcagtcggccccaggaaagacggcaggattacctggtggggaaccaanagttaggaagaagaagtgtgcactggtaccagcagaagccaggccaggcccctntcgatgactcgtctagtgatagatacgccgaccggccctcgacgggactccgngagcgcgtcgctggcctacgaactcgtgacacgcgaccaccgtcggaccagtaccgagacggacgggtacgagggaccgggagtacggacggacccgtactaagtttaccgtcgtacgacgggtaggttaggtaacgtaaggttcgggtaggtacgtacgtaccgtcgttaccccggttagttacccggggacggtaacgggtaccggtaagtttaacccggaccggttaaccgttagccgtaccgacccgaaccggtcccggttaacccgtccccgttacggttacccgccgtttccgttcccgttccccgtaaccccctcccttccgaccttaacccg

SEQ ID NO: 157434 - DNA, 696 bp, Homo sapiens
  misc_feature: GYAE6OF02IMKJF.43.19.B08.1.454.CMB.1.raw
  modified_base (334)..(334): a, c, t, g, unknown or other
  misc_feature (334)..(334): n is a, c, g, or t
tcagtgtgagtagtcacgaccggtgctcgatttagtgagtcagtaaggggctgggcctaaggaagcagcactggtggtgcctcagccatggcctggaccgttctcctcctcggcctcctctctcactgcacagggtcggtgacttcctatgtgctgactcagccaccctcggtgtcagtcggccccaggaaagacggccaggacttacctggtacgggggaaccaacagttaggaagaagaagtgtgacactggtaccagcagacgccaggccacggcccctctagatcgagtcgtctatcgatgataggccgaccggcctcgaggtcctccgngacgcgacggtccgcgtcggctaccaacgtcctcggaccaacgacccggtccaacccgtcggaccacgtcgacggcggacggggttacgaaacgggccgggtagacgggaccggaccgtacgttaacgtttacgtggtacggtagggttggtaacgggtagttaacggttgggttaggtacgtacgttaacgtccggtttaccgggttacggtccgggacggggtaacggtaaccgtaagggtttccgaaccggttaccgtaacgtccgaaccgaccggtaacggtcccgtacccggtcccccgtggttacccgtaccgttcccgttcccggttcccccacccgtttccctacgttaacccc

SEQ ID NO: 157435 - DNA, 696 bp, Homo sapiens
  misc_feature: GYAE6OF02I2PWT.43.19.B08.1.454.CMB.1.raw
tcagtgtgagtagtcacgaccggtgctcgatttagtgagtcagtaaggggctgggcctaaggaagcagcactggtggtgcctcagccatggcctggaccgttctcctcctcggcctcctctctcactgcacagggtcggtgacttcctatgtgctgactcacgccaccctcggtgtcagtcggcccaggaaagcggccaggattaccgtggtacggggaaccaacagttggaagaagaagtgtgcacgtggtaccagcagaagccgaggccacggcccctctgatcgattccgtactagtggtataggtaagtacggaccggaaccccggtcccgtacggacggggtaccttcccgtagggaacggccggtaggtccggcgtaccgggcctaccgacgttcggacggtaccaaccgacccgggaccctacccggtcggacctacgtccgacggtaccggtacgggtaccgggaacggaccggggtatacgggaccggtacgtacggttacttacgtgtacgtagggtacggtaggtagttaaggtgggttagtcgtaacctgtacggttccggttcggtacgggacggtacgggaattaaccggtcgtaacccggttctaacggtccagacccggtaggccctccggtccccgtcggtcctaccgtcttcccgtacccgtcccttccgacctaccg

SEQ ID NO: 157436 - DNA, 722 bp, Homo sapiens
  misc_feature: GYAE6OF02JP8TV.43.19.B08.1.454.CMB.1.raw
  modified_base (305)..(305): a, c, t, g, unknown or other
  misc_feature (305)..(305): n is a, c, g, or t
tcagtgtgagtagtcacgaccggtgctcgatttagtgagtcagtaagggcgtgggccgtaaggaagcagcactggtggtgccgtcagccatggcctggaccgttctcctcctcggcctcctctctcactgcacagggtcggtgacttcctatgtgctgactcagcccacctcggtgtcagtcggcccaggaaacgcggccaggacttacgtggtacggggaaaccaacgagttacggaagtaagaagtgtagacacgtcggtaccagcaagaacgtccacggaccacgggcccctatgactacgnttccgttactagtcggataggataacggcccgaccggccctacggaacgggaccttcccgtaggaaccgtcggtaaccgtcggaccgtcgggtacctccgtaaacctccgttacggacgaaaccgtacggccctaaccgtcggaccctagtaccgacgcggtacggaaccggacggaccgggagtacgtaccgggacgtacggttattacgtggtaccgtagtcgggttaggaacgttagtcgggtaggtagtctaacggcgttaccggtcggtttaccgggagggttaccggtaaccgttaaggttccgaacccggtacgttacgcgtaccggtaccggacggttccgttcccggaccccgtttggaccgttacccgtcggtaccccttcccggtacccctttacgcccgtaaccg

SEQ ID NO: 157437 - DNA, 643 bp, Homo sapiens
  misc_feature: GYAE6OF02JH6M0.43.19.B08.1.454.CMB.1.raw
tcagtgtgagtagtcacgaccggtgctcgatttagtgagtcagtaaggggctgggcctaaggaagcagcactggtggtgcctcagccatggcctggaccgttctcctcctcggcctcctctctcactgcacagggtcggtgacttcctatgtgctgactcagccaccctcggtgtcagtcggccccaaggaaagaccggccaggacttacctggtgggggaaaccaacattaggaagaagaagtgtgcactggtacagcagaagccaggccaggcccctctgatgatcgtctatgatgatacgcgaccggccctgaacgggtactccctggacgcggagtcgcgtcgctccaactcgtgaccaacgccgccaccgtgaccctagtcacgtcgacgggtacgaacggccgggatcggacgggtaccgtacgtagttaaccgtgtcgagggttgggtaggattaacggtggtaggtgacgttcgaacggttcccggtacgttacggggcgggaacggtaacctaaggttccggtaccgtaccgttaaggtcccgacggtaccccgaaggtccctccgggtacccccgtggttaccccgtacgttcccggttcccgtcccccgtacccttcccgtaccctaacccg

SEQ ID NO: 157438 - DNA, 833 bp, Homo sapiens
  misc_feature: GYAE6OF02GM3SS.43.19.B08.1.454.CMB.1.raw
  modified_base (131)..(131): a, c, t, g, unknown or other
  misc_feature (131)..(131): n is a, c, g, or t
tcagtgtgagtagtcacgaccggtgctcgatttagtgagtcagtaaggggctgggcctaaggaagcagcactggtggtgcctcagccatggacctggaccgttctacctcctcggcctcctctctcactgnacagggtcggtgacttcctatgtgctgactcagccaccctcggtgtcaggtggccccgaggaaagaccggcgaggattaccgtggtacggggaaccaacagttaggaagaagtaagtagtgctacgtaggtaaccgagacgaacggaacgaccgaacggacccaacggggtaccccctacgttaacggagttacggacttacggttacttaagtaggtaacgtagaagttacggaccgtaacccgggccccgttaccgaacggggtaactccccgtaggtacggaccggtacggtccgtaccgtcggaccttacccgaacgttaccgtaggtaacaacccggaccggacccacccgtacggaccacgttaccgaggaccgggacgggttaccggaaacggggtccggggtaaggtacgggaaccgtacccggggtaactttaacgttaaccggttaggtaaccggtaggggttacgggtagggtaaacggttaagggttacgggttacgggttagtaaccgtacggtaccggtttaccgggttccggtttaccggggacggggtaacgggaacgttaaacgttcggaaaccgttaccgtaacgtaccggtaccggaccgtaacggccgttacccggacccgttacggtaccctaccgttccgttaccggttccccgtaccccgttacccgtacgttaacccg

SEQ ID NO: 157439 - DNA, 777 bp, Homo sapiens
  misc_feature: GYAE6OF02JSSSF.43.19.B08.1.454.CMB.1.raw
  modified_base (167)..(167): a, c, t, g, unknown or other
  misc_feature (167)..(167): n is a, c, g, or t
  modified_base (705)..(705): a, c, t, g, unknown or other
  misc_feature (705)..(705): n is a, c, g, or t
  modified_base (757)..(757): a, c, t, g, unknown or other
  misc_feature (757)..(757): n is a, c, g, or t
tcagtgtgagtagtcacgaccggtgctcgatttagtgagtcagtaaggggcgtgggcctaaggaagcagcactggtggtgcctcagccatggcctggaccgttctcctcctcggcctcctctcgtcactgcacagggtcgtcgacttcctatgtgctgactcagccncccgtcggtgtcaggtcggccccgaagggaaacggaccgggcccaagggtacttacccgtgggtacgggggaaacccaacgtagtttagggaaagaagggtaagttcggacgcctacggtcgggtaccgaggtacaaggaaacgccggaacggtccgaccgggcccccttgtggaacgtcggtaacttcggtactaagcggtagtaggtaacgtcggaccggtcccggtccgtacggacggggtaccttcccgtaggcgtccgtacggtcgcgtccgggtacctaaccgtacggtcgtacggaccctaaaccggccgacccgtaaccgtcggacctaacgtccggaacgcgtaggggcgtaacggcgggtatcgggacgcctacgtataccgtggtcgagggtgtacggattaggtgggtagtacgagttccgtacggttaccggggttgttaccggggacggttaaccgggaacgggttacgttaccgggacccgtttaccgtaagggtccctaccgggtaccgaaccgggtttccncccggttaaccccggtgtaacccgttccgttccgttcccggtttaacccccnccgttcccgttaccgacccg

SEQ ID NO: 157440 - DNA, 783 bp, Homo sapiens
  misc_feature: GYAE6OF02IKXDX.43.19.B08.1.454.CMB.1.raw
  modified_base (179)..(179): a, c, t, g, unknown or other
  misc_feature (179)..(179): n is a, c, g, or t
tcagtgtgagtagtcacgaccggtgctcgatttagtgagtcagtaagggtaaagggggctgggcctgaggaagcagcactggtggtgcctcagccatggcctggaccgttctcctcctcggcctcctctcctcactgcacaggctcgtgacctctatgactgactcacgccccctggtntctggtcggcccgaggacacggaccggccagacctacgttaccgtgggtgggggaacttaacgtaaccgtttcgaaccccgaaagtaaaaacgttcgtaactacgttggtaactacaaggccgtaaggaaacggccgaacggtccccgacgggtccccctggtacgtagtcggttccgtcgttaggtcgaacggtacggttaaccggggccccggtcccggttacggggacttccgtgggaccgacgttactttcgtcggtcgtccaccggtaacgtccgggtaacgggaaccctaccgggtacctacgttcgtaccgacctaacgtcggaccgggtacccgggtacgggaccgggtacccgggggacgtacgggtacccgtaacgttagtttacgttacggtacgtacgttgggtaggtacgtgggttacgtcggtaccggtacggttcggtcggtcgggttccgggacgggtacggaccgtagtccggtacgtacccgttacgtacggtaccacggcccgtaggtcccgtacccggtcccgtccggtacctccgtcgttacccgttcccgaccctttaccggccttacctcccgagtacccg

SEQ ID NO: 157441 - DNA, 859 bp, Homo sapiens
  misc_feature: GYAE6OF02IQ5M4.43.19.B08.1.454.CMB.1.raw
tcagtgtgagtagtcacgaccggtgctcgatttagtgagtcagtaaggggctgggcctaaggaagcagcactggtggtgcctcagccatggcctggaccgttctcctcctcggccctccctctctcactgcacagggtcggtgacttcctatgtgctgacctcacgcccacccgttcggtgtcacgtcggccccaagggaaaggaccggccaaggacttaacccgtggtacgggggaacccaaacaggtttacgggaaagaaggaaagtggtgacgaacgttcggtaccgaggtacaaggaacgaccggaacgggacccgaacgggcccccttcgagaacttcgaagttccgttacttacgtagtattacggagttacggaccggacccggtccccgttacggacggggtacctccgtaggacggtcgacggtcggccgtggacctaccgaactcgtagaccacgacccgcccgaccgtggtccaactccgacggacgacgggtaaccgacgggaccgggacgtacgggaccggtacccggtaattaccgttacgttaggtcccggtagggttagggttaagggtaacgttaaggggttgggtttacgggttaggacctttaaccggtacgggtttaccccgggttccgggtttaccgggggtacccggggaaggggtaaccccgtttaaaggttacccgggttaaccccgttaccggttaaaccgggtacccgtaacccgggtacccccgaaaggggtttcccccgacccgggttccccccggttaccggttaacccgtccgtttccccgtttacccggttccccccctccccggttacccctacccttaaaccccgg

SEQ ID NO: 157442 - DNA, 787 bp, Homo sapiens
  misc_feature: GYAE6OF02HTH0H.43.19.B08.1.454.CMB.1.raw
  modified_base (278)..(278): a, c, t, g, unknown or other
  misc_feature (278)..(278): n is a, c, g, or t
tcagtgtgagtagtcacgaccggtgctcgatttagtgagtcagtaaggggtggcctaaggaagcagcactggtggtgcctcagccatggcctggaccgttctcctcctcggcctcctctctcactgcacagggtcggtgacttcctatgtgctgactcagccaccctcggtgtcagtcggcccaggaaacgacggcaggacttacctggtgggggaaccaactattgggaagaagaagtgtgcacgtggtaccagcagaagccaggccgaggcccctntgatgactcgtctatagattagatacgccggacccggccctacggacggactccccggtagacggacggtagttccgacgtgggtacctaccgtaaccgttccggtacggacctaaaccgacccggtaccccgaacccgtcgggacctaacgtaccgacgggaccggtaacggggtaccgggtaacgggaccggggtaacgtcggggaaaccgggttcccgtaaacgtttaacgttttaaccgtcgggttaaccggtaggggttcgggtaacggggtaaactttaagggttcgggggttaggtacgacgtacggtaccggttcccgggtttacggtccggggtaacgggtaacgggtacccgtaaagggtttccggtaaacccgttaccgttaacggtaccgtacggaacccccgtagggtccccgtcccgtaccccgggttcgttaccctaccggtttcccttccccggttaccccctacccgttaccctaccctaaccgttaccccg

SEQ ID NO: 157443 - DNA, 791 bp, Homo sapiens
  misc_feature: GYAE6OF02GZBQB.43.19.B08.1.454.CMB.1.raw
  modified_base (311)..(311): a, c, t, g, unknown or other
  misc_feature (311)..(311): n is a, c, g, or t
tcagtgtgagtagtcacgaccggtgctcgatttagtgagtcagtaagggtggcctaaaggaagcagcactggtggtgcctcagccatggcctggaccgttctcctcctcggcctcctctctcactgcacgaggtcggtgaccttcctatgtgactgactcacgccctacccgtcggtgtcaacggtcggacccccaaggaaacggcggaccgaggtacttaccgtgggtacgggggaaacccaaacgtagttagggaaaggaaacgtaaggttgtcggacctacgtacggttaacccagacgaaggaaccnccggacggtcccgaaccgggccccttacgtgtacgtagacgttcgttacctaggtcgtagttcgtacgtacggcccggtacccggtccctacgggaacggtccgttccgtaacgggtacgaccgggtagtcccggtagtccggaacccgttccgtaacctccggtacggaaccgaacccggaccggtaccccgaccggtaccggtacctaacgtccggaaacgcggtacgggtaaccggaaccggggtacgggtacgtacgggaaccgggtaccgtaacgttaaccggttcgtacggtacggtagggtggtaacggttagtagttcggtacggtatacgtacgtacgtcccggttacgtaggggaccgtaacggtacggtaccgtcggtaacccgtatacgccgacgtcggaccgtcgtacccccgtagtcccgtactccgttcccgtaccgttccccgaccctccgtacccgtctaccg

SEQ ID NO: 157444 - DNA, 943 bp, Homo sapiens
  misc_feature: GYAE6OF02IWOE0.43.19.B08.1.454.CMB.1.raw
tcagtgtgagtagtcacgaccggtgctcgatttagtgagtcagtaaggggctgggcctaaggaagcagcactggtggtgcctcagccatggcctggaccgttctcctcctcggcctcctctctcactgcacagggtcggtgacttcctatgtgctgactcacgccaccctcggtgtcagtcggcccaggaaacgacggccaggacttaccgtggtacgggggaaaccaacgtaagttacgggaaagaaaggaaaggttgttacggacctaaccgttacgggttaacccaacggaccgaaggaaacgacccgaacggcccgtaaacgggtcccccctacgtacggtaactacggtaacgtccgttaaccgtaagtaggtaatacggtaaacgttacgggacccgggtaacccccgggaccccgttaccggaaacgggggtacccttccccggttaggaaccgggtaccggtaacggtccggtaccgtttacgggacccttacccgtaaacgtccgttaccgggaaccaaacccggtacccggacccgtacccgacggtacccctaaagtaccggaaaccggtcgggtaaacgggggttacccggaaaacggggtacccgggggtaacggttaaccggggtaaaccgggtacccgttaaacggtttaaaaccgtttacggttaacgggtttaaccgggtaacggggtttaacgggttacggggtaaatttaacgggttaggggttaacgggttaccgtaacgtttacgtaaccggtttccgggttaccggtttacggggaaccgggtacgggtaaccgttaacggttacggaacccgttacgttaaggtaccaccggtaaccgaacggtccgtaacccggtccccgttacgggtacctttacccgttccgttacccctccccgttacctaccgttacctaacccg

SEQ ID NO: 157445 - DNA, 717 bp, Homo sapiens
  misc_feature: GYAE6OF02IMDLY.43.19.B08.1.454.CMB.1.raw
  modified_base (285)..(285): a, c, t, g, unknown or other
  misc_feature (285)..(285): n is a, c, g, or t
  modified_base (291)..(291): a, c, t, g, unknown or other
  misc_feature (291)..(291): n is a, c, g, or t
  modified_base (332)..(332): a, c, t, g, unknown or other
  misc_feature (332)..(332): n is a, c, g, or t
tcagtgtgagtagtcacgaccggtgctcgatttagtgagtcagtaaggggctgggcctaaggaagcagcactggtggtgcctcagccatggcctggaccgttctcctcctcggcctcctctctcactgcacagggtcggtgacttcctatgtgctgactcagcccaccctcggtgtcaggtcggcccaggaaagacggccaggtattacctgggtacgggggaaccaacagttggaagaagaagtgtgcactcggtaccagacagaacgccacggccacgccctntgatgntcgtctatgatgatcggccgaccggcctacgaggactccgnggacgtacgagtcgcgtcggtcaccgaactcgcgacaaccgccggtacccacccggtcgaccctagtaccgacggaccggtaacggggtaccggaaacgggccggggtaacgttcgggaaccgggtacccgtaacgttacgtttacggtacggtacggtagggttacggagggttaacgtagttggggttagaggaccttacggtacggttccgggttaccggtacggggtaccgggaacgggtaaccttaacgggttacggtaccggttaaccgttacggaccgtaaccggacccggtaacggtccccggtacccgtacccccggtacgttacgtaccctttcccggtacccgttacccccgaacccttcccgaccgttacccc

SEQ ID NO: 157446 - DNA, 803 bp, Homo sapiens
  misc_feature: GYAE6OF02HL3OL.43.19.B08.1.454.CMB.1.raw
  modified_base (583)..(583): a, c, t, g, unknown or other
  misc_feature (583)..(583): n is a, c, g, or t
  modified_base (615)..(615): a, c, t, g, unknown or other
  misc_feature (615)..(615): n is a, c, g, or t
tcagtgtgagtagtcacgaccggtgctcgatttagtgagtcagtaaggggcgtgggccgtaaggaagcagcactggtggtgcctcagccatggctggaccgttcctcctcctcggcctcctctctcactgcacgtagggtcggtgaccttcctatgtgctgactcgacgccctacccgtcggtgtcaggtcggaccccgaaggaaacggaccgggaccgtaagggaactttaccgtaggggtacgggggaaaacctaaacgaagttaagggaaaggaaaggtaaggtgtagctaacgtacggtaccaagcaaggaacgccgaacgggacccaaccggccctacgtggacttaggacgttccgtagtagtgtaacgtagtacgtaacggacccggaacccggtcccgtacggaccggtacgttaccccgaggacggaccggtaacggtcccggtcgtacgggtaccctacccgtaaccgtcggtacgaacgaaacccggccggtacccaccgtacgcctaaacgtcgacggtcggagggtacgacgggcgggacgtacggaacggacgtacgttaacgttaccnggtacggtaggtcggttagggtaacgttaggngggtagtacgagttaccgacggttaccggtaccggtttacggggacggtacgggtaacgttaacggtacggttaaacccgtacgtaaccgtacgaccggtaaccgtggacccgttcccggaccccggttaccgaccgttaccgttcccggttaccttaccccgtaccccggttacctaacccgtaccg

SEQ ID NO: 157447 - DNA, 824 bp, Homo sapiens
  misc_feature: GYAE6OF02H02KX.43.19.B08.1.454.CMB.1.raw
tcagtgtgagtagtcacgaccggtgctcgatttagtgagtcagtaaggggtggcctaaggaagcagcactggtggtgcctcagccatggcctggaccgttctcctcctcggcctcctctctcactgcacgagggtcggtgacttcctatgtgctgactcacgccacccgtcggtgtcagtcggaccccgaggaaacgacggccaggtaatttaccgtggtacgggggaaaccaaactacgttaggaaagaaaggtaagttcgtgacacgtacggtaaccagacgaagtaacgccgtaaggaccgacggcccctcgtgtactgactccgtactacgtagtagtagaattacggacccggacccggtaccctacggtaacggtacctcccgtaggacggtaccggacggttccgacggtcggtacctacccgtaacgtcggtacggaccaaaccgccggtacccacccggtacgaccctaatccggaacggaccggaacggggtaccggtaaacggggaccgggtaagtaccgggaaaccgggtaccccgtaagttaactttaaccggacggtaacggttacgggtaacggtaagggttaaagttaaggtcggggtacggttaaagcgttaaccgtacgggttacccggttacggtaccggggaacgggtaaccgggtaacccttaagggttacccgtaaccgttaacggtaacgtccgaaccggacccggtacggccccgttacccggaccccggttacgtaccctaccgttacccggttacccgttacccccgtaacccttccgtacccttaacccgttaaccg

SEQ ID NO: 157448 - DNA, 821 bp, Homo sapiens
  misc_feature: GYAE6OF02JQ2GU.43.19.B08.1.454.CMB.1.raw
  modified_base (151)..(151): a, c, t, g, unknown or other
  misc_feature (151)..(151): n is a, c, g, or t
  modified_base (317)..(317): a, c, t, g, unknown or other
  misc_feature (317)..(317): n is a, c, g, or t
tcagtgtgagtagtcacgaccggtgctcgatttagtgagtcagtaagggctgggcctaaggaagcagcactggtgtgcctcagccatggcctggaccgttctcctcctcggcctcctctctcactgcacagggtcgtgacttcctatgtcnctgactcacgccatccgtccggtgtcaggtccgccccgaaggaacgaccggccaggtacttaaccgtgggtacggggaaccaacacgttagggaagaacgaagtggtacgacgtacgtacggtaccacggaccgaagacgaccgaggccctaccggccctcgtagntacgacgttcgtacgtactgacgtagacgtcggaccgcccggaccttccggaggtctccgtgagaccgtacgtccgcgtaggccctaacgtaccgttcgacgcccgtaaacccggccgttacccgacccggtccgaccgtacaccggtaccgggaccggttcgggtaaccgggaacccgggtacgggtaacgtacgggtacccggtaccgtaactttaccggttaacccgtcggacggttagggtacgggtacgggtacgtttaacgggttgggccggtttaacgacccggtttcctaccgggtttaccgggtttacccgggtaaccgggtccggggtaaacccggttacgtaaacccggtttaccgaaccgggttttaaacccgtccggaacggtacccggtcccggtaacggtttccccggaaaccccgtttccccggttacttaaccccggtcgtttaccccggtttcccccgggccccttaacccggtcccttaacccgg

SEQ ID NO: 157449 - DNA, 899 bp, Homo sapiens
  misc_feature: GYAE6OF02FJD08.43.19.B08.1.454.CMB.1.raw
tcagtgtgagtagtcacgaccggtgctcgatttagtgagtcagtaaggggctgggcctaaggagcagcactggtggtgcctcagccatggcctggaccgttctcctcctcggcctcctctctcactgcaccagggtcggtgacttccatgtgctgactcacgccaccctcggtcgtcagtcggccccagggaaagaccggtccaggacttaaccctggtacggggggaaacccaacacgtttagggaacgaacggtaacggttggttcggccacgttacggggtaacccacggtaccgaacggaaacggtccccaagggccccaacggggtcccccccttagtaccggtaacttccgggtaaactttcccgggtaccttaagttccggacgtttaacggaagttaaccggacccggtaaccccggggtcccctacggtaacggggtacttcccccgtaggaaaccggccggaacggttccggatccgggtcctacccgaacttcgtacgtccgaaaccgtcgggacccacccggtacgggtaccctaacgtcacgggacgtacggggtaccggaaacgggccggggtaatccggaacgggtcccggtaaccttaacgtttacctacgggtactaggggttcgtcgggtaacctaaggttccgggtaggtcgggtaaccttacggtacgtcccgggttacggtttaccggggaacggggtaacggggtaacccgtaaggttttaccgggaaccgttaccccgttaaacgggttccaacccgggtccccgtaaaacggggtccccgttaaccccgggtccccccggtttacggtaacccggttaccgttaacccgttcccggtttaaccccctacccccggttacctcccggttaaacccg

SEQ ID NO: 157450 - DNA, 504 bp, Homo sapiens
  misc_feature: GYAE6OF01BASVW.41.71.G05.1.454.CMB.1.raw
  modified_base (477)..(477): a, c, t, g, unknown or other
  misc_feature (477)..(477): n is a, c, g, or t
tcagtctatactatcacgaccggtgctcgatttagtgtcgtcgcaagagagagggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcaggttattaataattggttggcctggtatcagcagaaaccagggaaagcccctaaactccctgatctataaggcgtctactttagagagtggggtcccttcaaggttcagtggcagtggatctgggacagagttcaccctcaccatcggcagcctgcagcctgaagatatcgcaacttattactgtcaacaatataacacttaattcagggcattcggccaagggaccaaggtgaaattaaacgactgtgntgcaccatctgtcttcatcttccgacc

SEQ ID NO: 157451 - DNA, 512 bp, Homo sapiens
  misc_feature: GYAE6OF01AGJ5E.41.71.G05.1.454.CMB.1.raw
  modified_base (488)..(488): a, c, t, g, unknown or other
  misc_feature (488)..(488): n is a, c, g, or t
  modified_base (498)..(498): a, c, t, g, unknown or other
  misc_feature (498)..(498): n is a, c, g, or t
  modified_base (502)..(502): a, c, t, g, unknown or other
  misc_feature (502)..(502): n is a, c, g, or t
tcagtctatactatcacgaccggtgctcgatttagtgtcgtcgcaagagagaggggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcaggttattaataattggttggcctggtatcagcagaaaccagggaaagcccctaaaactcctgatctataaggcgtctactttagagagtggggtcccttcaaggttcagtggcaggtggatcgtgggacaggagttcaccctcaccatcggcagcctgcagcctgaagatatccgactaacttattactgtacaactaatataacactttatcagggctagttcggacaagggaccaaggtagaattaaacgaatgtggntgcacatctntctncttcctccgc

SEQ ID NO: 157452 - DNA, 519 bp, Homo sapiens
  misc_feature: GYAE6OF01EQDZO.41.71.G05.1.454.CMB.1.raw
tcagtctatactatcacgaccggtgctcgatttagtgtcgtcgcaagagagagggggagtcagacccagtcaggacacagcatggacatgagggtcccgctcagctcctggggctcctgctgctctggctcccaggtgccaaatgtgacatccagatgacccagtctccttccaccctgtctgcatctgtaggagacagagtcaccatcacttgccgggccagtcaggttattaataattggttggcctggtatcagcagaaaccagggaaagcccctaaactcctgatctataaggcgtctactttagagagtggggtcccttcaaggttcagtggcagtggatctgggacagagttcatcctcaccatcggcagcctgcagcctgaagatatcgactaacttattactgtacaacaatataacacttaattcaggggtctagttcggaccaaggggaccaagggtaggtaaattaaacgaacgttgtaggctgcaccatctgttacttcatctcccg

SEQ ID NO: 157453 - DNA, 552 bp, Homo sapiens
  misc_feature: GYAE6OF01BODYL.41.71.G05.1.454.CMB.1.raw
  modified_base (524)..(524): a, c, t, g, unknown or other
  misc_feature (524)..(524): n is a, c, g, or t
  modified_base (532)..(532): a, c, t, g, unknown or other
  misc_feature (532)..(532): n is a, c, g, or t
tcagtctatactatcacgaccggtgctcgatttagtgtcgtcgcaagagagagggggggagtcagacccagtcaggacacagcatggacatgagggtccccgctcagctcctggggctcctgctgctctggctcccaggtgccaaatgtgacatccagatgacccagtctcccttccaccctgtctgcatctgtaggagacagagtcaccatcacttgccggccagtcaggttattaatattggtgctgtatcagcagaaaccgagggaacgacccctaaactcctgatactataacggcgttactacgtttagagaggttcgggtcccttacgtaaggttcaggtggcgtaggtggatcgtagggacaggtacgttccaccctcaccagtcggcacgtcctgcagcctagaagtatacgtcgtactaactttactactcgtacaactaatactaactacttactacggagggtactacgttaccggacgaagggaccgtaaggtagtaaataacgagtgcgtnagcacgtntctgtctatctccgtcccgc

SEQ ID NO: 157454 - DNA, 750 bp, Homo sapiens
  misc_feature: GYAE6OF01CUQVX.41.71.G05.1.454.CMB.1.raw
  modified_base (198)..(198): a, c, t, g, unknown or other
  misc_feature (198)..(198): n is a, c, g, or t
  modified_base (279)..(279): a, c, t, g, unknown or other
  misc_feature (279)..(279): n is a, c, g, or t
tcagtctatactatcacgaccggtgctcgatttagtgtcgtcgcaagagagaggggggagtcagacccagtcaggacacagcatggacatgagggtccccgctcagctcctggggctcctgctgctctggctcccaggtgccaaatgtgacatccagatcgacccagtctccttccaccctgtctgcatctgtagganacagagtcaccatcacttcgccgggcagtcaaggttattaatattggttggccttggtatcagcaagaaccgagggaaacncccctaaactcctagactactaagtaacggcttactaacgtttagagtacggttcgggtaccccttgaaacggtttcgaaggttcggacgtaggttaggaacgttcgtacggggaactacggtacggtttacccctacccttaccgaacccgtaaggttcccgggacctaacgtcccgttaggaccggtaccgtacccgttaaggaaacgtaagtttaacctaccggttaaccttaaacgtttactttaaaccgtacgttaaccaaaacttaaattaaacttaaaccgtaacttttacgttaacgggaacggggttaacctaacggtttaccgggaccgtaaacggggaacccgtaaagggttaaacggtaaaacgttaaaccggaacgttagggtcggtaacgttacgaccgtaacccgtagtttcccgttagttacccttaccttaaccgttcccgttccccgtaaccc

SEQ ID NO: 157455 - DNA, 542 bp, Homo sapiens
  misc_feature: GYAE6OF01CGBKW.41.71.G05.1.454.CMB.1.raw
  modified_base (410)..(410): a, c, t, g, unknown or other
  misc_feature (410)..(410): n is a, c, g, or t
  modified_base (522)..(522): a, c, t, g, unknown or other
  misc_feature (522)..(522): n is a, c, g, or t
tcagtctatactatcacgaccggtgctcgatttagtgtcgtcgcaagagagaggggggagtcagacccagtcaggacacagcatggacatgagggtccccgctcagctcctggggctcctgctgctctggctcccaggtgccaaatgtgacatccagatgacccagtcctccttccaccctgtctgcatctgtaggagacagagtcaccatcacttgccgggccagtcaggttattaatattggtggctggtatcagcagaaaccagggaaacgcccctaaactcctgatctataaggcgtctactttagagtaggtcggggtcccttagaaggttcaggtggcaggtggatcgtgggacaggacgttccaccctcaacctatcggcacgcctgcagcctagaagatacncgactaacttattactagtacaactaataataaactactttaatacgaggggtctagttccggacaagggaccaaggtagaaattaaacgaacgtgtgctagcaccattctntcttacacttcctcccgtac

SEQ ID NO: 157456 - DNA, 680 bp, Homo sapiens
  misc_feature: GYAE6OF01A16D2.41.71.G05.1.454.CMB.1.raw
  modified_base (275)..(275): a, c, t, g, unknown or other
  misc_feature (275)..(275): n is a, c, g, or t
tcagtctatactatcacgaccggtgctcgatttagtgtcgtcgcaagagagaggggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcaggttattaatattggttgcctggtatcagcaagaaaccagggaaacncccctaaactcctgatctataaggctactacttagagagtgggtcccttgaaggttcagtggctaggtggatcgtgggacaggtacgtttaccaccccgtcaccgactccgggacacggtccctggacccaggtccccgttaagggaaacgtacttaacgttacccggaactaaaacctttttaatttacccgttagttaacccaaaacgtaaacttaactaaaccgttaacttttagtaccggaagggggtccttaagtttaccgggacccgtaaaggggtacccaaaaggggttacggtaaaaaacgtttaaaccggaaccgttagggtggtaccgttcggaaccctaccgtaactttccgttacgttaccctttaccaactttcccccgtttccccgaaccg

SEQ ID NO: 157457 - DNA, 574 bp, Homo sapiens
  misc_feature: GYAE6OF01BLLRD.41.71.G05.1.454.CMB.1.raw
  modified_base (247)..(247): a, c, t, g, unknown or other
  misc_feature (247)..(247): n is a, c, g, or t
  modified_base (249)..(250): a, c, t, g, unknown or other
  misc_feature (249)..(250): n is a, c, g, or t
  modified_base (264)..(264): a, c, t, g, unknown or other
  misc_feature (264)..(264): n is a, c, g, or t
  modified_base (364)..(364): a, c, t, g, unknown or other
  misc_feature (364)..(364): n is a, c, g, or t
tcagtctatactatcacgaccggtgctcgatttagtgtcgtcgcaagagagaggggggagtcagacccagtcaggacacagcatggacatgagggtccccgctcagctcctggggctcctgctgctctggctcccaggtgccaaatgtgacatccagatgacccagtcctcccttccaccctgtctgcatctgtaggagacagagtcaccatcactggccggcagtcagttataatatggtgctgtncnncagaacagggaacncccctaaatcctgatctataaggctactactttagagaggtcgggtcctagaggttcagtgcaggtggatcgtgggacaggtacgttccaccctcaaccncgtcggcacgctgcacgaccgtagaagatactcgtactaacttattactgtacaactaaatactaactactttacgtacgagggactaagttccggaaccgaacgggaacgaaacgggtacggtaaaacgttaaaaccgaacgttaggtacggactacggacctaccgtacttcgtaccgtttcttaccttacttcccgttccctacccg

SEQ ID NO: 157458 - DNA, 650 bp, Homo sapiens
  misc_feature: GYAE6OF01EN69D.41.71.G05.1.454.CMB.1.raw
tcagtctatactatcacgaccggtgctcgatttagtgtcgtcgcaagagagaggggggagtcagacccagtcaggacacagcatggacatgagggtccccgctcagctcctggggctcctgctgctctggctcccaggtgccaaatgtgacatccagatgacccagtcctccttccaccctgtctgcatctgtaggagacagagtcaccatcacttcggccggcagtcaggttattaataagttggttggcctggtatcagacaagaaaccgagggaaaccgcccctaaaactccctagactactaagtaacggtcgtacttaacgtttaggagtaggttcgggtcccttagtaaggttcaggtggcaggtggagtcgtagggactaggtacgtccaccctcacctagtcggcacgctgcagtcctagaatatacgtcgactaactttattactagtactaaactaattaactaaacctactttaacgtacgaacggggtacctacggttaccggaaccggtaaacggggaaccgtaaagggttaaaggtaaaaaccgtttaaaccggaaccgtttggtaaccggtactacgtaccctaacctagttccttacgttaccctttactaccgtttccccgtccccgtaaccc

SEQ ID NO: 157459 - DNA, 632 bp, Homo sapiens
  misc_feature: GYAE6OF01EGQ31.41.71.G05.1.454.CMB.1.raw
  modified_base (406)..(406): a, c, t, g, unknown or other
  misc_feature (406)..(406): n is a, c, g, or t
tcagtctatactatcacgaccggtgctcgatttagtgtcgtcgcaagagagagggggggagtcagacccagtcaggacacagcatggacatgagggtccccgctcagctcctgggggctcctgctgctctggctcccaggtgccaaatgtgacatccagatgacccagtctccttccaccctgtctgcatctgtaggagacagagtccaccatcacttggcccggggccagtcgtaggtttattaaataagtttggttaggcctggtatacagcaagaaaccgaagggaaacgacccctaaaacgtcctagatactaagtaacgcgtctacttagagagtcgggtcctagtcaaggttcgagtaggtcgaagtcggagtactagggactagaccgtttcaaccctnaccgatcggctaggccctaggcctaaggacctagaaaacgtctacgtaaccgtactaaacctttagttacctaacgtacaaactaaacttaacgttaaactacgttaaaggttccaaggggttaccgacttaacggggaacccaaaggggtaccgtaaaagttaacgggaaaattaaacggaacgtcgtaggctcgactaccatctcgtatctaccgtcgtaaccc

SEQ ID NO: 157460 - DNA, 588 bp, Homo sapiens
  misc_feature: GYAE6OF01C4KN1.41.71.G05.1.454.CMB.1.raw
  modified_base (359)..(359): a, c, t, g, unknown or other
  misc_feature (359)..(359): n is a, c, g, or t
tcagtctatactatcacgaccggtgctcgatttagtgtcgtcgcaagagagaggggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccggcagtcaggttattaataatggttgcctggtatcagcagaaccagggaacgccctaaactcctagatctataaggctctactttagagagtgggtccttgaagttcagtgcaggtgatcgtgggacagagttacaccctnaccgatcggcagcctagcacgcctagaagatagtcgactaactttagttactgtacaacgtaataactaactaacttaagttacacggggtactacgtttaccgggacctaaacgggacccgaaaggtaacgggtaaaacttaaaaccggtaaacttacgggttacggtacgtacggactaaccctagttcctaggttaccttactaccttcccgttcccggttaaccc

SEQ ID NO: 157461 - DNA, 787 bp, Homo sapiens
  misc_feature: GYAE6OF01BYQX4.41.71.G05.1.454.CMB.1.raw
  modified_base (196)..(196): a, c, t, g, unknown or other
  misc_feature (196)..(196): n is a, c, g, or t
tcagtctatactatcacgaccggtgctcgatttagtgtcgtcgcaagagagaggggggagtcagacccagtcaggacacagcatggacatgaggtccccgctcagctcctggggctcctgctgctctggctcccaggtgccaaatgtgacatccagatgacccagtctccttccaccctgtctgcatctgtagganacagatcaccatcacttcggccggcagtcaggttattaatagttggtgcctgtatcagcaagaaaccgagggaacacccctaaactcctagtactactaagtaacggtcgttactaacgttttaggagtacgggttcggggttaccctttacgaacggtttccaggtacggtacgtacggttgggtacgttcggtaggggaactaggtacgtttacccgaccctaccgaacctacgtccgggaccgtaacggtcccgtaggacctacggcccgttaaggaacgtagtaacgtaccggtaaccttaaaccgttttacttaacccggttacgtaaccgtaaaacctttaacttaaaccttaaaccgttaacgttttaacgtttacccgggaacggggtaccttaaccggttaccgggaacccggtaaccggggtaaaccggttaaaggggttaaacgggttaaaaaccgtttaaaaccgggtaaaccggtttacgggttaccgggtaccgttaacggtacccgtaacccgttagttacccgttacggtttaccctttaaccgtaaccgtttcccccgtttccccggtaaaccc

SEQ ID NO: 157462 - DNA, 692 bp, Homo sapiens
  misc_feature: GYAE6OF01E3WY1.41.71.G05.1.454.CMB.1.raw
  modified_base (202)..(202): a, c, t, g, unknown or other
  misc_feature (202)..(202): n is a, c, g, or t
tcagtctatactatcacgaccggtgctcgatttagtgtcgtcgcaagagagaggggggagtcagacccagtcaggacacagcatggacatgagggtccccgctcagctcctggggctcctgctgctctggcctcccaggtgccaaatgtgacatccagatcgacccagtctccttcccaccctgtctgcatctaggtagganacagagtcacctatccacttcgcccgggaccagtcgtaggtttaattaaattaagttggttggcctggtatcgagacaacgaaaaccgagggaaacgaccccctaaaactccctagaactctaagtaacggcgttacttaacgtttaggagtacggttcgggtacccttacgaaacggttcaggtcggactaacggtggtactcgtggggaacgtagtaacgttccaacccctcgaacctagtccggacacgtcctcgcgagtaccgagtaagacttagtccgataacttacttaacttacgtaactaaacaacttaactaaactaacgtttaacttacggaacggggtactaacggtttacccggaccggaaacgggtaacccgaaagggtaacggtaaaaacgtttaaaacggaaccgttggtacggtacctaacggcctaacccgtattccgtacgttaccttaccgactttcccctcccgtacccg

SEQ ID NO: 157463 - DNA, 709 bp, Homo sapiens
  misc_feature: GYAE6OF01CE347.41.71.G05.1.454.CMB.1.raw
  modified_base (203)..(203): a, c, t, g, unknown or other
  misc_feature (203)..(203): n is a, c, g, or t
  modified_base (209)..(209): a, c, t, g, unknown or other
  misc_feature (209)..(209): n is a, c, g, or t
tcagtctatactatcacgaccggtgctcgatttagtgtcgtcgcaagagagagggggagtcagacccagtcaggacacagcatggacatgacggtcccgctcagctccgtggggctcctgctgctctggcctccaggtgaccaaatgtgacatccagatcgaccagtcctccttccacctgtctcgctatcgtaggtacgganacaggntaccacgtactctacgttcggaccggcctaggtctaaggtttaattaacgtagttcggttcggaccttggtactacgaacgacgtaaacggaaaccgtaacggggtaaaccaccccgttaaacgtccgtagtacttacgtacgtaacggtcttacgttaacgtttagaaggtacggttcgggttacccttagacgtttacgaggtcggtactagggtacggttacgtacggtacgggaaccgtacggtacggtttaaccccaccctacgtaaccgtaggtcccgacgtacgccgtagaccgaccgacgtagaacgtactacgtacctagttaacttacgttactagtaactaaacgtattaactaaacttcgttaagtcggaacggtactaacggttaccggaacgttaacggactaaagggtactaaacgtaacgttacgaggtccgcgtaacgccgttaacctgtttacgtaccgttacttatccttccgtacctacg

SEQ ID NO: 157464 - DNA, 674 bp, Homo sapiens
  misc_feature: GYAE6OF01D1TTT.41.71.G05.1.454.CMB.1.raw
  modified_base (637)..(637): a, c, t, g, unknown or other
  misc_feature (637)..(637): n is a, c, g, or t
tcagtctatactatcacgaccggtgctcgatttagtgtcgtcgcaagagagaggggggagtcagacccagtcaggacacagcatggacatgaggtcccgctcagctcctggggctcctgctgctctggctcccaggtgccaaatgtgacatccagatgaccctagtctcctccacctgtctgcatctgtagagacagtacgtcaccatcacttcggccggcctagtctaggttaactaataagttggtgcctggtactcgagtcgaacgaaaaccgaggggaaactaccccgtaaaagttcctaggtactacttaaagtaacggtcttaaccgttaacttaaggaggttacggtacggggttaccctacgtaaggttccgaggtggtacctaggtcgggtattacggtacgggtaactaaggtacgttccaacccgttacgacccaagtcgacacggtcctgtacaacgcctaaggtaaagtataacgtacgaacttaactttattacgtacgaacaaactaataacttaactacttaacgtacggacgggtacttaacggttccggaaccgtaaacgggacctaaagggtaacgttaaaaactaacggtaactgggtacgtactacgacctaaccngtacttacgttacttaccggtccttccgtacccgacg

SEQ ID NO: 157465 - DNA, 820 bp, Homo sapiens
  misc_feature: GYAE6OF01BR21X.41.71.G05.1.454.CMB.1.raw
tcagtctatactatcacgaccggtgctcgatttagtgtcgtcgcaagagagaggggggagtcagacccagtcaggacacagcatggacatggagggtccccgctcagctcctggggctcctgctgctctggcctcccgaggtcgaccaaatgtagacatccgagatcgaccctagtcctcccttcccaccttgtctgctatcgtagtaggacgacagacgtcaacctatcacgttcggcccggcctagtcgtaaggtttaattaagttaagtttggttcggtaccttggtactacgagtacaaacggaaaccgaagggaaacccgtaccccttaaactctagaacgttactaagtaacggtccgttacttacgtttaggacggtacgggttccgggttacccttacgtaacgggtttcgtacgggttcggacgtaggtcggtacgttacggtagggtaaccgtacggtaccgttaccctaaccccgtaccgtaccgtacggtaccggaccgaccgtccgttaccggaccgtaccgtaccgtaacggtaacgtaacgttaacgtaccggtaacctttaaactttacgtttaccgtaacgtaaacctaaactaaacttaaccttaaaccttaacgttaacgttaccgggtaacggggtacctttaacgggttacccgggaaaccgggttaaacccgggaacgtaaacgggttaaacggtaaaacgttaaaccggtacgtttacggtcggtaccgttaccggacctaaccctaacgttaccttaccggttaccttaccttacccgttcccgttacccgtaccg

SEQ ID NO: 157466 - DNA, 693 bp, Homo sapiens
  misc_feature: GYAE6OF01BET8I.41.71.G05.1.454.CMB.1.raw
  modified_base (297)..(297): a, c, t, g, unknown or other
  misc_feature (297)..(297): n is a, c, g, or t
  modified_base (343)..(343): a, c, t, g, unknown or other
  misc_feature (343)..(343): n is a, c, g, or t
tcagtctatactatcacgaccggtgctcgatttagtgtcgtcgcaagagagagggggagtcagacccagtcaggacacagcatggacatgagggtccccgctcagctcctggggctcctgctgctctacggctccaggtgccaaatgtgacatccagatgacccagtctccttccaccctgtcctgcattctgtaaggagacaggacgtcaccctatctacgttggcccggccagttcgaggtttattaagttaattggttacggcctggtactcgagcaagaacccagggtaaacnccccgtaaactcctgtactacgtaagtacgcgttcttagtttaagnggtacggtcgggttaccctttcaagggttacctaggtcggacgaggtggtaactcgtacggggactaggacgttcccaaccgttcaccgtgtacccggtacacgcctgacgtcgaccgtagaagtacgtactacgaacctaacgtttacttaacgtacgtaacgtaacctaagttaactaaaccgttaacgtttaacttacgggaacgggttaccttacgtaccggtaccgtaaacggggtaccctaaagggtaacggttaaaaccgttaaacgtaacgtaccgttaggtacgtaacggcaccggtaaacttccgtaacgttccttaaggtcccttcgttccccggtaac

SEQ ID NO: 157467 - DNA, 566 bp, Homo sapiens
  misc_feature: GYAE6OF02HJKWD.41.71.G05.1.454.CMB.1.raw
tcagtctatactatcacgaccggtgctcgatttagtgtcgtcgcaagagagaggggggagtcagacccagtcaggacacagcatggacatgagggtccccgctcagctcctggggctcctgctgctctggctcccaggtgccaaatgtgacatccagatgacccagtcctccttccaccctgtctgcatctgtaggagacagagtcaccatcacttcgccggccagtcaggttattaatattggttgctggtatcagcagaaacgagggaaacacccctaaactcctagatctaataggcgtactactttagagtaggtcggggttcccttacgtaaggttcaggtggcaggtggatcgtagggacaggtacgttcaccctcaccagtcggcagcctgcagtcctagaagatatcgactaaacttattactgtacaacaataactaactacttatacgacgggctacgttacggaccgaacgggaacctaaaggtaggtaaacttaacggaacttaggtcggtactagaccacctatcttcgtccttactacttccttcccgtacc

SEQ ID NO: 157468 - DNA, 516 bp, Homo sapiens
  misc_feature: GYAE6OF02GLLSR.41.71.G05.1.454.CMB.1.raw
tcagtctatactatcacgaccggtgctcgatttagtgtcgtcgcaagagagaggggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcaggttataataattggttgcctggtatcagcagaaaccagggaaagcccctaaaactcctgatctataaggcgtctactttagagagtggggtcccttcaaggttcagtggcagtggatctgggacagagttcaccctcaccatcggcagcctgcagctgaagatatcgacaacttattactgtacaacaatataacacttatacaggggtctagttcggaccaagggaccaaggtaggaaattaacgaactagtggctagcaccgatctgtcttcacttctcccgtcc

SEQ ID NO: 157469 - DNA, 681 bp, Homo sapiens
  misc_feature: GYAE6OF02IDAJD.41.71.G05.1.454.CMB.1.raw
  modified_base (419)..(419): a, c, t, g, unknown or other
  misc_feature (419)..(419): n is a, c, g, or t
tcagtctatactatcacgaccggtgctcgatttagtgtcgtcgcaagagagaggggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcattgccgggccagtcagttattaataattggtgctggtatcagcagaaaccgaggaaacgcccctaaaactcctagatactaagtaaggccgtactactttagagaggttcggggtcccttacgaaggttcaggtggacaggtggagtcgtagggaacagtacgttccaccctcaccatccggcacgcctgcacgcctagaagactanccgtactaaacttacttactacgtacaaactaacttaactaaactaactttacgttaccggaacggggtacctagtttacccgggaacccgtaaaaggggtaacccggtaaaagggttaacgggtaaaaacgttttaaaacccggtaaaccgtttaggggttaaccgggtaccttacgggtaaccctaaccccgttaattacccgtttaccggtttaccctttaccgttaacctttcccccggttttaccccccgtaacccg

SEQ ID NO: 157470 - DNA, 683 bp, Homo sapiens
  misc_feature: GYAE6OF02JHSYD.41.71.G05.1.454.CMB.1.raw
  modified_base (197)..(197): a, c, t, g, unknown or other
  misc_feature (197)..(197): n is a, c, g, or t
  modified_base (676)..(676): a, c, t, g, unknown or other
  misc_feature (676)..(676): n is a, c, g, or t
tcagtctatactatcacgaccggtgctcgatttagtgtcgtcgcaagagagagggggagtcagacccagtcaggacacagcatggacatgagggtcccgctcagctcctggggctcctgctgctctggctcccaggtcgccaaatgtgacatccagatgacccagtctccttccaccctgtctgcatctgtacgganacagagtccaccatccacttcggacccgggcctaagtcctaaggtttattaaataacgttggttggtaccttgggttatcgtacgacaacggtaaaccgaagggaaacgtacccctaaacgtcccgtagtactctaagtaacggccgttacttacggttagggaggttcggggtcccttagaggttcgaggttggctaaggtggacgtcgtagggactagtacgttccacctacgacccagtccggctacgtccgtacggctacgcccgtaggaaagtcttaacgtaccggacttaaacgtttacttaacgttacgttaccaaacttaacgtaacttaaccactttacgtacggtaacgggtcttaacggttacggaccgtaaacggggtaacctaaacgggtaagtaaaccgttaacgacgttacggtacggtcgtacgactaaccgtacttgttactctaccgtacttcccgtaccncgttacg

SEQ ID NO: 157471 - DNA, 617 bp, Homo sapiens
  misc_feature: GYAE6OF02IMXEV.41.71.G05.1.454.CMB.1.raw
  modified_base (268)..(268): a, c, t, g, unknown or other
  misc_feature (268)..(268): n is a, c, g, or t
tcagtctatactatcacgaccggtgctcgatttagtgtcgtcgcaagagagaggggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccggccagtcagttataatattggttgctgtatcagcaagaaccgaggaacncccctaaactcctgatctataaggctactactttagagtagtcgggtcccttagaagttcagtgcagtggatcgtgggacagtacgtcaccctcaaccatcggacacgtccctgaccgacgtccgtaggaaacgtatacgtaccggactaaacttttaattaccgtgtaacctaaaactaattaactaaaccttagtttaacttaccggaacgggtacctaacggtttaccggaccgtaaaacggggacctaaagggttacgtaaaacgttaaccgaacgttggtacggtactacggacctaaccgtattccgttacgttaccttacctactttccccgtaccccgtac

SEQ ID NO: 157472 - DNA, 577 bp, Homo sapiens
  misc_feature: GYAE6OF02FQU1U.41.71.G05.1.454.CMB.1.raw
  modified_base (197)..(197): a, c, t, g, unknown or other
  misc_feature (197)..(197): n is a, c, g, or t
  modified_base (322)..(322): a, c, t, g, unknown or other
  misc_feature (322)..(322): n is a, c, g, or t
tcagtctatactatcacgaccggtgctcgatttagtgtcgtcgcaagagagaggggggagtcagacccagtcaggacacagcatggacatgagggtccccgctcagctcctggggctcctgctgctctggctcccaggtgccaaatgtgacatccagatgacccagtctccttccaccctgtctgcatctgtagganacagagtcaccatcacttgccggcagtcagttatatattggtggcctggtatcagcagaaaccagggaaacgcccctaaactcctgatctataaggcgtactactttagagagtggggtcccttnaaggttcagtggcagtggatcgtgggacagtacgtcaccctcaccagtccgcacgcctgcagcctagaagatacgtcgactaactttattactgtacaaactaataactaactactttatacgtagggtactacgttaccggaccgtaaagggaccctaaagggtacgtaaaacgttaaacggaactagggtcggacgtacgaccgtaacctagttccgttagttacccgttactacttcccgttccccgtaccg

SEQ ID NO: 157473 - DNA, 611 bp, Homo sapiens
  misc_feature: GYAE6OF02F7UFJ.41.71.G05.1.454.CMB.1.raw
tcagtctatactatcacgaccggtgctcgatttagtgtcgtcgcaagagagaggggggggatctcaggaggcagctctctcggaatatctccaccatggcctgggctctgctcctcctcaccctcctcactcagggcacaggatcctgggctcagtctgccctggctcagcctccctccgtgtccgggtctcctggacagtcagtcaccatctcctgcactggaaccaacagtgacgtcggttcgtttgaccgtgtctctggtaccagcacgaccccagaaacacgcccccaaactcattattatgcgtacaatcgttccgcccttccggtcgtccctgacgcgtcttctcgtcgggtccaagtctggacaacgaccggtcctcccgtgaccctactctcgtcgggcctccgacggtcgtaggacggacggaggcgtagtatttagttaccccgtgacgacgtactctaataactaacgaaggttacggaacttactttacgttacgttccggacgtacgacggtaccacgtcgtacggtacccgttaccgtacggtaccacggacccgacggtccgtacccggtcccccgtcggttacctaccgttcccg

SEQ ID NO: 157474 - DNA, 615 bp, Homo sapiens
  misc_feature: GYAE6OF02IKO98.41.71.G05.1.454.CMB.1.raw
  modified_base (199)..(199): a, c, t, g, unknown or other
  misc_feature (199)..(199): n is a, c, g, or t
  modified_base (272)..(272): a, c, t, g, unknown or other
  misc_feature (272)..(272): n is a, c, g, or t
  modified_base (343)..(343): a, c, t, g, unknown or other
  misc_feature (343)..(343): n is a, c, g, or t
  modified_base (362)..(362): a, c, t, g, unknown or other
  misc_feature (362)..(362): n is a, c, g, or t
  modified_base (368)..(368): a, c, t, g, unknown or other
  misc_feature (368)..(368): n is a, c, g, or t
  modified_base (371)..(371): a, c, t, g, unknown or other
  misc_feature (371)..(371): n is a, c, g, or t
  modified_base (390)..(390): a, c, t, g, unknown or other
  misc_feature (390)..(390): n is a, c, g, or t
  modified_base (397)..(397): a, c, t, g, unknown or other
  misc_feature (397)..(397): n is a, c, g, or t
  modified_base (421)..(421): a, c, t, g, unknown or other
  misc_feature (421)..(421): n is a, c, g, or t
tcagtctatactatcacgaccggtgctcgatttagtgtcgtcgcaagagagagggggagtcgagaccagtcaggacacagcatggacatgagggtcccgctcagctcctggggctcctgctgctctggcctcccaggtgaccaaatgtgacatccagatcgaccagtctccttccaccctgtctgcatcgtagtagganacagagtcaccatcacttggccggcagtcagttataatattggtgcctggtatcagcaagaacgagggaaacncccctaaagtcctagattactaagtaacggcttacttacgttagaacgtggtacgggtccttagaaggttnagtgacgtgtagattcggnggaacngtnttccacctcacagtcgganacgtccngtacacgtccgtaagaagtagtcncgtaacttacttacttacgacgtacaaagtaacttagaaaccttagttacgtagtacgggacttaggtaacccggtacaaacggggtaaccaacgggtttaagtaaaaccgtacggttaaacgtggtcgttaaacggctaaccgtaacgttgttaccgttcttaccgttaactaccgttccgtaaccccgtaag

SEQ ID NO: 157475 - DNA, 678 bp, Homo sapiens
  misc_feature: GYAE6OF02IONDA.41.71.G05.1.454.CMB.1.raw
  modified_base (200)..(200): a, c, t, g, unknown or other
  misc_feature (200)..(200): n is a, c, g, or t
tcagtctatactatcacgaccggtgctcgatttagtgtcgtcgcaagagagaggggggagtcagacccagtcaggacacagcatggacatgagggtccccgctcagctcctggggctcctgctgctctggctcccaggtgccaaatgtgacatccagatgacccagtcctccctccaccctgtctgctatctggtagganacagactcaccatcacttggccggcagtcaggttattaataagttggttcggctggtatcagacaacgaaacgagggaaacacccctaaactcctagacttcgtaataaggtcctacttaacgtttagaagtaggttcggggtacccttagtaaggttcaggtggactaggtggtacttcgtagggacaggtacgttaccaccctcacctacgtcgggacacgtacctcgacacgtactaggaatacgtactacgacttaaacttattacgtagtaacaaactaataactaaacctaactttacgttaacgtaggggtaccttaacggttaccggaaccggtaaacggggtaaaccgtaaaggggttaaacggttaaaacgttaaaccggtaacgttgggtaacggtaccgtaaggaaccgtaacccgtaagttccgttacgtcctttaaccgtaccgtttcccgttaccccgtaacc

SEQ ID NO: 157476 - DNA, 628 bp, Homo sapiens
  misc_feature: GYAE6OF02I5PTK.41.71.G05.1.454.CMB.1.raw
  modified_base (200)..(200): a, c, t, g, unknown or other
  misc_feature (200)..(200): n is a, c, g, or t
  modified_base (577)..(577): a, c, t, g, unknown or other
  misc_feature (577)..(577): n is a, c, g, or t
tcagtctatactatcacgaccggtgctcgatttagtgtcgtcgcaagagagaggggggagtcagacccagtcaggacacagcatggacatgagggtccccgctcagctcctggggctcctgctgctctggcctcccaggtgccaaatgtgacatccagactgacccagtcctccttccaccctgtctgcatctgtagganacagatcacctagtccagttcggcccgggacagtcgaagttaattaataacgttggtggactggtatgagcaacgaaacgaggaaacacccctaaatcctagatctaataggccgttatacgttagagtacgtcgggtaccttagaagtcgaggtacgtcagtcggtaatcgagggacaggtacttaccgaccccttgaacctcggtacggaccctagcccgtaggacctacgcctaagaactacgtactacggaccttaacttattacgtacgtactaaacaactaactaactattacgtacgaggtactacgttacggaaccgtaacgggaacgtaaccgggtagtaaaacgtaacgtacgttagtaacgggtanacgtacctacctattaccgttagttacgtacctacttaccgtccctaaccg

SEQ ID NO: 157477 - DNA, 744 bp, Homo sapiens
  misc_feature: GYAE6OF02H8G09.41.71.G05.1.454.CMB.1.raw
  modified_base (199)..(199): a, c, t, g, unknown or other
  misc_feature (199)..(199): n is a, c, g, or t
tcagtctatactatcacgaccggtgctcgatttagtgtcgtcgcaagagagagggggagtcagacccagtcaggacacagcatggacatgaggtcccactcagctcctggggctcctgctgctctggctcccaggtgccaaatgtgacactccagatcgaccctagtcctccgttccacctgtctgcatctagtagganacgagagtcacgatcacttcgaccggccagtacaggtttactaataagttggttgcttggtatacgagacaagaaaccgaggaaacgtacccctaaatctacgatcgtaactaacggtctacgttaactttaggacgttacggttaccggggttaccttacgtaaggttacgtaacggtacggtacggttaacggtaggaacttcccgggaagggtaccggtaaggtaccgttttacccgaaccccttaccggaaccttacggtacccgggtcgtaaccgccggttcgacggaaccgtacccgtagtaaggtactacgtaccgtaacttaaaccctttagttaaccgttcgaaccgtaaaccgtaaacgttaacttaaaccgtaactttacggttaaccgcggggtaaccttaacggttccgggtaaaccgtaacgggtaaccgtaaaacggttaaggttaaaaccttaacggacgttaggtcgtacgtcgtaaccgtaacctagttccgttacgtaccgttacctacgttaccccttccggacg

SEQ ID NO: 157478 - DNA, 595 bp, Homo sapiens
  misc_feature: GYAE6OF02GBM82.41.71.G05.1.454.CMB.1.raw
  modified_base (400)..(400): a, c, t, g, unknown or other
  misc_feature (400)..(400): n is a, c, g, or t
tcagtctatactatcacgaccggtgctcgatttagtgtcgtcgcaagagagaggggggagtcagacccagtcaggacacagcatggacatgagggtccccgctcagctcctggggctcctgctgctctggctcccaggtgccaaatgtgacatcccagatgacccagtctaccttccaccctgtctgcatctgtaggagacagagtcaccatcacttcgccgggcagtcaggttatatattggtgcctggtatcagcagaaaccagggaaacgcccctaaactcctgactctataaggctctactttagagagtcgggtcccttagaaggttcagtggcagtggatcgtgggacaggagttccaccctcaccatccggcacgccgtgcagcctagaagtntactcgactaacttatactgtacaactaatataactacttagtacgagggtactagttaccggactaacgggaaccgtaagggttaacgtaaaacgttaaaccggaacggttaggtaacggtaccttaggaaccctaaccgttagttacccgttagttacccttaccgtaccgtttccccttaccccgtaacccg

SEQ ID NO: 157479 - DNA, 694 bp, Homo sapiens
  misc_feature: GYAE6OF02H4YHG.41.71.G05.1.454.CMB.1.raw
  modified_base (199)..(199): a, c, t, g, unknown or other
  misc_feature (199)..(199): n is a, c, g, or t
tcagtctatactatcacgaccggtgctcgatttagtgtcgtcgcaagagagaggggggagtcagacccagtcaggacacagcatggacatgagggtccccgctcagctcctggggctcctgctgctctggctcccaggtgccaaatgtgacatccagatgacccagtctccttccacctgtctgcatctgtaggagacngagtcacatcacttgccggcagtcgagttataatattggttgcctggtatcagcagaaacgaggaacaccctaactctagtatctagtagcgtacttactagagtaggtcgggtacccttagaacggttcaggtcggacgtaggtggtaactcggtacggggactaaggtacggtttccaacccctacgaccgtacgtcgggcctacgccgtgtaccgacgtcctagaacgtagtacgtcgtaaccttaagtttacttaccgtagtaacctaaaacgtattaaactaaacctacgttttaacgttaacggtacgggggtaccttaacggttacccgggaaccggtaaaacgggtacccgttaaaaggggttaaacggttaaaaccgttaaaaccgggtaacggttagggtcgggttaaccgtacggtacccgtaaccctaggttcccgttagttacccctttacggtaacccctttcccggtttaccccgtaacc

SEQ ID NO: 157480 - DNA, 917 bp, Homo sapiens
  misc_feature: GYAE6OF02H7K1F.41.71.G05.1.454.CMB.1.raw
  modified_base (281)..(281): a, c, t, g, unknown or other
  misc_feature (281)..(281): n is a, c, g, or t
tcagtctatactatcacgaccggtgctcgatttagtgtcgtcgcaagagagagggggagtcagacccagtcaggacacagcatggacatgagggtccccgctcagctcctggggctcctgctgctctggcctcccaggtcgaccaaatgtgacagtccagatcgacccagtctccttccgacctgtctagctatctgtaaggactacagacgtcaccatctacgttcggacccgggtcaagtaccgtaggtttaataaattagttggttcgaccttggtanccgtaagctaacggaaacgaagggaaccgtacccctaaaactctacggtactacgttaacgtaacggtcgttaaccgtttagttaacggacggtacgggtttacccgggttcctttacggtaacggttccgaagggttccggacgtaagggtaccggtaagttccgggtagggtaaccaagggttacccgttaccctaacccgtacccgtaccgaccggtaccggggtaactccggtaccgttacggtacccgaacgggttacccgttaaagggaaactttacgtacccggttaaacgtaacggttttaaaaccccttttaagttaaccccggttattaaaaacccccgtaaagtttaaactaaccggttaaaacccttacgggtttttaaaccgaaacccggggtaccgggttaacttacccgggttaaacccggggaacccgggtttaaaacgggaaaccggtttaaaacgggttaaacccgggtttaaaaaacccttttaaacccgggggtaacccgggtttaacgggggttggaaccccctttcgggaaaccctttaaccccgaccggtttttaccgtaactttaccccggttttaccctaacccgttttacccccggggtccccctaaacg

SEQ ID NO: 157481 - DNA, 723 bp, Homo sapiens
  misc_feature: GYAE6OF02F1KWG.41.71.G05.1.454.CMB.1.raw
tcagtctatactatcacgaccggtgctcgatttagtgtcgtcgcaagagagagggggacccaaaaaccacatccctccttgggagaatcccctagatcacagctcttcaccatggactggacctggagcatccttttcttggtgacagcagcaacaggtgccctatcccaggttcagctggtgcaatcgtggagtctgaggtgaagaagccgtggggcctcgaggtagaaggtcctcctagacaagtaccttcgtacggttaccacgtaccttttaacctccttagttggtcgttacgttacgttcgggtcgtaccgacgaccgggtccccgtagggaccggtacgggggtcttacgggaggttacgggtaggttggggagttacgggtacgttacgggttaacggggttaactaagttacgggtaactacgaagtacgtagtcgaacgaacgaaggtaacgttacggacggtacgaacgtaacgtaccgaacacgtaacgacccgaagaccgacgacgacgtaccggacgacgaccgacaccgtactacgtaggtagtaggtacgacgacgtccgtagacgtacgtcgtacggaccgtacgtaccgtccttacgttacgtttccggtaggtcggaccgggtacgggaaacgtacctacgttccgtacggttacccttcccggttacgttccgtcgggtacggtacccggttaggtacccggg

SEQ ID NO: 157482 - DNA, 629 bp, Homo sapiens
  misc_feature: GYAE6OF02JX8AY.41.71.G05.1.454.CMB.1.raw
  modified_base (197)..(197): a, c, t, g, unknown or other
  misc_feature (197)..(197): n is a, c, g, or t
  modified_base (273)..(273): a, c, t, g, unknown or other
  misc_feature (273)..(273): n is a, c, g, or t
  modified_base (303)..(303): a, c, t, g, unknown or other
  misc_feature (303)..(303): n is a, c, g, or t
  modified_base (340)..(340): a, c, t, g, unknown or other
  misc_feature (340)..(340): n is a, c, g, or t
  modified_base (381)..(381): a, c, t, g, unknown or other
  misc_feature (381)..(381): n is a, c, g, or t
  modified_base (426)..(426): a, c, t, g, unknown or other
  misc_feature (426)..(426): n is a, c, g, or t
  modified_base (563)..(563): a, c, t, g, unknown or other
  misc_feature (563)..(563): n is a, c, g, or t
tcagtctatactatcacgaccggtgctcgatttagtgtcgtcgcaagagagagggggagtcagacccagtcaggacacagcatggacatgagggtccccgctcagctcctgggctcctgctgctctggcctcccaggtcgaccaaatgtgacatccagatgacccagtctccttccaccctgtctgcatctgtaganacagatcaccatcactgccgggaccagtcaaggttactaagtacttggttcgactggtatcgagtacacgaaaccnggaaacgcccctaaatcctagactactaanaggtcgtaccttagttagaggtagtagggtcccttanaaggtccaagtacgcgtaagtgactacgtcggacaacggtnttacccaaccctcaacccgtaagtccggcaacgtcctagacccgngtcccgtaagaagttctacgtcgaccttaagttaacttcctagtccaaaagtactacgtaaacctactttagtcggtaacggtagtacttccggaagttaaccggaaacctaaagggttacgtaaaacgtttaacgngtttcgtcgggaactaccggacttacctagtcccgttagtccgtataacccggttcctacccgtac

SEQ ID NO: 157483 - DNA, 146 bp, Homo sapiens
  misc_feature: GYAE6OF01BTX3S.2.83.H06.1.454.CMB.1.raw
  modified_base (127)..(146): a, c, t, g, unknown or other
  misc_feature (127)..(146): n is a, c, g, or t
tcagacgctcgacacacgaccggtgctcgatttagatcacgtgcgtcgcgggctggcaaggcgcatagctgcctggtcaaggactacttcctgtcgagcgtctgagcgggctggcaaggcgcatagnnnnnnnnnnnnnnnnnnnn

SEQ ID NO: 157484 - DNA, 138 bp, Homo sapiens
  misc_feature: GYAE6OF01BLP2U.2.83.H06.1.454.CMB.1.raw
  modified_base (127)..(138): a, c, t, g, unknown or other
  misc_feature (127)..(138): n is a, c, g, or t
tcagacgctcgacacacgaccggtgctcgatttagatcacgtgcgtcgcgggctggcaaggcgcatagctgcctggtcaaggactacttcctgtcgagcgtctgagcgggctggcaaggcgcatagnnnnnnnnnnnn

SEQ ID NO: 157485 - DNA, 493 bp, Homo sapiens
  misc_feature: GYAE6OF01AXSE6.44.76.G10.1.454.CMB.1.raw
  modified_base (196)..(196): a, c, t, g, unknown or other
  misc_feature (196)..(196): n is a, c, g, or t
tcagacagtatatacacgaccggtgctcgatttagtcactcatacagggggaggaactgctcagttaggacccagacggaaccatggaagccccagcgcagcttctcttcctcctgctactctggctcccagacaccactggagaaatagtgatgacgcagtctccagccaccctgtctctgtctccaggggaaanagccaccctctcctgcagggccagtcagagtgttggcagcagcgtagcctggttccagcagaaacctggccagactcccaggctcctcatctatgatgcatccaacagggtcactggcaccccagacaggttcagtggcagtgggtctgggacagacttcactctcaccgtcagcaatgtacagcctgaagtattttgctagtttattactgtcagcagtcgttcctccaggccgctcactttcggcggggtaccaggtggagagtcgagacgacgtgtggcgtgcaccatctgttc

SEQ ID NO: 157486 - DNA, 584 bp, Homo sapiens
  misc_feature: GYAE6OF01B9E8G.44.76.G10.1.454.CMB.1.raw
  modified_base (197)..(197): a, c, t, g, unknown or other
  misc_feature (197)..(197): n is a, c, g, or t
  modified_base (226)..(226): a, c, t, g, unknown or other
  misc_feature (226)..(226): n is a, c, g, or t
  modified_base (286)..(286): a, c, t, g, unknown or other
  misc_feature (286)..(286): n is a, c, g, or t
tcagacagtatatacacgaccggtgctcgatttagtcactcatacagggggaggaactgctcagttaggacccagacggaaccatggaagccccagcgcagcttctcttcctcctgctactctggctcccagacaccactggagaaatagtgatgacgcagtctccagccaccctgtctctgtctccgaggggaaancgccaccctctcctgcagggccagtcagngtgtggcagcagcgtagccgtggtccagcaagaaccgtgggcaggctccgaggtcctccncatcctaataccactactcccgaccgacgggccctacgtcggtacctcccgacggcccagtacttcgaggttcggcacgtggggtctgggacaggtacgttccacttctaccacatcgagcacgcctgctagtctagtaagttattttgctttaagtttacttacgtgttacagtctagtattaggtgtacgtcgtccttccgttctaccgtttccggcccgtacggaccctacgtacgttaccgttaactttacgaaaccgttacgtaggttcggactcgtacctacgtacgttccg

SEQ ID NO: 157487 - DNA, 547 bp, Homo sapiens
  misc_feature: GYAE6OF01AL3DM.44.76.G10.1.454.CMB.1.raw
  modified_base (197)..(197): a, c, t, g, unknown or other
  misc_feature (197)..(197): n is a, c, g, or t
  modified_base (315)..(315): a, c, t, g, unknown or other
  misc_feature (315)..(315): n is a, c, g, or t
  modified_base (544)..(544): a, c, t, g, unknown or other
  misc_feature (544)..(544): n is a, c, g, or t
tcagacagtatatacacgaccggtgctcgatttagtcactcatacagggggaggaactgctcagttaggacccagacggaaccatggaagccccagcgcagcttctcttcctcctgctactctggctcccagacaccactggagaaatagtgatgacgcagtctccagccaccctgtctgtgtctccgaggggaaanagccaccctctcctgcagggccagtcagagtgttaccagcaacttagcctggtaccacagaaacctgggcaggctccaggctcctcatctatggaacatccacagggccactggtacnccccaccaggttcagtggcaggtcgggtccgggacaggacgttcactctacaccatcaggccgctgcagtctggaggtatttgcttagtttatacttgtcagtctagtataataacgtcgtccttctcgtacggtttccgggacgggggtaaccgtaagggtggaagtacgtacgaaacggtactggtcggcgtcgacactgtcttgtacttctacttccttcccgctntcg

SEQ ID NO: 157488 - DNA, 511 bp, Homo sapiens
  misc_feature: GYAE6OF01DXBO1.44.76.G10.1.454.CMB.1.raw
  modified_base (196)..(196): a, c, t, g, unknown or other
  misc_feature (196)..(196): n is a, c, g, or t
  modified_base (447)..(447): a, c, t, g, unknown or other
  misc_feature (447)..(447): n is a, c, g, or t
  modified_base (504)..(504): a, c, t, g, unknown or other
  misc_feature (504)..(504): n is a, c, g, or t
tcagacagtatatacacgaccggtgctcgatttagtcactcatacagggggaggaactgctcagttaggacccagacggaaccatggaagccccagcgcagcttctcttcctcctgctactctggctcccagacaccactggagaaatagtgatgacgcagtctccagccaccctgtctctgtctccaggggaaanagccaccctctcctgcagggccagtcagagtgttggcagcagcgtagccttgttccagcagaacctggccagactccaggctcctcatctataccacactcccaccagggccactggtactcccagccagacttcgagtggcacgttgggtctgggacaggagttcacttctcaacctatcagcacgcctgcagtctagaagtattttgactagtttattactgtcagtctaagtaataataactgtcctntactacgttcggacggggtacaggtggagagtacaacggtactggtgctagacactntcgtgtc

SEQ ID NO: 157489 - DNA, 682 bp, Homo sapiens
  misc_feature: GYAE6OF01D1IN4.44.76.G10.1.454.CMB.1.raw
  modified_base (197)..(197): a, c, t, g, unknown or other
  misc_feature (197)..(197): n is a, c, g, or t
tcagacagtatatacacgaccggtgctcgatttagtcactcatacagggggaggaactgctcagttaggacccagacggaaccatggaagccccagcgcagcttctcttcctcctgctactctggctcccagacaccactggagaaatagtgatgacgcagtctccagccaccctgtctctgtctccgaggggaaancgcccaccctctcctgcagggccagtcagagtgttggcagcagcgtagcctggttccagcagaacctggccagacctccgaggcctcctcactcctactaccactactcccaccgacgggccacgtcggtactcccgagccagtacttcgacggttgacctacgtcggggtctagggactaggtacgttccaacttcctacgacctatccgagccgacgtccgtgacctagtaccgtaggtaacgttcgttttacgacgtttaacgttttaactttacgttcgttacgtacggttacgtaaggttaacgttacggttacgttaaccgttccgggttccccgttttacccggtttaccgttaacccggtttttccccgggacccgttaccgggtaaaccttaccggtacgttacccggttaacttttacccggtaaaaccggttaccgttcggtacggtacctacgtccctaaccgtagtttcccg

SEQ ID NO: 157490 - DNA, 740 bp, Homo sapiens
  misc_feature: GYAE6OF01CCHNS.44.76.G10.1.454.CMB.1.raw
  modified_base (198)..(198): a, c, t, g, unknown or other
  misc_feature (198)..(198): n is a, c, g, or t
tcagacagtatatacacgaccggtgctcgatttagtcactcatacagggggaggaactgctcagttaggacccagacggaaccatggaagccccagcgcagcttctcttcctcctgctactctggctcccagataccactggagaaatagtgatgacgcagtctccagcccaccctgtctgtgtctccgaggggaaanagcccaccctctcctgcagggccagtcagagtgttaccagcaacttagcctaggtaccacagaaaccgtgggcaggcctcccgaggtcctcctcatctagtacggaacatcccaccgacgggccctacgttcggtaacctcccccgaacccgtaggtttccgaggtcgggcgtacgggtcggggtaccgggactacggtacgttccgaacttccgtaccaacccgtacgttaccgaacggtcccggtcccttggaccgtacggttccgtagggtacgggtttatttttacgggactttaaggtttttacttacgttacggttaccaggtccgtacggttccccgtttacccttcccggacggtccccgtcttcccgttaaccgggttttccggggggaccgggggtaacccgttaaggggtcggtaacggtacgtaacgaacggtaaccgtaacgttcgggtacggccgttacggacctaacccgtcgttaccggtttcgttaccctttaccgtaaccttccccgtttcccgccgttaaccg

SEQ ID NO: 157491 - DNA, 533 bp, Homo sapiens
  misc_feature: GYAE6OF01C0QZ9.44.76.G10.1.454.CMB.1.raw
  modified_base (198)..(198): a, c, t, g, unknown or other
  misc_feature (198)..(198): n is a, c, g, or t
  modified_base (279)..(279): a, c, t, g, unknown or other
  misc_feature (279)..(279): n is a, c, g, or t
  modified_base (290)..(291): a, c, t, g, unknown or other
  misc_feature (290)..(291): n is a, c, g, or t
  modified_base (360)..(360): a, c, t, g, unknown or other
  misc_feature (360)..(360): n is a, c, g, or t
  modified_base (384)..(384): a, c, t, g, unknown or other
  misc_feature (384)..(384): n is a, c, g, or t
  modified_base (389)..(389): a, c, t, g, unknown or other
  misc_feature (389)..(389): n is a, c, g, or t
  modified_base (527)..(527): a, c, t, g, unknown or other
  misc_feature (527)..(527): n is a, c, g, or t
tcagacagtatatacacgaccggtgctcgatttagtcactcatacaggggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaanagccaccctctcctgcagggccagtcagagtgttaccagcaacttagcctggtaccacagaacctggcaggctccagctcnatctatgaacnnccacgaggccactggtactcccaccaggttcagtgcaggtggtccggacagtacgttcactctacaccntcacggcgcctgcagtctggagtntttgntagtttatactgtcagtctagtattaatacgtggtcctcgtcgtacgtttcggggacggggacctagggtgagtataacgaaacgtacgtgtggctcggaccacctagttccgtgttccttacgtacttcccgtcccntagtcg

SEQ ID NO: 157492 - DNA, 739 bp, Homo sapiens
  misc_feature: GYAE6OF01BYNV4.44.76.G10.1.454.CMB.1.raw
  modified_base (196)..(196): a, c, t, g, unknown or other
  misc_feature (196)..(196): n is a, c, g, or t
  modified_base (225)..(225): a, c, t, g, unknown or other
  misc_feature (225)..(225): n is a, c, g, or t
  modified_base (234)..(234): a, c, t, g, unknown or other
  misc_feature (234)..(234): n is a, c, g, or t
  modified_base (287)..(287): a, c, t, g, unknown or other
  misc_feature (287)..(287): n is a, c, g, or t
tcagacagtatatacacgaccggtgctcgatttagtcactcatacagggggaggaactgctcagttaggacccagacggaaccatggaagccccagcgcagcttctcttcctcctgctactctggctcccagacaccactggagaaatagtgatgacgcagtctccagccaccctgtctctgtctccgaggggaancgccaccctctcctgcagggccagtcagngtgttggcngcagcgtagcctggttccagtcacgaacctggccagacctccgaggtcctccncatcctactaccacactcccaccgacgggccctacgtcggactccccgagacctaagtacttcgaggtcggacgtaccggtgggggttcctagggggtaaccagggtacgtttacccgacttccgtaccaacccgtacttccgacgacccgtaaggtccccgtaggacccgttaacggttcgtaacgggttaaacgtttgttttacgtaacgtttacgtttttaacgtttaccgttcgttaccgtaacgttcgtaaggtttaacgttacggttacggtacccgttccgggttccccgtttaccggttttaccgttaacccggttttcccgggtaaccccggttacggggtaacccctaccggtttacgggttaaccgttaacgtttaacccgaaaaccggttaccgttcgggttaccggcccgttaacgccctaaacccgttgtttacccgg

SEQ ID NO: 157493 - DNA, 887 bp, Homo sapiens
  misc_feature: GYAE6OF01A9BQ1.44.76.G10.1.454.CMB.1.raw
  modified_base (163)..(163): a, c, t, g, unknown or other
  misc_feature (163)..(163): n is a, c, g, or t
  modified_base (180)..(180): a, c, t, g, unknown or other
  misc_feature (180)..(180): n is a, c, g, or t
  modified_base (198)..(198): a, c, t, g, unknown or other
  misc_feature (198)..(198): n is a, c, g, or t
  modified_base (229)..(229): a, c, t, g, unknown or other
  misc_feature (229)..(229): n is a, c, g, or t
tcagacagtatatacacgaccggtgctcgatttagtcactcatacagggggaggaactgctcagttaggacccagacggaaccatggaagccccagcgcagcttctcttcctctgctactctggctcccagacaccactggaagaaatgtgatgacgcagtcnccagcccacctgtcctntcgtcctcgaaggggaancgcccacctcgcctgcgaggcctacgtgagngtgtggcaggcaggtcgtacgccgtcggtaccagaccgtaacgaaccgtggacccaacgtacccttacccggaggtcctacccctacgtacctacctactaacccaaccgtacctacccgaaccgaccgggtaccctacggttacccggtaacgtcccccgaacgtacccgtaacggtttaaccttacggtacggtaccgtacccgggttaccggttacgggggttaacccggtaacggggtaaccgttaccgggtttaaccgggtttacccctaaccgtttacccgacccggtaaacccttaaccggttaacccgaacggtaccggttaacccgccccgtttagggtaaccgttacggtttaacccgttaagggttaaaccgtttacgtttttacgtaaccggtttttaaagttttaaccgtttaaccgttacggttacccgttaaaggacggtttaaacggtttacggttaacgttaaccgttaccggttacccggttaccgttttccccggttaccttaccccggtttcccgggtaaccggtttcccgggtaaaccccttacggtttacccggttaacttaccggttttaaaccgaacccgggttacggttccggtaacggttacccttacggaaccgttcccgtaaggttcccg

SEQ ID NO: 157494 - DNA, 705 bp, Homo sapiens
  misc_feature: GYAE6OF01EY2CJ.44.76.G10.1.454.CMB.1.raw
  modified_base (203)..(203): a, c, t, g, unknown or other
  misc_feature (203)..(203): n is a, c, g, or t
  modified_base (210)..(210): a, c, t, g, unknown or other
  misc_feature (210)..(210): n is a, c, g, or t
  modified_base (566)..(566): a, c, t, g, unknown or other
  misc_feature (566)..(566): n is a, c, g, or t
  modified_base (675)..(675): a, c, t, g, unknown or other
  misc_feature (675)..(675): n is a, c, g, or t
tcagacagtatatacacgaccggtgctcgattttagtcactcatacaggggggaggaactgctcagttaggacccagacggaaccatggaagccccagcgcagcttctcttcctcctgctactctggcctcccagaccaccacgtggaagaaatagtgatgacgcagtctccagccaccctgtctcgtgtctcgaaggggaancgacccncctctcctgacgacgggtccagtcgtaaggtagttgttcggacacggcgaaggtcgttacggtcctgggttccaggacgaacgaaaccgtcggacctacggacctacccgacggtcctaccgtctattacctacgtaccacacctacccgaccggacggtacctacggttcgtaccctaccccgagacccgaagtacgttacggtaacgtcgggtacctacggttacgggcggttaagggaactcggtaacttctaacgtcgtactaacctaagtcgaacggacaccgtacgtcgtacgtacgttaacgtaaggttaaacgttcttttaacggacgtttaaacgttttctaccgtntaccgagtacgtagttaacgtacgtacgttccgtaacgttccgttaccgttacgtccggtacccgttaccgtacgaactacggtacgttacgtaacttaaccgtaaacncgtacgtcttaccagtaccgattccggtac

SEQ ID NO: 157495 - DNA, 652 bp, Homo sapiens
  misc_feature: GYAE6OF01A3CUL.44.76.G10.1.454.CMB.1.raw
  modified_base (210)..(210): a, c, t, g, unknown or other
  misc_feature (210)..(210): n is a, c, g, or t
  modified_base (541)..(541): a, c, t, g, unknown or other
  misc_feature (541)..(541): n is a, c, g, or t
  modified_base (547)..(547): a, c, t, g, unknown or other
  misc_feature (547)..(547): n is a, c, g, or t
tcagacagtatatacacgaccggtgctcgatttagtcactcatacagggggaggaactgctcagttaggacccagacggaaccatggaagccccagcgcagcttcctcttcctcctgctactctggctcccagacaccactggaagaatagtgatgacgctagtcctaccacgccacccgtgtcctctcgtcctaccggaaggggaaacnccgccctaccctccgtaccgtggaccgacgggaccctaggtccgaggtagtgttcggacgagcgaggcgtacgtccgttcggttaccgagtacgaacgtaaccgtcggacccgagtacccgtaccgacggtcctaccgtcgtactaccgtactacccaacctaccgtcccgaaccgacggtaccctaacgtaccggtacctacccgagtaccacgtactacgacggtcgactacggtcggtacgcggatacgtcgtacactccacaccgtatacgcgtacaccgtcgtcgacgtcgttacgtaagtagttcgttacgtcgttagttacgtntcgtanactagtgtactagtcgtgtcgtcgtcgttaccgtccgtcgtccgtacgacctagtacgtagtacgttaacgacgttcgtatacggtcgtactacgtcttgttccg

SEQ ID NO: 157496 - DNA, 736 bp, Homo sapiens
  misc_feature: GYAE6OF01CMYVH.44.76.G10.1.454.CMB.1.raw
  modified_base (145)..(145): a, c, t, g, unknown or other
  misc_feature (145)..(145): n is a, c, g, or t
  modified_base (200)..(200): a, c, t, g, unknown or other
  misc_feature (200)..(200): n is a, c, g, or t
tcagacagtatatacacgaccggtgctcgatttagtcactcatacagggggaggaactgctcagttaggacccagacggaaccatggaagccccagcgcagcttctcttcctcctgctactctggctcccagacaccacgtgganaaatagtgatgacgcagtcctcagccaccctgtctctgtcctccgaaggggaaancgccctacccgtctcctgccgagggcccagtcagtagttgtcggcagcgaggtcgtagtccgttggttaccagaccgaacggtaaaaccgttcggacccgaacgtacccgtaccccgaacggtcctccctactacttcctaacctacctaccacctacccgaacccgtacgggccctaacgtacggtaccttacccgacgaccgtacgtaacgtttacgaggttcggaccgtacggttcggggtacgttacgggaacgtacgtacggttacctaccgttacctaccacgtactacgacgcacgtcctcggactacggtctaagtagttacgtttagtactttaacggtttacttagtaacgttctacggttacgtagttagtttacgggttacgtaccgtaccgttcgtacggtacggttaccggaaccggtaaccggtaaaccgtaagggtaaaccgttaaacgtaccgtaaaaccggtcgttaaccggtacgtaacgttacgacccgtacgtaaccttccgttacggttaaccc

SEQ ID NO: 157497 - DNA, 575 bp, Homo sapiens
  misc_feature: GYAE6OF02IDE0O.44.76.G10.1.454.CMB.1.raw
  modified_base (193)..(193): a, c, t, g, unknown or other
  misc_feature (193)..(193): n is a, c, g, or t
tcagacagtatatacacgaccggtgctcgatttagtcactcatacagggggaggaactgctcagttaggacccagacggaaccatggaagccccagcgcagcttctcttcctcctgctactctggctcccagataccaccggagaaattgtgttgacgcagtctccaggcaccctgtcttgtctccagggganagagccaccctctcctgtaggccagtcggagtgttgctaagtacctagcctggtaccacagaaacctgggcaggctcccaggctcctcatctatggaacatccaccagggccactggtactcccaccaggttcagtcggcaggtgggtccggacagagttcactctcaccatcagcgcctgcagtctgagtatttgctagttttatactgtcagctagtataattacgtgccttctctacgtttcgggacggggtacctaagggtcggtaagtagtaaccgaaacgtacgtggtacggtctacggccacctagtcgttcgttacttaccgtaacgttcccgtttaccccgaccttacgttccgttacgtacttagttaaccg

SEQ ID NO: 157498 - DNA, 677 bp, Homo sapiens
  misc_feature: GYAE6OF02HETX4.44.76.G10.1.454.CMB.1.raw
  modified_base (197)..(197): a, c, t, g, unknown or other
  misc_feature (197)..(197): n is a, c, g, or t
tcagacagtatatacacgaccggtgctcgatttagtcactcatacagggggaggaactgctcagttaggacccagacggaaccatggaagccccagcgcagcttctcttcctcctgctactctggctcccagacaccactggagaaatagtgatgacgcagtctccagccaccctgtctctgtctccgaggggaaangccacctctcctgcagggccagtcagagtgttggcagcagcgtagcctggttccagcagaacctggccagactccaggcctcctcatctataccacactccaccgagggcccacgtcggtactccccgaagcccaagtacttccgaaggtcggtaccacggttggggttacctaggggactagggtacgtttccaaccttcctaccaaccctatccaacggtacctaacggtccctacggacctacggttcttaggtaaacgttacgtttttcggaccgtttaaggttttaacttacgttacgtactaacggtcgtaagtttacgttaggttcgtaaccgttcgggtcccgtttacccggttaccttaccggttttcccgggaccccgttgggaacccctacggtaacggttccgtaacttttaacccgaaacgttaccgttacggttcggtaccttacggtaccgtaccgtacttcccg

SEQ ID NO: 157499 - DNA, 683 bp, Homo sapiens
  misc_feature: GYAE6OF02ISRRF.44.76.G10.1.454.CMB.1.raw
  modified_base (198)..(198): a, c, t, g, unknown or other
  misc_feature (198)..(198): n is a, c, g, or t
tcagacagtatatacacgaccggtgctcgatttagtcactcatacagggggaggaactgctcagttaggacccagacggaaccatggaagccccagcgcagcttctcttcctcctgctactctggctcccagataccactggagaaatagtgatgacgcggtctccagccaccctgtctgtgtctccgaaggggaaancgcccaccctctcctgcagggccagtcagagtgtagcagctaacttgcctcgtaccagcaagaaatcgtggccaggcctacccgaggcctcctcactctagtcggtcgacactcccacgacgggccacgtcggctactcccgacgccccgtacttcgacgtcggactagggtcgggtctacggggactacgtaccttcaccgttctaccaacctactaccaacctacgaccctaacggacgtaccgttagaaagtttacttttggacctttaagttttaacttacgttcgttacctaaccgtaacgtaaaggtacgtccggtaccctaccgtaatttacgttacccgtacgttttcccgggacccgttaacgggtaacctaaaggttacggtaacttaaccgttaacggaaaaccgttaccgtaggttaccggtaccgtaccggtacctaacccgttagttccgtttaccggtacctttaacccg

SEQ ID NO: 157500 - DNA, 505 bp, Homo sapiens
  misc_feature: GYAE6OF02FZPZ2.44.76.G10.1.454.CMB.1.raw
  modified_base (196)..(196): a, c, t, g, unknown or other
  misc_feature (196)..(196): n is a, c, g, or t
tcagacagtatatacacgaccggtgctcgatttagtcactcatacagggggaggaactgctcagttaggacccagacggaaccatggaagccccagcgcagcttctcttcctcctgctactctggctcccagacaccactggagaaatagtgatgacgcagtctccagccaccctgtctctgtctccaggggaaanagccaccctctcctgcagggccagtcagagtgttggcagcagcgtagcctggttccagcagaaacctggccagactcccaggctcctcatctataccacatccaccagggcccactggtactcccagccagacttcagtcgcactgggtctgggacagagttcactctcacatcagcagcctgcacgtctgaggtattttgcgtagtttattactgtcagtcagtataatacgtgccttctctacgttcggcgggggacctaggtggagatacgaaacgtaactaggtgtcgtgccgacgatccgtgtc

SEQ ID NO: 157501 - DNA, 578 bp, Homo sapiens
  misc_feature: GYAE6OF02I8RR3.44.76.G10.1.454.CMB.1.raw
  modified_base (195)..(195): a, c, t, g, unknown or other
  misc_feature (195)..(195): n is a, c, g, or t
  modified_base (394)..(394): a, c, t, g, unknown or other
  misc_feature (394)..(394): n is a, c, g, or t
tcagacagtatatacacgaccggtgctcgatttagtcactcatacagggggaggaactgctcagttaggacccagacggaaccatggaagccccagctcagcttctcttcctcctgctactctggctcccagagatcaccggagatattgtgttgacacagtctccaggcaccctgtctttgtctccaggggganagagccaccctctcctgtagggccagtcggagtgttgctaagtacctagcctggaccaacagaaacctggccaggctccaggctcctcatctatgatgcatccaacagggtcactggccaccccagaccaggttcagtggcaggtgggtcgtgggacagtacttcactctcaccgtcagcaatgtacagcctagaagtntttgcttagtttatactgtacagctagtccgttcctccgacgggcccgtctccgttaccggtttccgggggccgggggtaacctaaggggtcgaacgagtacgaggacgtaacgtggtacggtcctacggtaccaccgtagttccgttcggttcctttacgacctttcccgttaccccgtaccg

SEQ ID NO: 157502 - DNA, 628 bp, Homo sapiens
  misc_feature: GYAE6OF02JXVLU.44.76.G10.1.454.CMB.1.raw
  modified_base (193)..(193): a, c, t, g, unknown or other
  misc_feature (193)..(193): n is a, c, g, or t
  modified_base (296)..(296): a, c, t, g, unknown or other
  misc_feature (296)..(296): n is a, c, g, or t
  modified_base (307)..(307): a, c, t, g, unknown or other
  misc_feature (307)..(307): n is a, c, g, or t
  modified_base (324)..(324): a, c, t, g, unknown or other
  misc_feature (324)..(324): n is a, c, g, or t
tcagacagtatatacacgaccggtgctcgatttagtcactcatacaggggaggaacgtgctcagttaggacccagacggaaccatggaagcccagcgcagcttctcttcctctgctactctggctcccagacaccactggagaaatagtgatgacgcggtctcagccacctgtctgtcgtctccgaggggaanagccaccctctcctgcagggccagtcagtagtgttagcagcaacttgcctgtaccagcaagaactcgtggcaggcctccgaggcctcgtacatctagtcggtncatccgaccgngggccctactggtaccnccgagtcctacggttcacgtcggacgtaggtcggtcgagggactagtcttcgaccgttccacgacctagtacgacggtccggtcgtcgcgtagtcgtaggtacggttatttcggagttaacgtttacgtacgttcgtacgtacgtacgtacgtttacgtgttaccttactccgtaacttcgttacgttaccggtcggtaaccggtaacgggttaccgtacgggttacgtaaacgtacggtaaaccggtacgttacggtacgtacgttacgaccgtaacgtacgtttaccgttacgttacctacg

SEQ ID NO: 157503 - DNA, 581 bp, Homo sapiens
  misc_feature: GYAE6OF02GKMQA.44.76.G10.1.454.CMB.1.raw
  modified_base (196)..(196): a, c, t, g, unknown or other
  misc_feature (196)..(196): n is a, c, g, or t
  modified_base (361)..(361): a, c, t, g, unknown or other
  misc_feature (361)..(361): n is a, c, g, or t
  modified_base (395)..(395): a, c, t, g, unknown or other
  misc_feature (395)..(395): n is a, c, g, or t
tcagacagtatatacacgaccggtgctcgatttagtcactcatacagggggaggaactgctcagttaggacccagacggaaccatggaagccccagcgcagcttctcttcctcctgctactctggctcccagacaccactggagaaatagtgatgacgcagtctccagccaccctgtctctgtctccaggggaaanagccaccctctcctgcagggccagtcagagtgttggcagcagcgtagcctggttccagcagaacctggccagactcccaggctcctcatctataccacactccaccagggccactggtactcccagccagattcagtcgcacgtggtctggacagagttcactcncacatcagcagcctgcagtctagaagtagttttncgtagttttacttactcgttctaactaccgttaagtaaacgttcggtacccttactaacgttattccgtaacttttaccgggaccccgttacggggtaaccctaaacggttacgggtaacttaacgttaccaaaacgtaaccgttaggtacggttacgtcgtaccctaacccgtacttccgttacg

SEQ ID NO: 157504 - DNA, 639 bp, Homo sapiens
  misc_feature: GYAE6OF02H7V9P.44.76.G10.1.454.CMB.1.raw
  modified_base (199)..(199): a, c, t, g, unknown or other
  misc_feature (199)..(199): n is a, c, g, or t
  modified_base (229)..(229): a, c, t, g, unknown or other
  misc_feature (229)..(229): n is a, c, g, or t
  modified_base (419)..(419): a, c, t, g, unknown or other
  misc_feature (419)..(419): n is a, c, g, or t
  modified_base (457)..(457): a, c, t, g, unknown or other
  misc_feature (457)..(457): n is a, c, g, or t
tcagacagtatatacacgaccggtgctcgatttagtcactcatacagggggaggaactgctcagttaggacccagacggaaccatggaagccccagcgcagcttctcttcctctgctactctggctcccagacaccactggagaaatagtgatgacgcagtctccagcccaccctgtcctctgtctccgaaggggaaancgcccaccctctcctgcacgggcagtcagngtgtgcagcagcgtagccgttggtccagcaagaaccgtggaccagacctcccgaggccttcctacgattactacttaccacactcccgaaccgacgggccctacgttggtacctccccagccgaagtacgttcaggttcggacctacggtcggggtctaggggaactgggtacttcacctctacgaaccntccgacgtccacgtcctagcgtagtcgtagtaagtttntttacggactttagttttattacgttgtacgtaagcgttaagttaagtacgtacgtccgttcgtacccgtttccgttcttaccgtttccgggacccttcgggaaccctacgtcggttaccgttacgtaacccgtaaacggttacgttcggtaccggtccttacggtacctaccctagttccg

SEQ ID NO: 157505 - DNA, 705 bp, Homo sapiens
  misc_feature: GYAE6OF02IXQW3.44.76.G10.1.454.CMB.1.raw
  modified_base (198)..(198): a, c, t, g, unknown or other
  misc_feature (198)..(198): n is a, c, g, or t
  modified_base (396)..(396): a, c, t, g, unknown or other
  misc_feature (396)..(396): n is a, c, g, or t
tcagacagtatatacacgaccggtgctcgatttagtcactcatacagggggaggaactgctcagttaggacccagacggaaccatggaagccccagcgcagcttctcttcctcctgctactctggctcccagacaccactggagaaatagtgatgacgcagtcctccagccaccctgtcctctgtctaccgagggaancgcccaccctctcctgccacgggccagtcagagtgtcggcagcagcgtagccgtggttccagacaacgaaacccgtcggaccacgaccctcccgacggtcctcctcatactactaccacactccaccgacggccacgtcgtactcccacgccagtcttcgagtcgactacgtcgggtacgtcggactagtacttaccncctaccgtccgtacccgtcacgtactaagttcgtaacgacgtcgtacgtaacgttacttttacgtacgttaacggttttaactttaccgttcggttacctacggtccgtacgttcccgtttacccgttacccggtacggtcccgtaccgttaccggttacccgggttttaccgggggacccggggtaaaccggtacggggtaccgggtaggtaccggtaccggaacgggtaacccggtaacggtttacggtcgggtaccgtaccggtaccgtacccgttacggttccgtttacggtccctttaacccgg

SEQ ID NO: 157506 - DNA, 756 bp, Homo sapiens
  misc_feature: GYAE6OF02GGFF3.44.76.G10.1.454.CMB.1.raw
  modified_base (161)..(161): a, c, t, g, unknown or other
  misc_feature (161)..(161): n is a, c, g, or t
tcagacagtatatacacgaccggtgctcgatttagtcactcatacagggggaggaactgctcagttaggacccagacggaaccatggaagcccagcgcagcttctcttcctcctgctactctggctacccagacaccacgtggaagaaatagtgatgacgnagtctccacgccacctgtctctgtcaccggagggaacacgcccacctctccgtgcgacggccagtcagtagtggtcgcgacgcgacgtcgtacgccgttcgggtaccacgacgaacgtaaccgtcggaccacgtacccgtccgaacggtcctcccgtaacacttacctaacgtaaccaccgtacctacccgaaccgggacggtaccccagttaccggtacctacccggaacgtacctacgttaaccgtacgtacgggtacgggtaccttacgggttacggggtacgtacggggaactacggggttaaccgttacccgtacttaccgttaaccaaccgtactaccgacgtacggaccgtacggtacgcgttaacgtacgttaaggtaacgtttcgttacggttacgttagttttacgttacgttcgtaacgtcgtaacgttaggttaacgttacggttacgtaccggttaccgtttccgttaccgtttaccgttccggttaccgggtacccggttagaccgtacggtacggttaccttaacgttaaacggtaccgttacggtcgtaccgtacgtacgtacccgttactacggttcc

SEQ ID NO: 157507 - DNA, 745 bp, Homo sapiens
  misc_feature: GYAE6OF02FZA9I.44.76.G10.1.454.CMB.1.raw
  modified_base (146)..(146): a, c, t, g, unknown or other
  misc_feature (146)..(146): n is a, c, g, or t
  modified_base (289)..(289): a, c, t, g, unknown or other
  misc_feature (289)..(289): n is a, c, g, or t
  modified_base (355)..(355): a, c, t, g, unknown or other
  misc_feature (355)..(355): n is a, c, g, or t
tcagacagtatatacacgaccggtgctcgatttagtcactcatacagggggaggaactgctcagttaggacccagacggaaccatggaagccccagcgcagcttctcttcctcctgctactctggcctcccagaccaccactgganaaatgtgatgacgcagtctccagcccacctgtcctctgtcctccgaggggaactcgacctaccctctcctggcacgggccagtcgagacgtgttggctagcaggcgtacgccgttggttccagcaagaacctggccacgaccnccaggcctccgtacactcgttacaccactacctccgaaccgacgggtccctaacgtcggttaaccncccgacggtacccagtacttacgacggtcgcctaacgggttgggtcgtacggggtactacgtacttcgtaccttcgtaccaacgtactacccaaccgtacgaaccgtaggacctacgtacggtaacgtttagtttcgacccggttttaagtttaaccttacgtttagacctttaaaccgtaaccgttaaacggttacggttacccgtaaccgtttaccctttaaacttaaccgttttacccgttacccggttttccgaaacccggtttacgggaaacccgttaaggttacccgggtaattaacccgttaaaccgaaacggtttaccgttacgggtaccgttaagtcccgaacgttaccttacggtcccggttacttcccgtttaacccgg

SEQ ID NO: 157508 - DNA, 259 bp, Homo sapiens
  misc_feature: GYAE6OF01BYW4M.24.78.H01.1.454.CMB.1.raw
  modified_base (257)..(259): a, c, t, g, unknown or other
  misc_feature (257)..(259): n is a, c, g, or t
tcagactactatgtcacgaccggtgctcgatttagtgtgagtagttgggtttgggacagacttcactctcatcatcgacagactggagcccgaagattttgcagtgtattactgtcagctgtttggtccctctcctcctatgtacacttttggccagggttccaggctggagatcaagcgaactgtggctgcaccatctgtcttcatcttcccgcatctgaacatagtagtctgagcgggctggcaaggcgcatagnnn

SEQ ID NO: 157509 - DNA, 526 bp, Homo sapiens
  misc_feature: GYAE6OF01CPYTH.24.78.H01.1.454.CMB.1.raw
  modified_base (240)..(240): a, c, t, g, unknown or other
  misc_feature (240)..(240): n is a, c, g, or t
  modified_base (517)..(517): a, c, t, g, unknown or other
  misc_feature (517)..(517): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgtctccagggganagagccaccctctcctgcagggccagtcagagtgttagcagcagctacttagcctggtaccagcagaaacctggcctggctcccaggctcctcatctatggtgcgtccacagggccactggcgtcgcggacaggttcagtggcagtggctttgggacagacttcactctcatcatcgacagactggacgccgaagtatttgcgtagttgtacttacgtgtcagtctgtttcgtcccttctcctcctattcgtacttacgtttcggcctagggttccnggtcgtagg

SEQ ID NO: 157510 - DNA, 272 bp, Homo sapiens
  misc_feature: GYAE6OF01CW2OF.24.78.H01.1.454.CMB.1.raw
  modified_base (263)..(272): a, c, t, g, unknown or other
  misc_feature (263)..(272): n is a, c, g, or t
tcagactactatgtcacgaccggtgctcgatttagtgtgagtagtttgggtttgggacgagacttcactctcatcatcgacagactggagcccgaagattttgcagtgtattacctgtcagctgtttggtccctctcctcctatgtacacttttggccagggttccaggctggagatcaagcgaactgtggctgcaccatctgtcttcatcttcccgcatctgaacatagtaagtctgagcggggctggcaaggcgacatagnnnnnnnnnn

SEQ ID NO: 157511 - DNA, 534 bp, Homo sapiens
  misc_feature: GYAE6OF01CF87J.24.78.H01.1.454.CMB.1.raw
  modified_base (234)..(234): a, c, t, g, unknown or other
  misc_feature (234)..(234): n is a, c, g, or t
  modified_base (323)..(323): a, c, t, g, unknown or other
  misc_feature (323)..(323): n is a, c, g, or t
tcagactactatgtcacgaccggtgctcgatttagtgtgagtagtttgggtttggcacgaccggtgctcgatttagtgtgagtagtttgggttggggagagctgctcagttaggacccagagggaaccatggaaacccagcgcagcttctcttcctcctgctactctggctcccagccatcaccggaggaattgtgttgacgcagtctccaggcacctgtcttgctcagggganagagccacctctcctgcagggccagtcagagtgtagcagcagctacttagcctggtaccaacagaacctggcctggctcccaggcctcncatctatggtcgcgtccacgagggccacgtggccgtcgcggacaggttcaggtcggctagtggtcgttgggactagtacttcacgtctcatcatcgacagacgtggacgacccgaagtactttcgctagtgttattacgtgtcagtcttggttcgtccctcttcctcctatcgtactcgtttcgccgtacggttccgacggtcgtggtacg

SEQ ID NO: 157512 - DNA, 513 bp, Homo sapiens
  misc_feature: GYAE6OF01C5NF7.24.78.H01.1.454.CMB.1.raw
  modified_base (237)..(237): a, c, t, g, unknown or other
  misc_feature (237)..(237): n is a, c, g, or t
  modified_base (480)..(480): a, c, t, g, unknown or other
  misc_feature (480)..(480): n is a, c, g, or t
  modified_base (505)..(505): a, c, t, g, unknown or other
  misc_feature (505)..(505): n is a, c, g, or t
tcagactactatgtcacgaccggtgctcgatttagtgtgagtagtttgggtttggcacgaccggtgctcgatttagtgtgagtagtttgggttggggagagctgctcagttaggacccagagggaaccatggaaaccccagcgcagcttctcttcctcctgctactctggctcccagccatcaccggaggaattgtgttgacgcagtctccaggcacctgtcttgtctccagggganagagccaccctctcctgcagggccagtcagagtgttagcagcagctacttagcctggtaccagcagaaacctggcctggctcccagctcctcatctatggtgcgtccaccagggccactggcgtcgcggacaggttcagtggcagtggctttgggacaggacttcactctcatcatcgacagactggagcccgaagtattttgctagtgtattactgtcagtctgttggtccctctcctcctntgtactactttcggctagggttccnggcgtagg

SEQ ID NO: 157513 - DNA, 521 bp, Homo sapiens
  misc_feature: GYAE6OF01BI70C.24.78.H01.1.454.CMB.1.raw
  modified_base (198)..(198): a, c, t, g, unknown or other
  misc_feature (198)..(198): n is a, c, g, or t
  modified_base (210)..(210): a, c, t, g, unknown or other
  misc_feature (210)..(210): n is a, c, g, or t
  modified_base (369)..(369): a, c, t, g, unknown or other
  misc_feature (369)..(369): n is a, c, g, or t
  modified_base (518)..(518): a, c, t, g, unknown or other
  misc_feature (518)..(518): n is a, c, g, or t
tcagactactatgtcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgctccagggganagagccaccctntcctgcagggccagccggagtgttagtaagtacttaggctggtaccaacagaaacctggccaggctcccaggctcctcatctatgatgtctccaacagggtcactggctcccgcaggttcagtggcagtgggtctgggacagacttcactctcaccgtnagcagtcctagagcctgaagtattttgcggtttactactgtcagcagcgttccgcctggccgctaacgtttcgggcgggggaccaggggtcggaggaggagacgaacgtgtggctgcaccgagtctgtcttcatcttccgcatctgacntag

SEQ ID NO: 157514 - DNA, 257 bp, Homo sapiens
  misc_feature: GYAE6OF01BHS9J.24.78.H01.1.454.CMB.1.raw
  modified_base (257)..(257): a, c, t, g, unknown or other
  misc_feature (257)..(257): n is a, c, g, or t
tcagactactatgtcacgaccggtgctcgatttagtgtgagtagttgggtttgggacagacttcactctcatcatcgacagactggagcccgaagattttgcagtgtattactgtcagctgttggtccctctcctcctatgtacacttttggccagggttccaggctggagatcaagcgaactgtggctgcaccatctgtcttcatcttcccgccatctgaacatagtagtctgagcgggctggcaaggcgcatagn

SEQ ID NO: 157515 - DNA, 519 bp, Homo sapiens
  misc_feature: GYAE6OF01DO4UZ.24.78.H01.1.454.CMB.1.raw
  modified_base (240)..(240): a, c, t, g, unknown or other
  misc_feature (240)..(240): n is a, c, g, or t
  modified_base (485)..(485): a, c, t, g, unknown or other
  misc_feature (485)..(485): n is a, c, g, or t
  modified_base (511)..(511): a, c, t, g, unknown or other
  misc_feature (511)..(511): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgtctccagggganagagccaccctctcctgcagggccagtcagagtgttagcagcagctacttagcctggtaccagcagaaacctggcctggctcccagctcctcatctatggtgcgtccacagggccactggcgtcgcggacaggttcagtggcaggtggcgtttgggacaggacttcactctcatcatcgacagactggacgccgaagtatttgactagtgtattactgtcagtctgttcgtccctctcccttctntgtactactttcggcctagggttccnggtcgtgg

SEQ ID NO: 157516 - DNA, 501 bp, Homo sapiens
  misc_feature: GYAE6OF01A855D.24.78.H01.1.454.CMB.1.raw
  modified_base (199)..(199): a, c, t, g, unknown or other
  misc_feature (199)..(199): n is a, c, g, or t
  modified_base (446)..(446): a, c, t, g, unknown or other
  misc_feature (446)..(446): n is a, c, g, or t
  modified_base (473)..(473): a, c, t, g, unknown or other
  misc_feature (473)..(473): n is a, c, g, or t
  modified_base (495)..(495): a, c, t, g, unknown or other
  misc_feature (495)..(495): n is a, c, g, or t
  modified_base (498)..(498): a, c, t, g, unknown or other
  misc_feature (498)..(498): n is a, c, g, or t
tcagactactatgtcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgtctccagggganagagccaccctctcctgcagggccagtcagagtgttagcagcagctacttagcctggtaccagcagaaacctggcctggctccaggctcctcatctatggtgcgtccaccagggccacgtggcgtcgcggacaggttcagtggcagtggctttgggacagtacttcactctcatcatcgacagacgtggacgcccgaagtatttgctagtgtattactgtcagtctgtttcggtcctctcctctatntactctttcgctggttccaggcgtggngtatcgagcgactgtcgctgcnctntcg

SEQ ID NO: 157517 - DNA, 530 bp, Homo sapiens
  misc_feature: GYAE6OF01C0222.24.78.H01.1.454.CMB.1.raw
  modified_base (200)..(200): a, c, t, g, unknown or other
  misc_feature (200)..(200): n is a, c, g, or t
  modified_base (232)..(232): a, c, t, g, unknown or other
  misc_feature (232)..(232): n is a, c, g, or t
  modified_base (402)..(402): a, c, t, g, unknown or other
  misc_feature (402)..(402): n is a, c, g, or t
tcagactactatgtcacgaccggtgctcgatttagtgtgagtagtttgggtttggggagagctgctcagttaggacccagagggaaccatggaaaccccagcgcagcttctcttcctcctgctactctggctccagataccactggagaaatagtgatgacgcagtctccagccaccctgtctgtgtctccaggggaaanagccacctctcctgcagggccagtcagagtanaagaagcaaactacttagcctggtatcaaacagaaacctggccaggctcccaggctcctcatctatggtatatccagcagggccactggtcgtcccagccaggttcagtggcaggtgggtctgggacaggtagttcactctcaccatcagcagtctgcagtctagaagtnttttgctagttttatactgccagcagcaacagtgacgtcggcctactcgtacgtttcgggaccggaagggtaccgaagggtcggagaattacgaaaacggtactggtacggactgaccacctgttccg

SEQ ID NO: 157518 - DNA, 514 bp, Homo sapiens
  misc_feature: GYAE6OF01C9UZD.24.78.H01.1.454.CMB.1.raw
  modified_base (197)..(197): a, c, t, g, unknown or other
  misc_feature (197)..(197): n is a, c, g, or t
  modified_base (242)..(242): a, c, t, g, unknown or other
  misc_feature (242)..(242): n is a, c, g, or t
  modified_base (328)..(328): a, c, t, g, unknown or other
  misc_feature (328)..(328): n is a, c, g, or t
  modified_base (347)..(347): a, c, t, g, unknown or other
  misc_feature (347)..(347): n is a, c, g, or t
  modified_base (392)..(392): a, c, t, g, unknown or other
  misc_feature (392)..(392): n is a, c, g, or t
  modified_base (455)..(455): a, c, t, g, unknown or other
  misc_feature (455)..(455): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggctcccagccatcaccggaggaattgngttgacgaagtctccaggcaccctgtcttgtctccaggggagagngccaccctctcctgcaggccagtcagagtgttagcagcagctacttagcctggtaccagcagaacctgcctggctcccaggctccncatctatggtgcgtccacngggccatggcgtcgcggacaggttcagtggcagtggcttgggacngacttcactctcatcatcgacagacgtcggagccgaagtatttgcgtagtgtattactcgtcngtcttgttcggtcctctcctctatcgtactctttggcctacggtcctaggcgtggtacg

SEQ ID NO: 157519 - DNA, 514 bp, Homo sapiens
  misc_feature: GYAE6OF01DB4J8.24.78.H01.1.454.CMB.1.raw
  modified_base (237)..(237): a, c, t, g, unknown or other
  misc_feature (237)..(237): n is a, c, g, or t
  modified_base (476)..(476): a, c, t, g, unknown or other
  misc_feature (476)..(476): n is a, c, g, or t
tcagactactatgtcacgaccggtgctcgatttagtgtgagtagtttgggtttggcacgaccggtgctcgatttagtgtgagtagtttgggttggggagagctgctcagttaggacccagagggaaccatggaaacccagcgcagcttctcttcctcctgctactctggctcccagccatcaccggaggaattgtgttgacgcagtctccaggcaccctgtctttgctccagggganagagccacctctcctgcaggggccagtcagagtgttagcagcagctactagctggtaccagcagaaacctggcctggctccaggctctcatctatggtgcgtccacagggccactggcgtcgcggacaggttcaggtggcagtggcttgggacagacttcactctcatcatcgacagactggacgcccgaagatttgctagtgtattactgtcagtcttgttcggtcccttctcctctntcgtactacgtttcggacctagggttccaggcgtaggg

SEQ ID NO: 157520 - DNA, 629 bp, Homo sapiens
  misc_feature: GYAE6OF01AXVHY.24.78.H01.1.454.CMB.1.raw
  modified_base (103)..(103): a, c, t, g, unknown or other
  misc_feature (103)..(103): n is a, c, g, or t
  modified_base (202)..(202): a, c, t, g, unknown or other
  misc_feature (202)..(202): n is a, c, g, or t
  modified_base (213)..(213): a, c, t, g, unknown or other
  misc_feature (213)..(213): n is a, c, g, or t
  modified_base (289)..(289): a, c, t, g, unknown or other
  misc_feature (289)..(289): n is a, c, g, or t
  modified_base (371)..(371): a, c, t, g, unknown or other
  misc_feature (371)..(371): n is a, c, g, or t
tcagactactatgtcacgaccggtgctcgatttagtgtgagtagtttgggtttgggggagagctgctcaggttaggacccgagagggaaccatggaaaccccngcgcagcttctcttcctcctgctactctggctcccagcccatcgaccggaggaagttgtgttgacgcagtcctccaggcaccctgtcttgtctcagggnagagccacctntcctgcaggccagtcagagtgtagcagctagctacttagcctaggtaccagcagaacctggcctgctccaggctcncatctatgtgcgtccacaggccactggcgtcgcggacgtcggttcagtcgcagtggtcgtttgggactgtacttcactcgtntatcatacgacacgtacgtggacgacccgtaagtgtttcgacgtagttagttaacgttacgtgtactacgttcgtttacgttttcggtccccttcttcccgttaccgtttacgttcggtttaaccttaccggttttacggacccggttaacgggtttacccgaagggtaccgttagggtaacgtaacgttaccggaaacgggtacccgtaaacgttcgggttacggtaccgttagacccgttaaccgtcgtttacccg

SEQ ID NO: 157521 - DNA, 578 bp, Homo sapiens
  misc_feature: GYAE6OF01AUORG.24.78.H01.1.454.CMB.1.raw
  modified_base (201)..(201): a, c, t, g, unknown or other
  misc_feature (201)..(201): n is a, c, g, or t
  modified_base (417)..(417): a, c, t, g, unknown or other
  misc_feature (417)..(417): n is a, c, g, or t
tcagactactatgtcacgaccggtgctcgatttagtgtgagtagtttgggtttggggagagctgctcagttaggacccagagggaaccatggaaaccccagcgcagcttctcttcctcctgctactctggctcccagataccactggagaagtagtcatgacgcagtctccagccaccctgtctgtgtctccaggggaaangccaccctctcctgcagggccagtgagaatgttggcagcaacttagcctggtaccagcagaaacctggccaggctcccaggctcctcctctatgctgtcctccaccgacgggcccctgggtcgtcccaggccctagggtttcgttgggccgggttgggtcgtggggactaggtattttccgactctcaccatccgagcggccctcagtctgaagtntttgctactttatttctgtcaactactatggtgtacgtggtccttccgtactacgtttcggccgtacggggacctaaacgtcggagtactacgaaacgtaacgtggtacggcgtagcctaccgtatcttcgttccttactacttccttccccgccttaacg

SEQ ID NO: 157522 - DNA, 524 bp, Homo sapiens
  misc_feature: GYAE6OF01CS2MC.24.78.H01.1.454.CMB.1.raw
  modified_base (200)..(200): a, c, t, g, unknown or other
  misc_feature (200)..(200): n is a, c, g, or t
tcagactactatgtcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgtctccgagggganagacgccacctctcctgcagggccagtcagagtgtagcagcagctacttagcctggtaccagcagaaacctggcctggctccaggctcctcatctagtggtcgccgtccaccgaggccacgtggcgtcgcggacaggttcagtggcagtggctttgggacagacttcactctcatcatcgacagactggacgcccgaagtatttgctagtgtattctgtctagtcttgtttcgtccctctcctctatcgtactcgtttggcctaggttccaggtcgtggagtagtacgaacggcgtaacgttcggtcggactgcacctagttcg

SEQ ID NO: 157523 - DNA, 538 bp, Homo sapiens
  misc_feature: GYAE6OF01A9GWL.24.78.H01.1.454.CMB.1.raw
  modified_base (527)..(527): a, c, t, g, unknown or other
  misc_feature (527)..(527): n is a, c, g, or t
tcagactactatgtcacgaccggtgctcgatttagtgtgagtagtttgggtttgggagaggagcccagcactagaagtcggcggtgtttccattcggtgatcagcactgaacacagaggactcaccatggagtttgggctgagctgggttttcctcgtcgctcttttaagaggtgtccagtgtcaggggcagctggtggagtctgggggcggcgtggtccaacctgggaggtccctgagactctcctgtgcggcctcccgattcaccttcaatacttatggcatgcactgggtccgccaggctccaggcaaggggctggagtgggtggccgctatcttattgatggaagtaatcaatattatgcagactccgtgaagggccggttcaccatctccagagacaattccaacaatactctgtttctgacaatgactagcctgcgatctgaggacacggctgtctattactgtgacgaaagtcttccccggcccttcttaccgtatttacgttcggggtcgccccctacncgtgggtaccg

SEQ ID NO: 157524 - DNA, 527 bp, Homo sapiens
  misc_feature: GYAE6OF01BURWF.24.78.H01.1.454.CMB.1.raw
  modified_base (240)..(240): a, c, t, g, unknown or other
  misc_feature (240)..(240): n is a, c, g, or t
  modified_base (491)..(491): a, c, t, g, unknown or other
  misc_feature (491)..(491): n is a, c, g, or t
  modified_base (518)..(518): a, c, t, g, unknown or other
  misc_feature (518)..(518): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgctccgagggganagagcccaccctctcctgcagggccagtcagagtgttagcagcagctacttagcctggtaccagcagaaacctggcctggctcccagctcctcatctatggtgcgtccaccgaggccacgtggccgtcgcggacaggttcagtggcagtggtcttgggacagacttcactctcatcatcgacagacgtggacgccgaagtactttgcgtagttgttaattactgtcagtcgtgtttcgtccctctcctctntcgtactacgtttcgccgtaggttccnggtcgtagg

SEQ ID NO: 157525 - DNA, 259 bp, Homo sapiens
  misc_feature: GYAE6OF01C91SP.24.78.H01.1.454.CMB.1.raw
  modified_base (257)..(259): a, c, t, g, unknown or other
  misc_feature (257)..(259): n is a, c, g, or t
tcagactactatgtcacgaccggtgctcgatttagtgtgagtagtttgggtttgggacagacttcactctcatcatcgacagactggagcccgaagattttgcagtgtattactgtcagctgtttggtcctctcctcctatgtacacttttggccagggttccaggctggagatcaagcgaactgtggctgcaccatctgtcttcatcttccgccatctgaacatagtagtctgagcgggctggcaaggcgcatagnnn

SEQ ID NO: 157526 - DNA, 530 bp, Homo sapiens
  misc_feature: GYAE6OF01B8M89.24.78.H01.1.454.CMB.1.raw
  modified_base (238)..(238): a, c, t, g, unknown or other
  misc_feature (238)..(238): n is a, c, g, or t
  modified_base (340)..(340): a, c, t, g, unknown or other
  misc_feature (340)..(340): n is a, c, g, or t
  modified_base (520)..(520): a, c, t, g, unknown or other
  misc_feature (520)..(520): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagaggaaccatggaaaccccagcgcagcttctcttcctcctgctactctggctcccagccatcaccggaggaattgtgttgacgcagtctccaggcaccctgtctttgtctcagggganagagccaccctctcctgcagggccagtcagagtgtagcagcagctacttagcctggtaccagcagaaacctggcctggctcccaggctcctcatctatggtncgtccaccaggaccacgtcggcgtcgcggacaggttcaggtggcgagtggtcgtttgggactagtacttcactctcatcatcgacagacgtggacgccgaagtatttgacgtagtagttacttactgtcagtctgttcgtccctcttcctctatcgtactcgtttcggacctaggttccnggtcgtacgg

SEQ ID NO: 157527 - DNA, 603 bp, Homo sapiens
  misc_feature: GYAE6OF01EFDNR.24.78.H01.1.454.CMB.1.raw
  modified_base (240)..(240): a, c, t, g, unknown or other
  misc_feature (240)..(240): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctgctcccagccatcaccggagaattgtgttgacgcagtctccaggccaccctgtctttgtctccgagggganagacgcccaccctctcctgcgagggccagtcaggagtgtagcagcagctacttagcctggtaccagcagaacctggcctggcctcccaggcctcctcatctagtggtcgcgtccacgacgggccacgtcggccgtcggccggacgtggttcaggtcggacgtaggtcggtcgtttgggactacggtacttcgacttctacacttcgacgtccgacacggacgtacggacgaccgtaagttacttttggactagttagttacttacgtgtctacgttcgttcgtttccggttcccttccttacccttccttacgttcgttaccttacgttttccggaccgttacgggttccgtggtcgtacggg

SEQ ID NO: 157528 - DNA, 606 bp, Homo sapiens
  misc_feature: GYAE6OF01DK3IW.24.78.H01.1.454.CMB.1.raw
  modified_base (241)..(241): a, c, t, g, unknown or other
  misc_feature (241)..(241): n is a, c, g, or t
tcagactactatgtcacgaccggtgctcgatttagtgtgagtagtttgggtttggcacgaccggtgctcgatttagtgtgagtaggttgggttggggagaggctgctcgagttaggacccagagggaaccatggaaaccccagcgcagcttctcttcctcctgctactctggctcccagccatcaccggaggaattgtgttgacgcagtctccaggcaccctgtctttgctccgagggganagagccaccctctcctgcaggggccagtcagagtgttagcagcagctacttagcctggtaccagacacgaaacctggcctggcctcccgaggcctcctcattctatggtcgccgtccgaccgacggcctacgtcggcgtcggcggacgtaggttcgaggtggacgaggtcgggtcgtttacggggactacggtacttcgactccgtacaccggtcagcacgcctacgagtcctagaacgttactttggtcgttttactacgttgtacgacgtacgacgttccgtccgaccgtcggccgtaccgttacggttccgggaccgggggtaccgacggggtacggacggagggacgacggtaacgtcggg

SEQ ID NO: 157529 - DNA, 524 bp, Homo sapiens
  misc_feature: GYAE6OF01DY9JT.24.78.H01.1.454.CMB.1.raw
  modified_base (199)..(199): a, c, t, g, unknown or other
  misc_feature (199)..(199): n is a, c, g, or t
  modified_base (358)..(358): a, c, t, g, unknown or other
  misc_feature (358)..(358): n is a, c, g, or t
tcagactactatgtcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgtctccagggganagagccaccctctcctgcagggccagtcagagtgttagcagcagctacttagcctggtaccagcagaaacctggcctggctcccaggctcctcatctatggtgcgtccaccagggccactggcgtcgcggacaggttcagtggcagtggctttgggacngacttcactctcatcatcgacagactggagcccgaagattttgcagtgttattactgtcagtcttgtttcggtcccttctcctcctatgttactacttttcggcctagggttccaggtctggagtatacgtaagcgtaaacgtggttcggctggctaccattaccg

SEQ ID NO: 157530 - DNA, 661 bp, Homo sapiens
  misc_feature: GYAE6OF01E1L2Z.24.78.H01.1.454.CMB.1.raw
  modified_base (256)..(256): a, c, t, g, unknown or other
  misc_feature (256)..(256): n is a, c, g, or t
  modified_base (352)..(352): a, c, t, g, unknown or other
  misc_feature (352)..(352): n is a, c, g, or t
  modified_base (359)..(359): a, c, t, g, unknown or other
  misc_feature (359)..(359): n is a, c, g, or t
  modified_base (364)..(364): a, c, t, g, unknown or other
  misc_feature (364)..(364): n is a, c, g, or t
tcagactactatgtcacgaccggtgctcgatttagtgtgagtagtttgggtttggcacgaccggtgctcgatttagtgtgagtagtttgggtttggggagagctgcttcagttaggacccaggagggaaccatggaaacccccagcgcgagcttcctcgttcctcctgctactctgggctcccgacgccgatcgaccggaggaactttggtgttcgacgcagtcctccaggcacctgtctttggtctccagggganagagcctacctctcctgcagggccagtcacgaggtggtagcagcagctacttgcctggaccaggcacgaaacctggacctcggcctccaggctccnactctanggtcnccgtaccacgacggccacgtaggcgtcgcggacaggttcaggtcggcagtcggtcgttgggacgacggtacttcgacttctacacgtcacgtcgacgacgacgtcgggacgtccggaaggttagttttcggacgtaggttacggttacttacggttacggtcgtacgtccgtttcggtttaccggttcccgttccgttccccgttacccgttaaccgttaccggttaaccctttaccggtttttccgggtacccccgtttaacccggggtttcccggtaccgggtccggttaccggg

SEQ ID NO: 157531 - DNA, 501 bp, Homo sapiens
  misc_feature: GYAE6OF01CIBL8.24.78.H01.1.454.CMB.1.raw
  modified_base (201)..(201): a, c, t, g, unknown or other
  misc_feature (201)..(201): n is a, c, g, or t
  modified_base (492)..(492): a, c, t, g, unknown or other
  misc_feature (492)..(492): n is a, c, g, or t
  modified_base (498)..(498): a, c, t, g, unknown or other
  misc_feature (498)..(498): n is a, c, g, or t
tcagactactatgtcacgaccggtgctcgatttagtgtgagtagtttgggtttggggagagctgctcagttaggacccagagggaaccatggaaaccccagcgcagcttctcttcctcctgctactctggctcccagatgccaccggagacattgtgttgacacagtctccagccaccctgtctttgtctccaggggaaangccaccctctcctgcagggccagtgacaatgttaggaagttgtagcctggtatcaacacaaacatggccaggctccccggctcctcatctatgatgcatccaatgggccatggcatcccagacaggttcagtggcagtgggtctgggacagacttcactctcaccatcagcagtgtagagcctagaagtatttgctagtttattactgtcagcacgtagactaacgtcggccctacgtttcggccctgggaccagactggacataccaacgactgtcggctgcactatctntcttcntcc

SEQ ID NO: 157532 - DNA, 744 bp, Homo sapiens
  misc_feature: GYAE6OF01EK58V.24.78.H01.1.454.CMB.1.raw
tcagactactatgtcacgaccggtgctcgatttagtgtgagtagtttgggtttggggagaggagcccagcactagaagtcggcggtgtttccattcggtgatcagcactgaacacagaggactcaccatggagtttgggctgagcttgggttttcctcgtcgctcttttaagaggtgtccagtgtcaggggcagctggtggagtcgtgggggcgcgtggtccaaccgtgggaggtccctgagacctctcctgtgccggcctcccgattccaccttcaatacttatggcatgcacgtgggtccgccaggcctcgaggccgaagggggctgggaggtggggtcggccgtcttattctttagtttgattgggaaagttaatacaaattattatgacagacctcggtaggaacgggtcccgttacaacctattcctaccaagaacgaacctaactttacccaaaactaaacttaaccttacgttacgttttaccgtacgtaacctaaaagttcgtaaccttaacggtcccttacggaccgtaacgttacccgttaggaaccggggtaccgtaaccgggtcctttacggttacctttaagtttaccgttggttacggtaaaccggtaaaaccggttcccgtttacccccccgggtaccccttttaccgttaaccggttacgttttaccgggtttccggggggttaccccgtacccccccgttaacgttaaccggtcgggttaacccggg

SEQ ID NO: 157533 - DNA, 514 bp, Homo sapiens
  misc_feature: GYAE6OF01BXX19.24.78.H01.1.454.CMB.1.raw
  modified_base (199)..(199): a, c, t, g, unknown or other
  misc_feature (199)..(199): n is a, c, g, or t
  modified_base (446)..(446): a, c, t, g, unknown or other
  misc_feature (446)..(446): n is a, c, g, or t
tcagactactatgtcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgtctccagggganagagccaccctctcctgcagggccagtcagagtgttagcagcagctacttagcctggtaccagcagaaacctggcctggctccaggctcctcatctatggtgcgtccaccagggccactggcgtcgcggacaggttcagtggcagtggctttgggacagacttcactctcatcatcgacagactggagccccgaagtattttgctagtgttattactgtcagtctgtttcgtccctctcctcctatnttactacgtttcgccgtagggttccaggtctggagtatacgaagcgtaactggtgctgcacctgttcg

SEQ ID NO: 157534 - DNA, 539 bp, Homo sapiens
  misc_feature: GYAE6OF01BUJIW.24.78.H01.1.454.CMB.1.raw
  modified_base (241)..(241): a, c, t, g, unknown or other
  misc_feature (241)..(241): n is a, c, g, or t
  modified_base (330)..(330): a, c, t, g, unknown or other
  misc_feature (330)..(330): n is a, c, g, or t
  modified_base (496)..(496): a, c, t, g, unknown or other
  misc_feature (496)..(496): n is a, c, g, or t
  modified_base (528)..(528): a, c, t, g, unknown or other
  misc_feature (528)..(528): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgtctccaggggganagagccaccctctcctgcagggccagtcagagtgtagcagcagctacttagcctggtaccagcagaacctggcctggctccagctcctnatctatggtgcgtccacgagggccacgtggcgtcgcggacaggttcaggtgcagtggcgtttgggacagacttcactctcatcatcgacagacgtggacgcccgaagtactttgacgtagttgttattacgtgtcagtcttgttcggttccctcttcccttccttnttcgttactacgttttcggccgtagggttccnggtcgtacggg

SEQ ID NO: 157535 - DNA, 526 bp, Homo sapiens
  misc_feature: GYAE6OF01B2M6W.24.78.H01.1.454.CMB.1.raw
  modified_base (198)..(198): a, c, t, g, unknown or other
  misc_feature (198)..(198): n is a, c, g, or t
  modified_base (300)..(300): a, c, t, g, unknown or other
  misc_feature (300)..(300): n is a, c, g, or t
tcagactactatgtcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtcttgtctccagggganagagccaccctctcctgcagggccagtcagagtgttagcagcagctattagcctggtaccagcagaaacctggcctggctccaggcctctcatctatggtcncgtccacgagggccagtggcgtcgcggacaggttcagtgcagtgctttgggacagacttcgactctcatcatcgacagactggacgcccgaagtatttcgatacgtgtattacgtgtcagtcttagtttcggtccctctccgtcctatcgttacttacttttggcctagggttccaggtctggagtatacgaagcgtaacgttggtcgactagacaccgtgttccg

SEQ ID NO: 157536 - DNA, 747 bp, Homo sapiens
  misc_feature: GYAE6OF01DNJEB.24.78.H01.1.454.CMB.1.raw
  modified_base (238)..(238): a, c, t, g, unknown or other
  misc_feature (238)..(238): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaacccagcgcagcttctcttcctcctgctactctggcctcccagccatcaccggaggaattgtgttgacgcagtctccaggcacctgtctttgctcgagggganagacgccacctctccgtgcagggccagtcagagtgtagcagcagctactagctggtaccagcagaacctggcctggcctccgaggcctcctcatcctagtggcgtccgtaccgaccgacgggcccacgtcgggtccgtaccggaccgggtaacgtacggggtttcaagggttcgggaccgtaacgggttcgggtacggttttacggggaacgtaacggtacccgtttaccgtaaccgttaccgttacgtaactaccgtaacgttaccggaacctaacggtaccgttacggggaaccggtacccggtaaacggttaacgtttttcggaccgttaagtttacgtttaacgtttaaccgttcggtaccgttacggttacgtttcgggttttaccggttacccccgtttccgtttacccctttacccgttaacgtttaccgtttaaccgtttacccggtttttaccggtaccccggttacggggtttaccccgtacgggtccggttaacgggg

SEQ ID NO: 157537 - DNA, 558 bp, Homo sapiens
  misc_feature: GYAE6OF01D0NKR.24.78.H01.1.454.CMB.1.raw
tcagactactatgtcacgaccggtgctcgatttagtgtgagtagtttgggtttggggagaggagcccagcactagaagtcggcggtgtttccattcggtgatcagcactgaacacataggactcaccatggagtttgggctgagctgggttttcctcgtcgctcttttaagaggtgtccagtgtcaggggcagctggtggagtctgggggcggcgtggtccaacctgggaggtccctgagactctcctgtgcggcctcccgattccaccttcaatacttatggcatgcactgggtccgccaggctccgaggcaagggggctggagtgggtggccgctatcttatttgatggaagtatcaatattatgcagactccgtgaagggccgttcaccatctccagagacaattccaaacaatactctgtttctgacaaatgactagcctgcatctgacggacacggctgtctattactgtagacgaaagtaccttccccggccctttcttaaccgtatttacggttcggggttccggtacccccctacgtcgtcgggtaccgg

SEQ ID NO: 157538 - DNA, 529 bp, Homo sapiens
  misc_feature: GYAE6OF01A1V7M.24.78.H01.1.454.CMB.1.raw
  modified_base (241)..(241): a, c, t, g, unknown or other
  misc_feature (241)..(241): n is a, c, g, or t
  modified_base (461)..(461): a, c, t, g, unknown or other
  misc_feature (461)..(461): n is a, c, g, or t
  modified_base (494)..(494): a, c, t, g, unknown or other
  misc_feature (494)..(494): n is a, c, g, or t
  modified_base (520)..(520): a, c, t, g, unknown or other
  misc_feature (520)..(520): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgtctccaggggganagagccaccctctcctgcagggccagtcagagtgtagcagcagctacttagcctggtaccagcagaaacctggcctggctccaggctcctcatctatggtcgccgtccaccgaggcccacgtggcgtcgcggacaggttcagtcggcgaggtggtcgtttgggacagtacttcactctcatcagtcgacagactggacgcccgaagtatttcgctagttnttattactgtcagtctgttcgtcctctcctctntcgtacttactttcggctaggtccgnggtcgtagg

SEQ ID NO: 157539 - DNA, 544 bp, Homo sapiens
  misc_feature: GYAE6OF01CTS2H.24.78.H01.1.454.CMB.1.raw
  modified_base (300)..(300): a, c, t, g, unknown or other
  misc_feature (300)..(300): n is a, c, g, or t
  modified_base (336)..(336): a, c, t, g, unknown or other
  misc_feature (336)..(336): n is a, c, g, or t
  modified_base (360)..(360): a, c, t, g, unknown or other
  misc_feature (360)..(360): n is a, c, g, or t
  modified_base (363)..(363): a, c, t, g, unknown or other
  misc_feature (363)..(363): n is a, c, g, or t
  modified_base (373)..(373): a, c, t, g, unknown or other
  misc_feature (373)..(373): n is a, c, g, or t
  modified_base (382)..(382): a, c, t, g, unknown or other
  misc_feature (382)..(382): n is a, c, g, or t
  modified_base (388)..(388): a, c, t, g, unknown or other
  misc_feature (388)..(388): n is a, c, g, or t
  modified_base (393)..(393): a, c, t, g, unknown or other
  misc_feature (393)..(393): n is a, c, g, or t
  modified_base (401)..(401): a, c, t, g, unknown or other
  misc_feature (401)..(401): n is a, c, g, or t
  modified_base (414)..(414): a, c, t, g, unknown or other
  misc_feature (414)..(414): n is a, c, g, or t
  modified_base (524)..(524): a, c, t, g, unknown or other
  misc_feature (524)..(524): n is a, c, g, or t
tcagactactatgtcacgaccggtgctcgatttagtgtgagtagtttgggtttggggagaggagcccagcactagaagtcggcggtgtttccattcggtgatcagcactgaacacagaggactcaccatggagtttgggctgagctgggttttcctcgtcgctcttttaagaggtgtccagtgtcaggggcagctgggtggagtcgtgggggcggcgtggtccaaccgtgggaggtccctgagactctcctgtgcggcctccgattccaccttcaatacttatggcatgcactgggtccnccaggctccgaggcaaggggctggagtgggtgccgntatcttattgatggaatatcaatntangcagactcgngaggccgtnacatcncaganacatcaanaatactctgttcngacaaatgactagcctgcgatcgtagaggacacggtctgtctaattacgtgtagacgaaacgtccttcccccggtacctttcgttaacgtatttacggttcggggtaccncccccttagagtcgggtacg

SEQ ID NO: 157540 - DNA, 705 bp, Homo sapiens
  misc_feature: GYAE6OF01B2QHN.24.78.H01.1.454.CMB.1.raw
  modified_base (237)..(237): a, c, t, g, unknown or other
  misc_feature (237)..(237): n is a, c, g, or t
tcagactactatgtcacgaccggtgctcgatttagtgtgagtagtttgggtttggcacgaccggtgctcgatttagtgtgagtagtttgggtttgggagagctgctcagttaggacccagagggaaccatggaaacccagcgcagcttctcttcctcctgctactctggctcccagccatcaccggaggaattgtgttgacgcagtctccaggcaccctgtctttgctcgagggganagagccaccctctcctgcacgggccagtcagagtgttagcagcagctacttacgcctggtaccagcaagaaacctggcctggctcccagcctcctcatctagtggtcgcgtccacgaggccacgtggcgtcgcgacgtaggttcaggtcggcgaggtggtcgtttagggactacggtaactttcgaacttccgtactacgtactaattaccggaactaacggaccgttagggaaccgtccccggtaaagttacgttttttcggaaccgttaacggttacggtttaaattttaccgttacggttacccgttaacggtttccggtttacgggtttttaccgggtacccccgttttcccgtttaccccttacccgtttacgtttaccggtttaaacccgttttaccgtttttccggggacccggttttaccggggttttaacccccgagggggtttcccctttaagggggg

SEQ ID NO: 157541 - DNA, 526 bp, Homo sapiens
  misc_feature: GYAE6OF01C5HFJ.24.78.H01.1.454.CMB.1.raw
  modified_base (238)..(238): a, c, t, g, unknown or other
  misc_feature (238)..(238): n is a, c, g, or t
  modified_base (375)..(375): a, c, t, g, unknown or other
  misc_feature (375)..(375): n is a, c, g, or t
  modified_base (517)..(517): a, c, t, g, unknown or other
  misc_feature (517)..(517): n is a, c, g, or t
tcagactactatgtcacgaccggtgctcgatttagtgtgagtagtttgggtttggcacgaccggtgctcgatttagtgtgagtagtttgggttggggagagctgctcagttaggacccagagggaaccatggaaaccccagcgcagcttctcttcctcctgctactctggctcccagccatcaccggaggaattgtgttgacgcagtctccaggcaccctgtcttgtctccagggganagagccaccctctcctgcagggccagtcagagtgttagcagcagctacttagcctggtaccagcagaaacctggcctggctcccaggctcctcatctatggtgccgtccaccgagggccacgtcggcgtcgcggacnggttcaggtggcagtggcgtttgggacagacttcactctcatcatcgacagactggacgcccgaagtattttgactagtgtattacgtgtctagtctgttcgtccctctccttctatcgtactcgtttcggcctaggttccnggtcgtagg

SEQ ID NO: 157542 - DNA, 562 bp, Homo sapiens
  misc_feature: GYAE6OF01D9Y2Q.24.78.H01.1.454.CMB.1.raw
  modified_base (241)..(241): a, c, t, g, unknown or other
  misc_feature (241)..(241): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgtctccgagggganagagcccaccctctcctgcagggccagtcagagtgttagcagcagctacttagcctggtaccagcagaaacctggcctggctccaggctcctcatctatggtgccgtccaccgaggccacgtggcgtcgcggacaggttcagtggcgagtggtcgtttgggactagtacttcactctcatcatcgacagactggacgccgtaagtactttgactagttgttacttacgtgtcagtcgttcgtttcggtcccttccgttccttaccttagttacgttaccttacgttttcggacccgttaggggtttcccaggtcgtacggg

SEQ ID NO: 157543 - DNA, 543 bp, Homo sapiens
  misc_feature: GYAE6OF01CL6XV.24.78.H01.1.454.CMB.1.raw
tcagactactatgtcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgtctccaggggagagagccaccctctcctgcagggccagtcagagtgttagcagcagctattagcctggtaccagcagaaacctggcctggctcccaggctcctcatctatggtgcgtccaccagggccactggcgtcgcggacaggttcagtggcagtggctttgggacagacttcactctcatcatcgacagactggacgcccgaagtatttgctagtgtattactgtcagtctgtttcgtcccttctcctcctatcgttactacgtttggacctacgggttccacgggtcttacgggacgtagtaccgaaggcgtaaaccgttggtacgggcttacggacctaccgtagttccg

SEQ ID NO: 157544 - DNA, 574 bp, Homo sapiens
  misc_feature: GYAE6OF01BQBCI.24.78.H01.1.454.CMB.1.raw
  modified_base (239)..(239): a, c, t, g, unknown or other
  misc_feature (239)..(239): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgctccagggganagagccaccctctcctgcagggccagtcagagtgttagcagcagctacttagcctggtaccagcagaaacctggcctggctcccaggctcctcatctatggtgccgtccaccgaggcccacgtggcgtcgcggacaggttcaggtggcgaggtggctttgggacagtaccttcactctcatcatcgacagactggacgtccgaagtactttcgctagtgttacttacgtcgtcgtagtcttggtttccggtccccttcgttcccttaccgttattccggttaacttaccgttttcggacccgttacggggtttcccgtagggtccgttaacgggg

SEQ ID NO: 157545 - DNA, 571 bp, Homo sapiens
  misc_feature: GYAE6OF01BDDMP.24.78.H01.1.454.CMB.1.raw
  modified_base (240)..(240): a, c, t, g, unknown or other
  misc_feature (240)..(240): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggctccagccatcaccggaggaattgtgttgacgcagtctccaggcaccctgtctttgtctccgagggganagagcccaccctctcctgcagggccagtcagagtgttagcagcagctacttagcctggtaccagcagaaacctggcctggctccagcctcctcatctatcggtcgcgtccacgacgggccacgtcggcgtcgcggactaggttcaggtggcgaggtggtcgtttgggactagtaccttcgacttctacactcactcgacagacgtggaccgccgaagtacgtttgacgtagtagttacttacgtgtctagtcgttcgttcggttccctctcccttaccttattcgttacttaccggttttcggaccgttagggttcccagggtcgtacggg

SEQ ID NO: 157546 - DNA, 263 bp, Homo sapiens
  misc_feature: GYAE6OF01A6HWR.24.78.H01.1.454.CMB.1.raw
  modified_base (258)..(263): a, c, t, g, unknown or other
  misc_feature (258)..(263): n is a, c, g, or t
tcagactactatgtcacgaccggtgctcgatttagtgtgagtagttgggtttgggacagacttcactctcatcatcgacagactggagcccgaagattttgcagtgtattactgtcagctgtttggtccctctcctcctatgtacacttttggccagggttccaggctggagatcaagcgaactgtggctgcaccatctgtcttcatcttcccgccatctgaacatagtagtctgagcgggctggcaaggcgcatagnnnnnn

SEQ ID NO: 157547 - DNA, 536 bp, Homo sapiens
  misc_feature: GYAE6OF01D7HS2.24.78.H01.1.454.CMB.1.raw
  modified_base (358)..(358): a, c, t, g, unknown or other
  misc_feature (358)..(358): n is a, c, g, or t
  modified_base (370)..(370): a, c, t, g, unknown or other
  misc_feature (370)..(370): n is a, c, g, or t
  modified_base (525)..(525): a, c, t, g, unknown or other
  misc_feature (525)..(525): n is a, c, g, or t
tcagactactatgtcacgaccggtgctcgatttagtgtgagtagtttgggtttggggagaggagcccagcactagaagtcggcggtgtttccattcggtgatcagcactgaacacagaggactcaccatggagtttgggctgagctgggttttcctcgtcgctcttttaagaggtgtccagtgtcaggggcagctggtggagtctggggggcggcgtggtccaacctgggaggtccctgagactctcctgtgcggcctcccgattcaccttcaatacttatggcatgcactgggtccgccaggctccaggcaaggggctggagtgggtggccgctatcttattgatggaatatcaatntatgcagctcgngagggccgttcacatctcagagacattccaacatactctgtttctgacaatgactagcctgcatctgaggacacggctgtctattactgtcgtacgaaagtccttccccggtacccttccgttacgtatttacgttcggggtacgccccctacgngtgggtaccgg

SEQ ID NO: 157548 - DNA, 322 bp, Homo sapiens
  misc_feature: GYAE6OF01DI8BJ.24.78.H01.1.454.CMB.1.raw
  modified_base (276)..(322): a, c, t, g, unknown or other
  misc_feature (276)..(322): n is a, c, g, or t
tcagactactatgtcacgaccggtgctcgatttagtgtgagtagttgggtttgggacagacttccactctcatcatcgactagactgggagcccgaagattttgcagtgtattactgtcagctgtttggtccttcgtcctcctattgttactacttttggcctagggtttccagggctggagtatcaagcgaactggtggctgcaccgatctgtcttcatcgtcccgcatctagaacatagtagtctgaggcgggtctgggacaaggcgacatagnnnnnnnnnnnnnnnnnnnnnnnnnnnnnnnnnnnnnnnnnnnnnnn

SEQ ID NO: 157549 - DNA, 538 bp, Homo sapiens
  misc_feature: GYAE6OF01BIX3Y.24.78.H01.1.454.CMB.1.raw
  modified_base (528)..(528): a, c, t, g, unknown or other
  misc_feature (528)..(528): n is a, c, g, or t
tcagactactatgtcacgaccggtgctcgatttagtgtgagtagtttgggtttggggagaggagcccagcactagaagtcggcggtgtttccattcggtgatcagcactgaacacagaggactcaccatggagtttgggctgagctgggttttcctcgtcgctcttttaagaggtgtccagtgtcaggggcagctggtggagtctgggggcgcgtggtccaacctgggaggtccctgagactctcctgtgcggcctcccgattcaccttcaatacttatggcatgcactgggtccgccaggctccaggcaaggggctggagtgggtgccgctatcttattgatggaagtaatcaaatattatgcagactcgtgaagggccgttcaccatctcagagacaattacaacaatactctgtttctgacaaatgactagcctgcgatctgaggacacggctgtctaattactgtgacgaaagtcttccccggccttcttaaccgtatttaacgttcggggtacgcccccctanagtggtacgg

SEQ ID NO: 157550 - DNA, 546 bp, Homo sapiens
  misc_feature: GYAE6OF01A88Y2.24.78.H01.1.454.CMB.1.raw
  modified_base (240)..(240): a, c, t, g, unknown or other
  misc_feature (240)..(240): n is a, c, g, or t
  modified_base (345)..(345): a, c, t, g, unknown or other
  misc_feature (345)..(345): n is a, c, g, or t
  modified_base (535)..(535): a, c, t, g, unknown or other
  misc_feature (535)..(535): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgtctccagggganagagcccaccctctcctgcagggccagtcagagtgtagcagcagctactagcctggtaccagcagaaacctggcctggctcccaggcctcctcatctagtggtcncgtccacgaggccacgtggcgtcgcggacaggttcagttcggacagtcggtcgtttgggactaggacttcactctcatcactcgacagacgtggacgccgaagtatttgactagttgtattactgtctagtcttcgtttcgtcccgtcttcctcttactcgttacttacgtttcggccgttagggttccnggtcgtacggg

SEQ ID NO: 157551 - DNA, 785 bp, Homo sapiens
  misc_feature: GYAE6OF01CHHM3.24.78.H01.1.454.CMB.1.raw
  modified_base (308)..(308): a, c, t, g, unknown or other
  misc_feature (308)..(308): n is a, c, g, or t
  modified_base (348)..(348): a, c, t, g, unknown or other
  misc_feature (348)..(348): n is a, c, g, or t
tcagactactatgtcacgaccggtgctcgatttagtgtgagtagtttgggtttggggagaggagcccagcactagaagtcggcggtgtttccattcggtgatcagcactgaacacagaggactcacatggagtttgggctgagcgttgggttttcctcgtcgcttcttttaagaggtcgtccagtgtcgaggggcaggctgggtggagtcgtgggggcgcgtggtccaacgtgggacgtcctgagctctcctgtcgccggcctccgattccacctttcaattacttatggcatcgcacgtgggtcccncaggctccgaggcgaaggggctgggaggtggggtcgccgnttagtctttagtttggaatagggaaattaatactaaattatttatcggactaacgtaccgttaccggtaggaaaccggggggttcccggtttacccaaaccgtacgttacccgttaacccgaacggaacggtaaaccgtaaacttttaacccgaaaaccttaaaacgttacctttaccgttttacgttttacccgtagtaacctaaaacgttacgtaacccgttaacgtccgttacggaccgtaacttaccgttagggaacgggtaccgtaccgggtctttaccggttacttaagtttaccgttacggtacggtaaccggtaaaccggttcccgtttaccccccgggttaccccttttacggttaccggttaacgttttagggttacccgggggttacccgtaaccccccgttagtaaccggttcggggtaaccggg

SEQ ID NO: 157552 - DNA, 693 bp, Homo sapiens
  misc_feature: GYAE6OF01DA5D3.24.78.H01.1.454.CMB.1.raw
  modified_base (206)..(206): a, c, t, g, unknown or other
  misc_feature (206)..(206): n is a, c, g, or t
tcagactactatgtcacgaccggtgctcgatttagtgtgagtagtttgggtttggggagagctgctcagttaggacccagagggaaccatggaaaccccagcgcagcttctcttcctcctgctactctggctcccagatgccaccggagacattgtgttgacacagtctccacgccaccctgtctgtgtctaccgaaggggaaacncgcccaccctctcctgcgagggccagtgagatgtgcagcaacttagcctaggtaccagacaagaaaccgtggaccaggcctcccgaggcctcctcctctatcgctcgtcctaccaccgacgggtcccctggtccgtcccgaggtcccgtagggtttcggtgggtccggggttaacgggtcggtaggggactacggttactttccgaacttcctaccaaccgtactcgacggcccggtccctccgtagtcgtagtaagttagttttcgtacttacttttacgtttcttacgtacctaactaacgttagttcggtacgtaccgtcggtcccgttaccgttaacgttaccggttttcgggacccggtaacgggtaaaccgtaaacgtacgggaacgtaacgtaacgtaaaccggtaacgtacggtacggtccgtacgacctacctacgttcttcgttacttactacctttcccgttccccgtcgtaaccg

SEQ ID NO: 157553 - DNA, 577 bp, Homo sapiens
  misc_feature: GYAE6OF01CEU0U.24.78.H01.1.454.CMB.1.raw
  modified_base (341)..(341): a, c, t, g, unknown or other
  misc_feature (341)..(341): n is a, c, g, or t
  modified_base (397)..(397): a, c, t, g, unknown or other
  misc_feature (397)..(397): n is a, c, g, or t
  modified_base (431)..(431): a, c, t, g, unknown or other
  misc_feature (431)..(431): n is a, c, g, or t
tcagactactatgtcacgaccggtgctcgatttagtgtgagtagtttgggtttggggagaggagcccagcactagaagtcggcggtgtttccattcggtgatcagcactgaacacagaggactcaccatggagtttgggctgagctgggttttcctcgtcgcttcttttaagaggtgtccagtgtcaggggcagctggtggagtcgtgggggcggcgtggtccaaccgtgggaggtccctgagactctcctgtcgcggcctccgattcgaccttcaatacgtatggcatgcacgtgggtccgccaggcctccgaggcgaaggggctgggagtgggtgccgntatcttattgatggaataatcaattatatgcagactcgtgaacgggccgttcaccntctcagagacaataccaacaactactctgtttcngtacaatgactagcctgcgtatcgtgaacgacgacggtcgtagtctaattactgtagacgtaaacgtacccgttaccccggtccctttcgttaccgttagtttacggttaccggggtaccgtaccccctaacgtcgtcggtaccgg

SEQ ID NO: 157554 - DNA, 616 bp, Homo sapiens
  misc_feature: GYAE6OF01BZQ6A.24.78.H01.1.454.CMB.1.raw
  modified_base (249)..(249): a, c, t, g, unknown or other
  misc_feature (249)..(249): n is a, c, g, or t
  modified_base (258)..(258): a, c, t, g, unknown or other
  misc_feature (258)..(258): n is a, c, g, or t
  modified_base (264)..(264): a, c, t, g, unknown or other
  misc_feature (264)..(264): n is a, c, g, or t
  modified_base (267)..(267): a, c, t, g, unknown or other
  misc_feature (267)..(267): n is a, c, g, or t
  modified_base (270)..(270): a, c, t, g, unknown or other
  misc_feature (270)..(270): n is a, c, g, or t
  modified_base (272)..(272): a, c, t, g, unknown or other
  misc_feature (272)..(272): n is a, c, g, or t
  modified_base (282)..(282): a, c, t, g, unknown or other
  misc_feature (282)..(282): n is a, c, g, or t
  modified_base (311)..(311): a, c, t, g, unknown or other
  misc_feature (311)..(311): n is a, c, g, or t
  modified_base (331)..(331): a, c, t, g, unknown or other
  misc_feature (331)..(331): n is a, c, g, or t
  modified_base (341)..(341): a, c, t, g, unknown or other
  misc_feature (341)..(341): n is a, c, g, or t
  modified_base (372)..(372): a, c, t, g, unknown or other
  misc_feature (372)..(372): n is a, c, g, or t
tcagactactatgtcacgaccggtgctcgatttagtgtgagtagtttgggtttgggggaggagcccagcactagaagtcggcggtgtttccattcggtgatcagcactgaacacagaggactcaccatggagtttgggctgagcttgggttttcctcgtcgctcttttaagaggtgtccagtgtcaggggcagctggtggagtcgtggggcgcgtggtccaacgtgggaggtccctgagactctcctgngcggctcgntagctnatntangnatgcatggcncagctcaggcagggctggagtggtcggcnctatctattgattggatatnaatacttagncagtacgtcgaggtacggtccgttacacgtntacgtacgagacgtaactaactaccaactaacttacgtcttagttactacgtaactaagtacgtaactaccgtcgtacgtaccgtactacgtaggaccggtacgtaccggtacgttacgtacttacgttaacgtcggtaccgtaacgtaaaccggtcccgttaccccggtacttaccgttacgttaacgtttcgggttaccgggttacccgtaccccgttaagtcggttacggtaccggtacgg

SEQ ID NO: 157555 - DNA, 697 bp, Homo sapiens
  misc_feature: GYAE6OF01EOBDD.24.78.H01.1.454.CMB.1.raw
  modified_base (244)..(244): a, c, t, g, unknown or other
  misc_feature (244)..(244): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagaggaaccatggaaaccccagcgcagcttctcttcctctgctactctggctcccagccatcaccggagtaattgtgttgacgcagtcctccaggccacccgtgttctttgtcctccgagggganagacgcccacccgtctccgtcgcgacgggccagtcagagttgtaagcagcagtctacgtagccgtcggtaccagccaagaaaccgtcggccctggcctccgagcctcctacagtctagtcggtcgccgtaccacgacggtcctacggtcggccgtacggaccggacgtacggttcgaggttcggacgtacgggttcggtacgtttacgggaaccgtaggtaccttcgaaccttccacgtactaccgtacgtaccgaacgtaacgtccgtagggacccgtacccgtaaagtttacgtttcgacgttagttacgttacttacgtcgttacgtaggttccgtttccggtttaccggttcccctttcgttacccctttacgttacgtttccgtttaaccgtttacccggtttttaccggcccggttaacggttcccggttaacggtccggttaacgg

SEQ ID NO: 157556 - DNA, 574 bp, Homo sapiens
  misc_feature: GYAE6OF01CGWZ3.24.78.H01.1.454.CMB.1.raw
tcagactactatgtcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgtctccgaggggagagacgccaccctctcctgcagggccagtcagagtgttagcagcagctacttagcctggtaccagcagaaacctggcctggctccaggctcctcatctatggtgcgtccaccgagggccacgtggcgtcgcggacaggttcagtggcaggtcggcgtttgggacagtacttcacgttctcgatcatcgacagacgtggacgacccgtaagtatttgctagtgttattactgtctagtcttgtttcggtcccttcttccttccttattacgttaccttacgttttcggaccgttacggggtttcccagggtcttgggtacgtagtacgtaaacggccgtaaacgttcggtacggtcgtagcctaaccgtagttccg

SEQ ID NO: 157557 - DNA, 539 bp, Homo sapiens
  misc_feature: GYAE6OF01C9DY8.24.78.H01.1.454.CMB.1.raw
  modified_base (239)..(239): a, c, t, g, unknown or other
  misc_feature (239)..(239): n is a, c, g, or t
  modified_base (400)..(400): a, c, t, g, unknown or other
  misc_feature (400)..(400): n is a, c, g, or t
  modified_base (429)..(429): a, c, t, g, unknown or other
  misc_feature (429)..(429): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgctccagggganagagccaccctctcctgcagggccagtcagagtgttagcagcagctactagcctggtaccagcagaaacctggccaggctcccaggctcctcctctatgctgtctccaccagggcccctggtctcccagccgtaggttcgtggcgggtgggtcgtgggacngtactttcactctcacatcagcgcctccngtctagatatttgctactttattctgtacaactactatgtacgactgccttcgtactacgtttcggccgtaacgggacctaaacgtggaacgatacaaacgtacgtacgg

SEQ ID NO: 157558 - DNA, 589 bp, Homo sapiens
  misc_feature: GYAE6OF01CUVWO.24.78.H01.1.454.CMB.1.raw
  modified_base (244)..(244): a, c, t, g, unknown or other
  misc_feature (244)..(244): n is a, c, g, or t
  modified_base (579)..(579): a, c, t, g, unknown or other
  misc_feature (579)..(579): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggcctcccagccatcaccggaggaattgtgttgacgcagtctccaggccaccctgtctttgtctccgaggggganagacgcccaccctctcctgcagggccagtcagagtgttagcagcagctacttgccctggtaccagcagaacctggcctggcctcccaggtcctcctcacgttctagtcggtcgaccgtcccacgagggccctacgtggccgtcggacggtacaggttcaggtggcgagtggtcgttgggacagtacttctactctcatacactcgacacgtacgtacggacgacccgtaagtacgtttcggactagttagttacttacgtgtactaggtcttacgtttcgtcccttcttcccttcctattcgttacgttcgttttcggaccgttacgggttccgnggtcgtacgg

SEQ ID NO: 157559 - DNA, 551 bp, Homo sapiens
  misc_feature: GYAE6OF01A9A04.24.78.H01.1.454.CMB.1.raw
  modified_base (484)..(484): a, c, t, g, unknown or other
  misc_feature (484)..(484): n is a, c, g, or t
  modified_base (513)..(513): a, c, t, g, unknown or other
  misc_feature (513)..(513): n is a, c, g, or t
  modified_base (542)..(542): a, c, t, g, unknown or other
  misc_feature (542)..(542): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgtctccaggggagagacgccaccctctcctgcagggccagtcagagtgtagcagcagctacttacgcctggtaccagcagaacctggcctggcctcccaggctcctcatcatggtcgccgtccaccagggcccacgtgggcgtcggcggactggttcaggtggctaggtggtcgtttgggacacgtacttcgactctacatcactcgacacgactggacgaccgtaagtatttcgcgtagttgttacttacgtgtcngtcgttgtttcggtcccttctccttcctntcgttacttacgtttcggcgtaggtccgnggtcgtagg

SEQ ID NO: 157560 - DNA, 532 bp, Homo sapiens
  misc_feature: GYAE6OF01AJELF.24.78.H01.1.454.CMB.1.raw
  modified_base (191)..(191): a, c, t, g, unknown or other
  misc_feature (191)..(191): n is a, c, g, or t
  modified_base (243)..(243): a, c, t, g, unknown or other
  misc_feature (243)..(243): n is a, c, g, or t
  modified_base (255)..(255): a, c, t, g, unknown or other
  misc_feature (255)..(255): n is a, c, g, or t
tcagactactatgtcacgaccggtgctcgatttagtgtgagtagtttggggtttggcacgaccggtgctcgatttagtgtgagtagtttgggtttgggagagctgctcagttaggacccagagggaaccatggaaaccccagcgcaggcttctcttcctcctgctactctggctcccagcccatcaccggnggaacttcgtgttgacgcagtctccaggcaccctgtctttgctccagggganagagccaccctntcctgcagggccagtcagagtgttagcagcagctactttagcctggtaccagcagaaacctggcctggcctcccgaggcctcctcatcctatggtcgcgtccacctagggccactggcgtcgcggacaggttcagtgcagtgcttggacagactcactctcatcatcgcagactggacgcccgaagtatttgcgtagtgttattactgtcagcgttgtttcggtccctctaccgttctatcgttactcttttcggcctagggttccaggtcgtacgg

SEQ ID NO: 157561 - DNA, 537 bp, Homo sapiens
  misc_feature: GYAE6OF01C317B.24.78.H01.1.454.CMB.1.raw
  modified_base (199)..(199): a, c, t, g, unknown or other
  misc_feature (199)..(199): n is a, c, g, or t
  modified_base (260)..(260): a, c, t, g, unknown or other
  misc_feature (260)..(260): n is a, c, g, or t
  modified_base (288)..(288): a, c, t, g, unknown or other
  misc_feature (288)..(288): n is a, c, g, or t
  modified_base (367)..(367): a, c, t, g, unknown or other
  misc_feature (367)..(367): n is a, c, g, or t
  modified_base (479)..(479): a, c, t, g, unknown or other
  misc_feature (479)..(479): n is a, c, g, or t
tcagactactatgtcacgaccggtgctcgatttagtgtgagtagtttgggtttggggagagctgctcagttaggacccagagggaaccatggaaaccccagcgcagcttctcttcctcctgctactctggctcccagccatcaccggagaaattgtgttgacacagtctccaggcaccctgtctttgtctccagggganagagccaccctctcctgcagggccagccggagtgttagtaagtacttaggctggtaccaanagaaacctggccaggctccaggctcctnatctatgatgtctccaacgagggtcactggctcccgcaggttcagtgcagtggctgggacagacttcactctcaccgtnagcagcctagagcctgaagtattttgcggtttactacttgtcagtcacgtcgttccgcgtggccgtctaacgtttcgggcgggggaccagggtggagaggagacgaacgtgnggcgtgacacagtcgtgttcttcgacttccgttcccgcctatctagaactagttaacg

SEQ ID NO: 157562 - DNA, 547 bp, Homo sapiens
  misc_feature: GYAE6OF01DQEEM.24.78.H01.1.454.CMB.1.raw
  modified_base (240)..(240): a, c, t, g, unknown or other
  misc_feature (240)..(240): n is a, c, g, or t
  modified_base (252)..(252): a, c, t, g, unknown or other
  misc_feature (252)..(252): n is a, c, g, or t
  modified_base (343)..(343): a, c, t, g, unknown or other
  misc_feature (343)..(343): n is a, c, g, or t
  modified_base (537)..(537): a, c, t, g, unknown or other
  misc_feature (537)..(537): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgctccaggggganagagccaccctntcctgcagggccagtcagagtgttagcagcagctacttagcctggtaccagcagaacctggcctggctccaggcctcctcatctatggtcncgtccacgaggcactggcgtcgcggacaggttcaggtcgcgagtggtcgtttgggactagacttcactcgtctactctacgtcgacgtacgacgtaggacgcccgaaagtatttcggactaggtacgttattactgtcagtcttgttcgtccctcttcctctactcgtactacgtttcggaccgttaggttccnggtctacggg

SEQ ID NO: 157563 - DNA, 534 bp, Homo sapiens
  misc_feature: GYAE6OF01BTL1A.24.78.H01.1.454.CMB.1.raw
  modified_base (239)..(239): a, c, t, g, unknown or other
  misc_feature (239)..(239): n is a, c, g, or t
  modified_base (502)..(502): a, c, t, g, unknown or other
  misc_feature (502)..(502): n is a, c, g, or t
  modified_base (524)..(524): a, c, t, g, unknown or other
  misc_feature (524)..(524): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgctccagggganagagccaccctctcctgcagggccagtcagagtgttagcagcagctacttagcctggtaccagcagaaacctggcctggctccaggctcctcatctatcggtcgcgtccaccgtagggccacgtgggccgtcgcggacaggttcaggtggacgaggtgggtcgtttggggacagtacttacactcgtacatctatcgacagactaggacgccgtaagtatttgctagtgttattactgtcagtcttgttcgtcctctcctctntcgtactcgttcgctaggtccnggtcgtacgg

SEQ ID NO: 157564 - DNA, 682 bp, Homo sapiens
  misc_feature: GYAE6OF01D6SF3.24.78.H01.1.454.CMB.1.raw
tcagactactatgtcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcacccttgtctttgtctccgaggggagagacgcccaccctctcctgcgagggccagtcagagtgtagcagcagctactagcctggtaccagcagaaacctggcctggcctcccgaggcctcctcatctagtcggtcgccgtccaccgcgggcccacgtggcgtcggcggactggttcaggtggctaggtggtcgttttagggactagtacttcgacttctacatcactcgacacgacgtacggacgacccgtaagttacgttttgacgtagttgtttaacgttacgttcgtacctacgttcgtttacggtttccggttcccctttccgttccctttaccgttacgtttaccgttaaccgtttaccggtttttaccgggtacccggttaccggggtttacccgtacggggttaccgttacggggtacgttaacgtacgtaaacgggtaccggttaaaccgttcgggttacgggtaccgttacggaacccttacccgtacgtttacccgg

SEQ ID NO: 157565 - DNA, 578 bp, Homo sapiens
  misc_feature: GYAE6OF01ESLFN.24.78.H01.1.454.CMB.1.raw
  modified_base (241)..(241): a, c, t, g, unknown or other
  misc_feature (241)..(241): n is a, c, g, or t
  modified_base (303)..(303): a, c, t, g, unknown or other
  misc_feature (303)..(303): n is a, c, g, or t
  modified_base (330)..(330): a, c, t, g, unknown or other
  misc_feature (330)..(330): n is a, c, g, or t
  modified_base (341)..(341): a, c, t, g, unknown or other
  misc_feature (341)..(341): n is a, c, g, or t
  modified_base (435)..(435): a, c, t, g, unknown or other
  misc_feature (435)..(435): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgtctccaggggganagagccaccctctcctgcagggccagtcagagtgttagcagcagctacttagcctggtaccngcagaacctggcctggctccagctccnatctagtggtnccgtccaccgaggccactggccatccccagacagggttcaggtggcaggtcggtcgtgggacaggtacttcacttcctcacctatcagcagtcngacaaccgtgaacgtactttacgacctaacttactattcgtactaaacgtagtaacgtttaccgtaccggtttaccccggtactacccggttcgggaccgggtaacgggacccgtaaagggtaggaacgtacgtaccgaaccg

SEQ ID NO: 157566 - DNA, 675 bp, Homo sapiens
  misc_feature: GYAE6OF01BDM70.24.78.H01.1.454.CMB.1.raw
  modified_base (241)..(241): a, c, t, g, unknown or other
  misc_feature (241)..(241): n is a, c, g, or t
  modified_base (347)..(347): a, c, t, g, unknown or other
  misc_feature (347)..(347): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggccaccctgtctttgctccgagggganagacgcccaccctctcctgcacgggccagtcagagtgtagcagcagctactagcctggtaccagcagaacctggcctggcctcccgagcctcctcatctatggtcnccgtaccacgcggccacgtcggcgtcggcgactcggttcaggtcgggactaggtcggtacgtttacgggactacgtaaccttcacttctactacgtactacgtccgaacgacggtaccgttacggaaccgtacccggtaagttacgttttcggacgttaggttacgttaacgtttaaccgtcggttaaccgtacggttccgtttacgggtttacccggttccccgtttcccgttaccctttacccgtttaacgttaccggtttaacctttaccggtttttaccggaccccggtttacgggtttacccgacggggttccgttaacgggg

SEQ ID NO: 157567 - DNA, 607 bp, Homo sapiens
  misc_feature: GYAE6OF01C7TLU.24.78.H01.1.454.CMB.1.raw
  modified_base (235)..(235): a, c, t, g, unknown or other
  misc_feature (235)..(235): n is a, c, g, or t
  modified_base (266)..(266): a, c, t, g, unknown or other
  misc_feature (266)..(266): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggctcccagccatcaccggagaattgtgtgacgcagtctccaggcacctgtcttgctcgagggganagacgccacctctcctgcagggccagtcagngtgtagcagcagctactagcctggaccagcagaacctggcctggcctccgagctcctcatctagtggtcgcatccgaagtacgggcctaacgtggacactcccgaagtacgtaggttcaggtcggacgtagggtcgggtcgtacgggactaacggtacttccgactccgtacaaccctatccgaagctaaggtcgtaacggaccgaccgttaggaaacgttattttacgactttaagtttacttacgtcgtacacgacgtacccggttagaacccaacgttcccgacccgttaccgtttcccggccccgtaagggacccaacgggtaccgtagggtaaccc

SEQ ID NO: 157568 - DNA, 610 bp, Homo sapiens
  misc_feature: GYAE6OF01BGRL1.24.78.H01.1.454.CMB.1.raw
  modified_base (240)..(240): a, c, t, g, unknown or other
  misc_feature (240)..(240): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgtctccagggganagagccaccctctcctgcagggccagtcagagtgtagcagcagctacttagcctggtaccagcagaaacctggcctggcctcccaggcctcctcatctagtggtcgccgtcccaccgacgggcccacgtcgggccgtcggcggaacgtagggtttccaggttcgggccgtaggtcggtcgtttaggggacgtaggtaccttcgacttcgtctatctatcgacgagtacgtggacgacccgtaagtacgttttcgcgtagttgttaacgttacgtcgtacgtagtcgttacgtttcggttcccttccttcccttccgtacgttcgtaccgttacgttttcggaccgttacgggttcctaggtcgttacggg

SEQ ID NO: 157569 - DNA, 541 bp, Homo sapiens
  misc_feature: GYAE6OF01EYPC3.24.78.H01.1.454.CMB.1.raw
  modified_base (200)..(200): a, c, t, g, unknown or other
  misc_feature (200)..(200): n is a, c, g, or t
tcagactactatgtcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgtctccgagggganagagcccaccctctcctgcagggccagtcagagtgttagcagcagctacttagcctggtaccagcagaaacctggcctggctccaggcctcctcatctatggtcgcgtccaccgagggccacgtcggcgtcggcggacgtacggttcaggtggcaggttcggtcgtttgggactagtacctttcactctcatcatcgacacgacgtggacgacccgaagtacgtttgactagtagtattacgtgtcagtctgttcgtcctctcctctatcgtactcgttcgcgtaggttccaggtcgtaggtacgtatacgagtcgtaagtgtcggctagcctcgtagtcg

SEQ ID NO: 157570 - DNA, 580 bp, Homo sapiens
  misc_feature: GYAE6OF01EQCKW.24.78.H01.1.454.CMB.1.raw
  modified_base (240)..(240): a, c, t, g, unknown or other
  misc_feature (240)..(240): n is a, c, g, or t
  modified_base (252)..(252): a, c, t, g, unknown or other
  misc_feature (252)..(252): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgtctccagggganagagccaccctntcctgcagggccagtcagagtgttagcagcagctacttagcctggtaccagcaagaaacctggcctggcctcccaggcctcctcatctagtggtcgcgtccaccgagggccacgtggcgtcgcggacaggttcaggtggcaggtgtcgtttgggacagtacttcactctacatcactcgacagactggacgacccgaagttacgtttcgactaggttacgttattacgtcgtacgtagtcgtttcggtttacggttcccttccttcccttaccttacttcgttaccttacgttttcggacccgttagggtttcccgagggtcgtaggg

SEQ ID NO: 157571 - DNA, 566 bp, Homo sapiens
  misc_feature: GYAE6OF01BXC0O.24.78.H01.1.454.CMB.1.raw
  modified_base (241)..(241): a, c, t, g, unknown or other
  misc_feature (241)..(241): n is a, c, g, or t
  modified_base (306)..(306): a, c, t, g, unknown or other
  misc_feature (306)..(306): n is a, c, g, or t
  modified_base (349)..(349): a, c, t, g, unknown or other
  misc_feature (349)..(349): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgtctccgagggganagacgcccaccctctcctgcaggggccagtcagagtgttagcagcagctacttagcctggtaccngcagaacctggcctggcctccaggctcctcatctagtcggtcnccgtccacgacgggccacgtcggcgtcgacggactggttcaggttcggcgagtggtcgtttgggacacgtacttcactctcatctactcgacacgacgtcggacgaccgaagtacgtttgacgtagttgttacgttactgtcagtcttcgttccgttccctcttccctcttactcgtaccttacgtttcggaccgttaggttccgtggtcgtacggg

SEQ ID NO: 157572 - DNA, 571 bp, Homo sapiens
  misc_feature: GYAE6OF01COEE9.24.78.H01.1.454.CMB.1.raw
  modified_base (296)..(296): a, c, t, g, unknown or other
  misc_feature (296)..(296): n is a, c, g, or t
  modified_base (319)..(319): a, c, t, g, unknown or other
  misc_feature (319)..(319): n is a, c, g, or t
tcagactactatgtcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgtctccgaggggagagacgccaccctctcctgcagggccagtcagagtgttagcagcagctacttagcctggtaccagcagaaacctggcctggctcccgaggcctcctnactctagtggtcgcgtccaccgngggccacgtggcgtcgcggacaggttcagtggcgaggtcggtcgtttgggactaggtaccttcgacttctacatcatcgacagacgtggacgacccgtaagtatttcgactagtagttattacgtgtcagtcgttcgtttcgtccctccttcctccttatcgttacttacgtttcggccgttacggttccgaggtcgttagggacgtagtacgaacggtcgtaacgttggtacggctagcctacgtgttccg

SEQ ID NO: 157573 - DNA, 516 bp, Homo sapiens
  misc_feature: GYAE6OF01EH4AL.24.78.H01.1.454.CMB.1.raw
  modified_base (457)..(457): a, c, t, g, unknown or other
  misc_feature (457)..(457): n is a, c, g, or t
  modified_base (477)..(477): a, c, t, g, unknown or other
  misc_feature (477)..(477): n is a, c, g, or t
  modified_base (513)..(513): a, c, t, g, unknown or other
  misc_feature (513)..(513): n is a, c, g, or t
tcagactactatgtcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgtctccgaggggagagagcccaccctctcctgcagggccagtcagagtgttagcagcagctactagcctggtaccagcagaaacctggcctggctcccaggcctcctcatctatggtcgccgtccaccgagggccacgtggcgtcgcggacaggttcaggtggcgaggtggcgtttgggactagtacttcgacttctcatcatcgacagacgtggacgacccgaagtatttgactagtgtattcgtgtcagtcttgttcgtcctctctctntctactctttgcctggtccnggtctggactatcgagcgtagtgtcggctagctcgntcg

SEQ ID NO: 157574 - DNA, 614 bp, Homo sapiens
  misc_feature: GYAE6OF01A618M.24.78.H01.1.454.CMB.1.raw
  modified_base (238)..(238): a, c, t, g, unknown or other
  misc_feature (238)..(238): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcacctgtctttgctccgaggganagacgccacctctcctgcagggccagtcagagtgtagcagcagctacttagcctggaccagcagaacctggcctggcctccgagcctctcatctagtggtcgccgtccacgaggccacgtggcgtcgacggtactaggttcaggttcggacgtaggtcggtcgttgggactgtactcgactctcactcactcgacacgtacgtggacgccgtaagtacgtttcgacgtagttacgttacgttacgttacgtaccgtaggttccgtttcggtttaccggttccccttccgttcccttaccgttacgttaccgttaacccgttacggttttaccgggcccggtttaacgggtttcccgtacgggttccggttaacggg

SEQ ID NO: 157575 - DNA, 500 bp, Homo sapiens
  misc_feature: GYAE6OF01DXVDZ.24.78.H01.1.454.CMB.1.raw
  modified_base (303)..(303): a, c, t, g, unknown or other
  misc_feature (303)..(303): n is a, c, g, or t
  modified_base (495)..(495): a, c, t, g, unknown or other
  misc_feature (495)..(495): n is a, c, g, or t
  modified_base (497)..(497): a, c, t, g, unknown or other
  misc_feature (497)..(497): n is a, c, g, or t
tcagactactatgtcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgtctccaggggagagagccaccctctcctgcagggccagtcagagtgttagcagcagctacttagcctggtaccagcaagaaacctggcctggctcccaggctcctcatctatggtncgtccacgagggccatggcgtcgcggacaggttcagtgcagtggctttgggacagacttcactctcatcatcgacagactggacgcccgaagattttgcagtgtattactgtcatctgttggtccctctcctctatgtactactttcggcctacgggttccaggctggagtatcaagcgaactgtggctgcncntcg

SEQ ID NO: 157576 - DNA, 674 bp, Homo sapiens
  misc_feature: GYAE6OF01DG7RJ.24.78.H01.1.454.CMB.1.raw
  modified_base (233)..(233): a, c, t, g, unknown or other
  misc_feature (233)..(233): n is a, c, g, or t
  modified_base (267)..(267): a, c, t, g, unknown or other
  misc_feature (267)..(267): n is a, c, g, or t
tcagactactatgtcacgaccggtgctcgatttagtgtgagtagtttgggtttggcacgaccggtgctcgatttagtgtgagtagtttgggttggggagagctgctcagttaggacccagagggaaccatggaacccagcgcagcttctcttcctcctgctactctggctcccagccatcaccggagattgtgttgacgcagtctccaggcacctgtctttgctcgagggganacgacgccacctctcctgcacggaccagtcgagngtgtagcagcagctactagcctaggtaccagcaacgaacctggccgtggccctacccgaggtccctccgtcatccgtagtcggtcgccgtaccacggacgggccaacgtgggtccgcggacggaccgtggttcgagttcggcgtaggtcggtcgtttacgggactacgtacttacgtactcgtacacttcgacgttaccgactaggacgttagggaccgtaacccggtaacgttaacgtttacggaccgttaaggtttacgttaacgtttacgtacggttacgtaggttaccgtttcggtttaccgttccccgtttccgttacccgttaccgtttacgttacggtttacccgtttacgtttttccgggacccgtttaggggtttacccgtagggttcgttaccgggg

SEQ ID NO: 157577 - DNA, 592 bp, Homo sapiens
  misc_feature: GYAE6OF01A0TOM.24.78.H01.1.454.CMB.1.raw
  modified_base (244)..(244): a, c, t, g, unknown or other
  misc_feature (244)..(244): n is a, c, g, or t
  modified_base (386)..(386): a, c, t, g, unknown or other
  misc_feature (386)..(386): n is a, c, g, or t
tcagactactatgtcacgaccggtgctcgatttagtgtgagtagtttgggtttggtacgaccggtgctcgatttagtgtgagtagtttgggtttggggagagctgctcagttaggacccagagggaaccatggaaaccccagcgcagcttctcttcctcctgctactctggctcccagccatcaccggaggaattgtgtgacgcagtctccagccaccctgtctgtgtctccgaaggggaaagngcccaccctctcctgccagggccagtcagagtataagaagcaactacttagcctggtatacaaacagaaaccgtggccgacggcctcccgaggcctcctacatctagtggtaatactccgagtcgacgggccacgtgggtcncccagccgtaggttcgacggtggctaggtgggtcgtcgggagacgtgttaccactcgtccgaacctactcgtaacgacgagtccgtgacgtacgtcgtagaacgttatttacgcttagtttacttacgtgtccagcagaccacgtacgtacgacgtcggtcccgcttacgtacgttacgggcggtaaggacggtaggtaggtaacg

SEQ ID NO: 157578 - DNA, 717 bp, Homo sapiens
  misc_feature: GYAE6OF01CAPT5.24.78.H01.1.454.CMB.1.raw
  modified_base (241)..(241): a, c, t, g, unknown or other
  misc_feature (241)..(241): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgtctccgagggganagacgccaccctctcctgcgaggggccagtcagagtgttagcagcagctacttagcctggtaccagcaacgaaaccgtggcctggcctcccaggcctcctcatctagtcggtcgcgtccacgacgggccacgtggacgtccggacggactacggttcgaggtcgggacgtaggttgggtcgtttaggggaactaacgtacgttaccgtactaccttacaacgtccaagttccgaacgacggtaaccggtgggaaccgtacccggtaaaagtttacgtttttacggaccgtaaggtttacgttaaagtttaccttacgggttacctaggttccgtttcgggtttttcccgggttccccctttaccgttacccctttaccgtttaaaccgtttccggttttaacccgtttaccggtttttaccgggtaccccggtttaaacgggggtttcccctaagggggttccggtttaacggggg

SEQ ID NO: 157579 - DNA, 664 bp, Homo sapiens
  misc_feature: GYAE6OF01EYWWQ.24.78.H01.1.454.CMB.1.raw
tcagactactatgtcacgaccggtgctcgatttagtgtgagtagtttgggtttgggggaggagcccagcactagaagtcggcggtgtttccattcggtgatcagcactgaacacagaggactcaccatggagtttgggctgagctgggttttcctcgtcgctcttttaagaggtgtccagtgtcaggggcagctggtggagtcgtgggggcggcgtggtccaacctggggaggtccctgagactctcctgtgcggcctccgattcaccttcaatacttatggcatgcactgggtccgccaggcctccaggcgaaggggctgggagtggggtggccgctatctttatttgatggaatatacaattattatgacagacctccggtaggaaacggggtcccgttacaacctattcctaccaagaacgtaacaacttacccaaactaacttaaccttcttagtttactagtactaaacttcgtaacttacgcctagacgtactcgtacggacggaccgtaccggtcttcgttaccttaagtttaccgtggtacggtacggtaaaacggtaccgtttacccccgggtaccctttacgttaaccgtagtttaacggtttcgggggtacccggtaccccccttaagtacggttcgggtacggttaccgggg

SEQ ID NO: 157580 - DNA, 536 bp, Homo sapiens
  misc_feature: GYAE6OF01DIL0O.24.78.H01.1.454.CMB.1.raw
  modified_base (244)..(244): a, c, t, g, unknown or other
  misc_feature (244)..(244): n is a, c, g, or t
  modified_base (373)..(373): a, c, t, g, unknown or other
  misc_feature (373)..(373): n is a, c, g, or t
  modified_base (477)..(477): a, c, t, g, unknown or other
  misc_feature (477)..(477): n is a, c, g, or t
  modified_base (528)..(528): a, c, t, g, unknown or other
  misc_feature (528)..(528): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatcggaaaccccagcgcagcttctcttcctcctgctactctggctcccagccatcaccggaggaattgtgttgacgcagtctccaggcaccctgtctttgctccaggggaagacnccaccctctcctgcagggccagtcagagtgttagcagcagctactagctggtaccagcagaactgcctggcctccagcctcctcatctagtggtcgccgtcaccgagggccacgtggcgtcgcggacgnggttcagtggcaggtggtcgtttagggactacgtacttcaacgtctacagtccatcgaacacgacgtggacgaccgagtactttgcgtagtgttattactgtcngtctgttcgtccctctcctcttatcgttactacgtttcggactaggttcgngtgtacgg

SEQ ID NO: 157581 - DNA, 559 bp, Homo sapiens
  misc_feature: GYAE6OF01A0SEX.24.78.H01.1.454.CMB.1.raw
  modified_base (241)..(241): a, c, t, g, unknown or other
  misc_feature (241)..(241): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgtctccaggggganagagcccaccctctcctgcagggccagtcagagtgttagcagcagctacttagcctggtaccagcagaacctggcctggctcccgaggcctcctcatctagtcggtgccgtccaccgagggccacgtcggcgtcgcggactaggttcaggtggcgagtcggtcgtttgggactagtacttcactctcatcagtcgacacgacgtggacgacccgtaagtatttcggctagtagtattacgtgtactagtcttagttcgtcccttcgttccctcttacgtcgttacttacgttttcggcctagggttcctggtcgtagg

SEQ ID NO: 157582 - DNA, 530 bp, Homo sapiens
  misc_feature: GYAE6OF01B91WD.24.78.H01.1.454.CMB.1.raw
  modified_base (199)..(199): a, c, t, g, unknown or other
  misc_feature (199)..(199): n is a, c, g, or t
  modified_base (302)..(302): a, c, t, g, unknown or other
  misc_feature (302)..(302): n is a, c, g, or t
tcagactactatgtcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgtctccagggganagagccaccctctcctgcagggccagtcagagtgttagcagcagctacttagcctggtaccagcagaaacctggcctggctcccaggctcctcatctatggtnccgtccaccgagggccacgtggcgtcgcggacaggttcagtggcaggtggctttgggacagacttcactctcattcatcgaacagacgtggacgacccgaagtattttgctagtgttattactgtctagtctgtttcgtcctctcctctatcgtactacgtttggcctagggttccaggtcctggtagtatacgaagtccgaagtgtcggtactgcctacgtgttccg

SEQ ID NO: 157583 - DNA, 520 bp, Homo sapiens
  misc_feature: GYAE6OF01E3ZCL.24.78.H01.1.454.CMB.1.raw
  modified_base (241)..(241): a, c, t, g, unknown or other
  misc_feature (241)..(241): n is a, c, g, or t
  modified_base (488)..(488): a, c, t, g, unknown or other
  misc_feature (488)..(488): n is a, c, g, or t
  modified_base (512)..(512): a, c, t, g, unknown or other
  misc_feature (512)..(512): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgtctccaggggganagagcccaccctctcctgcagggccagtcagagtgttagcagcagctacttagcctggtaccagcagaaacctggcctggctcccaggctcctcatctatggtgcgtccaccgagggccacgtggcgtcgcggacaggttcagtggcgagtggcgtttgggacagacttcactctcatcatcgacagactggacgccgaagtatttgctagtgtattactgtcagtcttgttcgtccctctcctctntgtactcgtttcggctaggttccnggtctagg

SEQ ID NO: 157584 - DNA, 696 bp, Homo sapiens
  misc_feature: GYAE6OF01CTCHG.24.78.H01.1.454.CMB.1.raw
  modified_base (202)..(202): a, c, t, g, unknown or other
  misc_feature (202)..(202): n is a, c, g, or t
tcagactactatgtcacgaccggtgctcgatttagtgtgagtagtttgggtttggggagagctgctcagttaggacccagagggaaccatggaaaccccagcgcagcttctcttcctcctgctactctggctcccagataccactggagaaatagtgatgacgcagtctccagccaccctgtctgtgtctccgaggggaaancgccaccctctcctgcagggccagtcagagtataagaagcaactacttagccttggtaccagcagaaactgctgcctccaggcctcctcatctatggtcgcgtccaccgagggccacgtggcgtcggcggacgaggttcagtggcgaggtcggtcgtttgggactacggacttcgactcgtcatcatcgacacgactggacgcccgaagtacgtttcgacgtagttacgttactttaacgtcgtactagttccgtttaggttttccgggttccctttccgtttaccccgtttacccgtttacgttaccggtttaaccctttaccgggttttttaccgggccccggtttaacggggtttacccggtaacgggggttacccgttacgggggtaaccgttacgttaacccgggaaaggttaccccgggttaaaacggttcgggttacggttacccggtaggttacccgtaaacccgtcgtttcccggttttacccgg

SEQ ID NO: 157585 - DNA, 663 bp, Homo sapiens
  misc_feature: GYAE6OF01BCLS7.24.78.H01.1.454.CMB.1.raw
  modified_base (243)..(243): a, c, t, g, unknown or other
  misc_feature (243)..(243): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggccaccctgtctttgtctccgaggggganagagcccaccctctcctgcagggccagtcagagtgttagcagcagctacttagcctggtaccagcaagaaacctggcctggcctcccgagcctcctcattctagtggtcgccgtaccacgacgggccacggtcgggccgtcggccggtactagggttcaggtcggacgtaggtcggtcgtttacggggacgtaacgtaccttcgtaaccttccgtactactccgtacgtaccgaacacggtacgtacgggaaccgtaacccggttaaaagttttcgacgtagttagttaactttacgtacgtacgtacggttcgttcggtttccgttcccttccgttcccgttaccttacgttcgttaaccgttaccggttttacgggtacccgttacggggtttaccgtacgggttccgtagggtaacg

SEQ ID NO: 157586 - DNA, 666 bp, Homo sapiens
  misc_feature: GYAE6OF01AX0W4.24.78.H01.1.454.CMB.1.raw
  modified_base (200)..(200): a, c, t, g, unknown or other
  misc_feature (200)..(200): n is a, c, g, or t
tcagactactatgtcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgtctccgagggganagacgcccaccctctcctgcagggccagtcagagtgtagcagcagctactagcctggtaccagcagaaccgtggcctggcctccgaggtcctcctcagtctagtcggtcgccgtacccaccgacgggccctacgtcggccgtcggaccggacgtacggttcgaggtcggcgtaggtcggtcgttttaggggaactacgtaccttcgaccttctacgacttcgtacgtaccgaacgacgtacgtcgggaacgtaccccgtaaagttcgttttacgacgttaggttagttaactttacgtcggttacgtagttccgtttggtttcccggtccccttccgttcccgttactttacgttacgtttacccgtttacgtttaccgggccgttacgggttccgagggttaccgttaggacgtacgtacgaacggtccgtaagttcggtcggtacgtctaccgtacgtcgttcg

SEQ ID NO: 157587 - DNA, 652 bp, Homo sapiens
  misc_feature: GYAE6OF01B9GFZ.24.78.H01.1.454.CMB.1.raw
  modified_base (241)..(241): a, c, t, g, unknown or other
  misc_feature (241)..(241): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttggctccgagggganagacgccaccctctcctgcagggccagtcaggagtgttagcagcagctacttagccgtggtaccagcaagaaacctcggcctggcctcccgaggcctccgtcaacgttctagtcggtcgccgtccgacgacgggccacgtggccgtcggcggactggttcgaggtcggcgaggtcggtcgtttagggactacggtacttcgacctctcatcacgtcgacacgtacgtggaaccgaccggtaagttacgtttacggacttaggttacgtttaacttaccgtgttaccgtacgttcgtttacggtttcccggttaccccttccgttacccctttacgttacgtttaccgttaaccgttaccgtttttacgggtacccggttacgggtttacccggtaggggttccgttacggg

SEQ ID NO: 157588 - DNA, 297 bp, Homo sapiens
  misc_feature: GYAE6OF01DA3IZ.24.78.H01.1.454.CMB.1.raw
  modified_base (260)..(264): a, c, t, g, unknown or other
  misc_feature (260)..(264): n is a, c, g, or t
  modified_base (266)..(297): a, c, t, g, unknown or other
  misc_feature (266)..(297): n is a, c, g, or t
tcagactactatgtcacgaccggtgctcgatttagtgtgagtagttgggtttgggacgagactttcactctcatcatcgacagactggaagcccgaagattttgcagtgttattactgtcagctgtttggtccctctcctcctatgtacacttttggccagggttccaggctggagatcaagcgaactgtggctgcaccatctgtcttcatcttcccgcatctgacatagtagtctgagcggctggcaaggcgcagtagnnnnngnnnnnnnnnnnnnnnnnnnnnnnnnnnnnnnn

SEQ ID NO: 157589 - DNA, 671 bp, Homo sapiens
  misc_feature: GYAE6OF01COW4T.24.78.H01.1.454.CMB.1.raw
  modified_base (388)..(388): a, c, t, g, unknown or other
  misc_feature (388)..(388): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagaggaaccatggaaacccagcgcagcttctcttcctcctgctactctggctccagccatcaccggagaattgtgttgacgcagtctccgaggccacccgttggtcttttcggtccgtccgaggggagaggacgccctaccttctccgtgcgacgggccagtcagtagttgttacgcgtagcacgtcttaacgttagccgttggtaccagccgaacgaaaccgtcggccgtaggcctccggagtcctccgtcattccgtagtcgggtcnccgtaccgaccgaggcctaacggtcggccgtacgcggtaacgtcggttcagggtcggcgtggtcggtcgttcgggactacgtactacgtactcctacactctacgtacgacgtacgtacgtcggaacgaaccgtaagttacgtttgaccgttagttacgtttaacttacgttcgtacgtcgttcgtttcggtttcccgttcccgtttccgttcccttacgttacttacggttaaccttacggtttacggcccggttaagggttcccggaggttaccggtacgg

SEQ ID NO: 157590 - DNA, 258 bp, Homo sapiens
  misc_feature: GYAE6OF01EGV0G.24.78.H01.1.454.CMB.1.raw
  modified_base (257)..(258): a, c, t, g, unknown or other
  misc_feature (257)..(258): n is a, c, g, or t
tcagactactatgtcacgaccggtgctcgatttagtgtgagtagttgggtttgggacagacttcactctcatcatcgacagactggagcccgaagattttgcagtgtattactgtcagctgttggtccctctcctcctatgtacacttttggccagggttccaggctggagatcaagcgaactgtggctgcaccatctgtcttcatcttcccgccatctgaacatagtagtctgagcgggctggcaaggcgcatagnn

SEQ ID NO: 157591 - DNA, 669 bp, Homo sapiens
  misc_feature: GYAE6OF01CQLZV.24.78.H01.1.454.CMB.1.raw
  modified_base (238)..(238): a, c, t, g, unknown or other
  misc_feature (238)..(238): n is a, c, g, or t
  modified_base (387)..(387): a, c, t, g, unknown or other
  misc_feature (387)..(387): n is a, c, g, or t
  modified_base (609)..(609): a, c, t, g, unknown or other
  misc_feature (609)..(609): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaagcccagctcagcttctcttcctcctgctactctggcctcccagacgaccaccggagaaattgtgttgacacagtctcaggcacctgtcttgtctcgagggganagacgccacctctccgtgcgacgggccaggccggtagtgttagtaagtacttaggcttaggaaccaacagaaaccgtggaccaggcctacccgaggcctccgtcatctaatgactcgtacctaccgaagcgggtacacgtcgggtaccnccccggacgtaggtttccaggtggtccgtagggttcggggtactaggggaacctacgtaccgttccaacgtccgtaccgacccgtgaacgcaacggtcctaaggaccgcggtaagttaacgttcgtttttcggtacgttttaactaccgtgtacgacgtcgtacgtcccggttaccgcggtacgcccgttagtaccgggttccgggggaaccggggtaccgnggggtagggacggacgggaacgtacggtaacgtcgggtcgacgtacggacctcgttacgg

SEQ ID NO: 157592 - DNA, 654 bp, Homo sapiens
  misc_feature: GYAE6OF01E1L9H.24.78.H01.1.454.CMB.1.raw
  modified_base (241)..(241): a, c, t, g, unknown or other
  misc_feature (241)..(241): n is a, c, g, or t
tcagactactatgtcacgaccggtgctcgatttagtgtgagtagtttgggtttggcacgaccggtgctcgatttagtgtgagtaggttgggtttggggagagctgctcagttaggacccagagggaaccatggaaaccccagcgcagcttctcttcctcctgctactctggctcccagccatcaccggaggaattgtgttgacgcagtctccaggcaccctgtctttgtctccgagggganaggacgcccaccctctcctgcagggccagtcagagtgtagcagcagctactgcctggtaccagcaagaacctggcctggcctccgagcctcctcatctagtggtcgccgtaccaccgagggccctacgtcgggccgtcggccgggaacgtaggttccagggttcggacgtaggtcgggtcgtttggggactacggtacttacgtacttccgtacccgtaccgtcacgtcacgtcccgtaggacgtccgtagtaacgttacgtttccggtacggttttaactaccgttcgtacgtacggccgtacggtccggttcccgaccgtcgggtcccgtaccgtttaaccggttccggggaccggggggtaccgtacgggggtacggtaagggacgggacggtaacggaacggttcgggg

SEQ ID NO: 157593 - DNA, 530 bp, Homo sapiens
  misc_feature: GYAE6OF01AK2F5.24.78.H01.1.454.CMB.1.raw
  modified_base (522)..(522): a, c, t, g, unknown or other
  misc_feature (522)..(522): n is a, c, g, or t
  modified_base (527)..(527): a, c, t, g, unknown or other
  misc_feature (527)..(527): n is a, c, g, or t
tcagactactatgtcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgtctccaggggagagagccaccctctcctgcagggccagtcagagtgttagcagcagctacttagcctggtaccagcagaaacctggcctggctccaggcctcctcatctatggtcgcgtccaccgagggcccacgtggcgtcgcggacaggttcagtggcagtggtctttgggacaggacttcactctcatcatcgacagactggacgcccgaagtattttgactaggtgttattactgtcagtcttgtttcgtccctctcctccttatcgtactctttcggccgtacgggttccaggtcgtggtacgtatcgaacgcgtaactggtcggctgcnccgtntcg

SEQ ID NO: 157594 - DNA, 259 bp, Homo sapiens
  misc_feature: GYAE6OF01C4J1F.24.78.H01.1.454.CMB.1.raw
  modified_base (258)..(259): a, c, t, g, unknown or other
  misc_feature (258)..(259): n is a, c, g, or t
tcagactactatgtcacgaccggtgctcgatttagtgtgagtagttgggtttgggacagacttcactctcatcatcgacagactggagcccgaagattttgcagtgtattactgtcagctgtttggtccctctcctcctatgtacacttttggccagggttccaggctggagatcaagcgaactgtggctgcaccatctgtcttcatcttcccgccatctgaacatagtagtctgagcgggctggcaaggcgcatagnn

SEQ ID NO: 157595 - DNA, 543 bp, Homo sapiens
  misc_feature: GYAE6OF01CY34E.24.78.H01.1.454.CMB.1.raw
  modified_base (241)..(241): a, c, t, g, unknown or other
  misc_feature (241)..(241): n is a, c, g, or t
  modified_base (472)..(472): a, c, t, g, unknown or other
  misc_feature (472)..(472): n is a, c, g, or t
  modified_base (508)..(508): a, c, t, g, unknown or other
  misc_feature (508)..(508): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgtctccgagggganagagccaccctctcctgcagggccagtcagagtgttagcagcagctacttagcctggtaccagcagaaacctggcctggcctcccgaggcctcctcatctagtggtcgccgtccaccgacgggccacgtgggcgtcgcggacaggttcaggtcggcgtaggtggtcgtttgggactagtacttcactctcatcatcgacagacgtggacgccgtaagtatttcgactagtnttattactgtctagtcttgttcgtcctctccttctntcgtacttcgtttcggccgtaggtcaggtcgtagg

SEQ ID NO: 157596 - DNA, 740 bp, Homo sapiens
  misc_feature: GYAE6OF01ETEXB.24.78.H01.1.454.CMB.1.raw
tcagactactatgtcacgaccggtgctcgatttagtgtgagtagtttgggtttggcacgaccggtgctcgatttagtgtgagtagtttgggtttggggagagctgctcagttaggacccagagggaaccatcggaaaccccagcgcagcttctcttcctcctgctactctggctccagccatcacggagaattgtgtgacgcagtctccaggcaccctgtctttgtctcgagggagagacgccaccctctccgtgcgacgggccagtcagtagtgtagcagcagctacgtagccgtaggtaccagcaacgaaaccgtcggaccgtggccctacccgaggtcctcctacgacttcgtagtggtcgtccgtaccgaccgacggccacgtcggcgtcggaccgacgtacggtcaggtcggacgtaggttcggtcgtttaggggactacggtacctttaccgacttccgtacgtaacttccgtacgtaccgaacgtacggtaaccgtacgggtaacccgtacccggttaaaggtttaccgttttacggaccgttaaggtttacgtttaacgtttaaccggttaggttaccgtaagttcccggttttaccggttttacccggttcccccgtttccgtttacccttacccgtttaacgtttacccggtttaacccgttttaccgggtttttacccgggaccggttttaacccggggtttcccgttacggggtccggtttaacgggg

SEQ ID NO: 157597 - DNA, 659 bp, Homo sapiens
  misc_feature: GYAE6OF01A7TXU.24.78.H01.1.454.CMB.1.raw
  modified_base (176)..(176): a, c, t, g, unknown or other
  misc_feature (176)..(176): n is a, c, g, or t
  modified_base (190)..(190): a, c, t, g, unknown or other
  misc_feature (190)..(190): n is a, c, g, or t
  modified_base (194)..(194): a, c, t, g, unknown or other
  misc_feature (194)..(194): n is a, c, g, or t
  modified_base (196)..(196): a, c, t, g, unknown or other
  misc_feature (196)..(196): n is a, c, g, or t
  modified_base (198)..(198): a, c, t, g, unknown or other
  misc_feature (198)..(198): n is a, c, g, or t
  modified_base (205)..(205): a, c, t, g, unknown or other
  misc_feature (205)..(205): n is a, c, g, or t
  modified_base (207)..(207): a, c, t, g, unknown or other
  misc_feature (207)..(207): n is a, c, g, or t
  modified_base (216)..(216): a, c, t, g, unknown or other
  misc_feature (216)..(216): n is a, c, g, or t
  modified_base (231)..(231): a, c, t, g, unknown or other
  misc_feature (231)..(231): n is a, c, g, or t
  modified_base (262)..(262): a, c, t, g, unknown or other
  misc_feature (262)..(262): n is a, c, g, or t
tcagactactatgtcacgaccggtgctcgatttagtgtgagtagtttgggtttggggagaggagcccagcactagaagtcggcggtgtttccattcggtgatcagcactgaacacagaggactcaccatggagttttgggctgagcgggcgttcggcgaaggcgtcttaagaggtntcagtgcaggcagngtgngngngtggcgngngcacgtggngcgtgagctctctgngcgccgtccgactctactactatactagtgntgtcgtcgtacgtcggtcgacgacgcgtacgacgacgacggcgtggtaggtcggtcggtcgtcgtatacttgtagtagtagtagtaatagtaagtagtatagtacgacgtacgtacgtagtacggtacgtacgacgtacgtacgtacgacgacgtaactaactaactaactaactactacgttacgttacgtacgtaacgtaacgtacgtaacgtacgtacgtacgtacgtacgtacgtacgtaacgtaacgtaccgtacgtacgttacgttaacgttaacgttacgtaacggtaacgtaaccggttacccgttacccgttacccgttaccgttaaccgttaacggttacgggttacggttaccggtaacccgttaaccggtacggtaccggtacgg

SEQ ID NO: 157598 - DNA, 606 bp, Homo sapiens
  misc_feature: GYAE6OF01DBYIU.24.78.H01.1.454.CMB.1.raw
  modified_base (348)..(348): a, c, t, g, unknown or other
  misc_feature (348)..(348): n is a, c, g, or t
  modified_base (374)..(374): a, c, t, g, unknown or other
  misc_feature (374)..(374): n is a, c, g, or t
tcagactactatgtcacgaccggtgctcgatttagtgtgagtagtttgggtttggggagaggagcccagcactagaagtcggcggtgtttccattcggtgatcagcactgaacacagaggactcaccatggagtttgggctgagcttgggttttcctcgtcgctcttttaagaggtgtccagtgtcgagggggcagctggtggagtcgtgggggcggcgtggtccaaccgtggggacggtccctgacgactctcctgtcgccggcctcccgattccaccttcaatacttatggcatgcacgtgggtccgccaggcctccgaggcgaaggggctggaggtgggtgccgntatcttattgatggaataatcaaatntatgcagactcggtagaacgggtccgttcactactcctaccagacgactaattaccaaacaactactcttcgtttctagtactaaagtgactacgctgcgtaactcgtagacggactacgggtcttacgttctaatttacgtgtacgtacgtaaacggtcccgttccccggtaccctttcgttacgtagttacggttcggggtaccgtaccccctacgtacgtcggtaccgg

SEQ ID NO: 157599 - DNA, 890 bp, Homo sapiens
  misc_feature: GYAE6OF01AG355.24.78.H01.1.454.CMB.1.raw
  modified_base (286)..(286): a, c, t, g, unknown or other
  misc_feature (286)..(286): n is a, c, g, or t
  modified_base (305)..(305): a, c, t, g, unknown or other
  misc_feature (305)..(305): n is a, c, g, or t
tcagactactatgtcacgaccggtgctcgatttagtgtgagtagtttgggtttggggagaggagcccagcactagaagtcggcggtgtttccattcggtgatcagcactgaacacagaggactcaccatggagtttgggctgagcttgggttttcctcgtcgcttcttttaagaggtgtccagtgtcaggggcagctggtggagtcgtgggggcgcgtggtccaacgtgggacggtccctgagactctcctgtcgccggcctccgattccaccttcaatacttagnggcatgccacgtcgggccncgaggcctccgagggcgaaggggctaggggaggtggggtcgccgtattacttctttagtttggaagttagggtaaattaactactaaaatttacttaagtcggacctaacggtaccgtttacccggggtaagggtaaaccgggggttccccggtttaccaacccgtacgtttaccccgtacccgaaaggtaacgtaaaccttaaacgtttaaccccaaaaccgtaaactttaccgtttaccgttttacggttttaccgtaacggtaaaccttaaaacgtttcggtaaaccgttaacggtacccgttacgggtaaccgttaaccgttaccgggtaacgggtaaaccgggtaacccggtaaccggggttaccgtttacggttaaccgtttaacgtttaacccggtagggttaacccgggtaaaccggttaaaacccggtttcccccgggtttacccccccggtttacccgtttttaaccggttttaaacccgggtttaacggtttttaaccggggtttcccgggggggttaacccccttaacccccccggttaacggtttaccgggttacccggggttaacccgggg

SEQ ID NO: 157600 - DNA, 582 bp, Homo sapiens
  misc_feature: GYAE6OF01B3U4L.24.78.H01.1.454.CMB.1.raw
  modified_base (156)..(156): a, c, t, g, unknown or other
  misc_feature (156)..(156): n is a, c, g, or t
  modified_base (171)..(171): a, c, t, g, unknown or other
  misc_feature (171)..(171): n is a, c, g, or t
  modified_base (337)..(337): a, c, t, g, unknown or other
  misc_feature (337)..(337): n is a, c, g, or t
tcagactactatgtcacgaccggtgctcgatttagtgtgagtagtttgggtttggggagaggagcccagcactagaagtcggcggtgtttccattcggtgatcagcactgaacacagaggactcaccatggagtttgggctgagctgggttttccncgtcgctctttaagnggtgtccagtgtcaggggcagctggtggagtcgtgggggcgcgtggtccaaccgtgggacgtccctgagactctcctgtgccggcctcccgattccaccttcaatacttatggcatgcactcgggtccgccaggcctccgaggcaaggggctggagtgggtgccgntatcttattgataggaataatcaaatattatgcagtactcgtaggaacgggtccgttacaccgtatcctaccagacgacaattaccaaactaatactcttcgtttctagactaaatcgactagcctgacgatcgtagacggacacggctgtactaattacgtgtggaacgtaaacgtccgtttccccggccctttacgttacgtatttacggttcgggaccggtaccccctagtcgtggtaccgg

SEQ ID NO: 157601 - DNA, 698 bp, Homo sapiens
  misc_feature: GYAE6OF01E4KEY.24.78.H01.1.454.CMB.1.raw
  modified_base (201)..(201): a, c, t, g, unknown or other
  misc_feature (201)..(201): n is a, c, g, or t
tcagactactatgtcacgaccggtgctcgatttagtgtgagtagtttgggtttgggggagagctgctcagttaggacccagagggaaccatggaaaccccagcgcagcttctcttcctcctgctactctggctcccagccatcaccggaggaattgtgttgacgcagtctccaggcaccctgtctttgtctccgagggganagagccaccctctcctgcagggccagtcagagtgttagcagcagctacttagcctggtaccagcagaacctggcctggctccaggctcctcatctatggtcgccgtcccaccgacgggccacgttgggccgtcggcggacgtacgggttcaggttcggacgtaggtcggtcgttttacggggacctaggactttaccgaactttccgtacgtacttcctaacgttaccgaaccgtaacgggtaaccgttaggggaacccggtaaccccggtaaaggttaacgtttttcggaccgtaggttagtttaacgtttaccgtggttacctaggttcgttttacgggttttcgggtacccctttccttcccgttaccgttaacttccggttactttccggttttacggttcccggttacgggttccggttaccggtacggttcgggtacgtacgtacggtacggacgtacgtaggttcggtcggtacaccgtacgcttaccgg

SEQ ID NO: 157602 - DNA, 617 bp, Homo sapiens
  misc_feature: GYAE6OF01CG19Y.24.78.H01.1.454.CMB.1.raw
  modified_base (173)..(173): a, c, t, g, unknown or other
  misc_feature (173)..(173): n is a, c, g, or t
  modified_base (286)..(286): a, c, t, g, unknown or other
  misc_feature (286)..(286): n is a, c, g, or t
  modified_base (305)..(305): a, c, t, g, unknown or other
  misc_feature (305)..(305): n is a, c, g, or t
  modified_base (340)..(340): a, c, t, g, unknown or other
  misc_feature (340)..(340): n is a, c, g, or t
tcagactactatgtcacgaccggtgctcgatttagtgtgagtagtttgggtttggggagaggagcccagcactagaagtcggcggtgtttccattcggtgatcagcactgaacacagaggactcaccatggagtttgggctgagctgggttttcctcgtcgcttcttttaagnggtgtccagtgtcgaggggcagctggtggagtcgtgggggcgcgtggtccaaccgtggggacgtccctgagctctcctgtcgccggcctcccgattccaccttcaatacttanggcatgcacgtcgggtccnccaggcctccgaggcgaaggggctgggagtggggngccgctattcttattgatggaaatatactaattatatgacagtacgtcggtaggaaccgggtccgttaccacctattcctacgagacgaactaacttacccaaactaacttactacttcgtttctacgtactaaagtcgtactacgcctacgcgtatcgtagacggacgacgtctagtctagttactgtacgtacgtaacgtccgttaccccgtcctttccgttaacgtacgtttacggttcgggtacccgtaccccctacgtcggtcggtaccggg

SEQ ID NO: 157603 - DNA, 593 bp, Homo sapiens
  misc_feature: GYAE6OF01D9YE0.24.78.H01.1.454.CMB.1.raw
  modified_base (295)..(295): a, c, t, g, unknown or other
  misc_feature (295)..(295): n is a, c, g, or t
  modified_base (334)..(334): a, c, t, g, unknown or other
  misc_feature (334)..(334): n is a, c, g, or t
  modified_base (392)..(392): a, c, t, g, unknown or other
  misc_feature (392)..(392): n is a, c, g, or t
tcagactactatgtcacgaccggtgctcgatttagtgtgagtagtttgggtttgggggaggagcccagcactagaagtcggcggtgtttccattcggtgatcagcactgaacacagaggactcaccatggagtttgggctgagctgggttttcctcgtcgctcttttaagaggtgtccagtgtcaggggcagctggtggagtctgggggcgcgtggtccaaccgtgggacgtccctgagactctcctgtgcggcctccgattcaccttcaatacttatggcatgcactgggtccnccaggctccgaggcgaaggggctgggagtggggtgccgntatcttattgatggaatatcaattatatgcagtactccggtagaacgggtcccgttanaccctatccgtaccagagaacctaacttaccaaactaattacctcttcgtttctgactaatcgactagcctgcgtatcgtagaggacacggtctgtacttattacgtgtacgacgtaaagtcccgttccccggtcctttacgttaaccgttagttacgttcggggtcccgtacccccttagtacgttgggtccggtacggg

SEQ ID NO: 157604 - DNA, 658 bp, Homo sapiens
  misc_feature: GYAE6OF01B3EMJ.24.78.H01.1.454.CMB.1.raw
tcagactactatgtcacgaccggtgctcgatttagtgtgagtagtttgggtttggggagaggagcccagcactagaagtcggcggtgtttccattcggtgatcagcactgaacacagaggactcaccatggagtttgggctgagctgggttttcctcgtcgctcttttaagaggtgtccagtgtcaggggcagctggtggagtcgtgggggcggcgtggtccaaccgtgggaggtccctgagactctcctgtgcggcctcccgattcaccttcaatacttatggcatcgcacgtcgggtccgccaggctccgaggcgaaggggctgggaggtggggtcggccgctatcttattgatggaaatatacaattattactgacagtaccgtccggtaggaaacggggtcccgttacaaccctattcctaccaagacgaactaacttacccaaactaaacttaccttacttcgtttctacgtaacaaacgtagtacctacgcctgacgtatacgtacggaacggtaccgacggtcgttacgtcgttaacttacgtgtacggtaccggtaaacgtaccgttaccccgggtccctttaccgttaccgttaggtttacggttacgggggttaccgtacccccgtacgtacgttacgggtacccggg

SEQ ID NO: 157605 - DNA, 585 bp, Homo sapiens
  misc_feature: GYAE6OF01DN0QJ.24.78.H01.1.454.CMB.1.raw
  modified_base (164)..(164): a, c, t, g, unknown or other
  misc_feature (164)..(164): n is a, c, g, or t
  modified_base (201)..(201): a, c, t, g, unknown or other
  misc_feature (201)..(201): n is a, c, g, or t
  modified_base (248)..(248): a, c, t, g, unknown or other
  misc_feature (248)..(248): n is a, c, g, or t
  modified_base (259)..(259): a, c, t, g, unknown or other
  misc_feature (259)..(259): n is a, c, g, or t
  modified_base (274)..(274): a, c, t, g, unknown or other
  misc_feature (274)..(274): n is a, c, g, or t
  modified_base (279)..(279): a, c, t, g, unknown or other
  misc_feature (279)..(279): n is a, c, g, or t
tcagactactatgtcacgaccggtgctcgatttagtgtgagtagtttgggtttggggagagctgctcagttaggacccagagggaaccatggaagccccagctcagcttctcttcctcctgctactctggctcccagatgccaccggagacattgtgttgacanagtctccagccacctgtctttgtctccgaggggaaanagccaccctctcctgcagggccagtgacatgtagagttgtagctgancaacacaaacntgccaggctcccggntcctnatctatgatgcatccaagtggccatgcatcccagacaggttcagtggcagtggtctgggacagactcactctcacatcagcagtgtagagcctgaaagtatttgacttagtttattactggtcagcctaccgtgaacctaagtccggtacccctacgtttccgggaccccgttagggggaccctaggtaaccttacgggaaccctaacgttaaccccgaaaaccggtaaaccgttcgggttaggtaccccgtaggtaacccctaaccctaacgttacccttacggtttaccctttccttaaacccg

SEQ ID NO: 157606 - DNA, 635 bp, Homo sapiens
  misc_feature: GYAE6OF01ATARU.24.78.H01.1.454.CMB.1.raw
  modified_base (239)..(239): a, c, t, g, unknown or other
  misc_feature (239)..(239): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaacccagcgcagcttctcttcctcctgctactctggctcccagccatcaccggaggaattgtgttgacgcagtctccaggcaccctgtctttgtctccagggganagagcccacctctcctgcgagggccagtcagagtgttagcagcagctacttagcctggtaccagcagaaacctggacctggcctccgagctcctcatctatggtcgcgtccacgcggaccacgtcggcgtcggcggactacggttcaggtcggactagtgggtctttggggactacgacctttcgacttacgtcactactacgtacgaacacgtaacgtcgggaccgtacccggtaagttaacgttttcggacgttaacggttcgttaacgtttacgtgttaccgtaacgtcgtttcgtttcgggtaccccttccgttcccttacccttacgttacgttaccgtttaaccggttttcgggtacccgttaggggtttccctaagggtcgttaacggg

SEQ ID NO: 157607 - DNA, 631 bp, Homo sapiens
  misc_feature: GYAE6OF01EDTUK.24.78.H01.1.454.CMB.1.raw
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggccaccctgtctttgtctccgaggggagagacgccaccctctcctgcagggccagtcagagtgttagcagcagctacttagcctggtaccagcaagaaccctggcctggcctcccgaggcctcctcatcctagtcggtcgccgtcccaccgagggccctacgtcgggccgtcggacggacgtacggttcgaggttcggacgtaggtcggtcgtttacgggactacggtacttcgacttctcactcatcgacacgacgtacggacgacccgtaaagttacgtttcgacgtaggttacgttaacgtttacgtgtactagttccgttggttttccggttccccgttccttcccgttaccttacgttcgttaccttaccgttttcgggacccgttacgggtttcccgtagggtcgtacggg

SEQ ID NO: 157608 - DNA, 559 bp, Homo sapiens
  misc_feature: GYAE6OF01BCGAM.24.78.H01.1.454.CMB.1.raw
  modified_base (516)..(516): a, c, t, g, unknown or other
  misc_feature (516)..(516): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgtctccaggggagagagccaccctctcctgcagggccagtcagagtgttagcagcagctacttagcctggtaccagcagaacctggcctggctccaggctcctcatctatggtcgccgtccaccgacgggccacgtcggcgtcgcggacaggttcaggtcggactaggtcggtcgtttggggactacggtacttcactcgtcatctactcgacagacgtggacgtccgaagtctttgcgtagttagtacttacgtgtcgagtcttcggtttcgtccctctcccttcttntcgttaccttacgtttcggaccttagggtcctggtcgtacggg

SEQ ID NO: 157609 - DNA, 592 bp, Homo sapiens
  misc_feature: GYAE6OF01ES5N6.24.78.H01.1.454.CMB.1.raw
  modified_base (241)..(241): a, c, t, g, unknown or other
  misc_feature (241)..(241): n is a, c, g, or t
  modified_base (253)..(253): a, c, t, g, unknown or other
  misc_feature (253)..(253): n is a, c, g, or t
  modified_base (323)..(323): a, c, t, g, unknown or other
  misc_feature (323)..(323): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgtctccgagggganagagcccacctntcctgcagggccagtcagagtgtagcagcagctactgctgtaccagcagaacctggcctgctccagctcncatctatggtcgtcgtccaccgacggccacgtcggcgtcgcggactaggtcagtggactaggtcgtcgttgggacaggtaccttcactcgtccacgtcagcacgtcctaaggcgtccgtagacgttacgtttcggtacgtttactacgtcggtacacgcgtacgtccgttaccgccgtacgggcccgttacggttaacggttccgggggacccgggggtaacgacgggggttacgggacggtaagggacgggtaccggtaggttacggg

SEQ ID NO: 157610 - DNA, 627 bp, Homo sapiens
  misc_feature: GYAE6OF01CFKBX.24.78.H01.1.454.CMB.1.raw
  modified_base (177)..(177): a, c, t, g, unknown or other
  misc_feature (177)..(177): n is a, c, g, or t
  modified_base (295)..(295): a, c, t, g, unknown or other
  misc_feature (295)..(295): n is a, c, g, or t
tcagactactatgtcacgaccggtgctcgatttagtgtgagtagtttgggtttggggagaggagcccagcactagaagtcggcggtgtttccattcggtgatcagcactgaacacagaggactcaccatggagtttgggctgagcttgggttttcctcgtcgctcttttaagaggtntccagtgtcgagggcagctggtggagtcgtggggcgcgtggtccaacgtgggacgtcctgagactctcctgtgcgcctccgattccacttcaatacttatgacatgcacgtgggtccncaggcctcgaggcgaggggctggacggtgggtcgaccgtctagtcttattgatggaaatatcaattatatgactagacgtcggagtaacgggtccgttacaaccgtactcctaccgaagtacgaacctaaacttacccaaactaacttaccgttactttacgttttccagtaacctaaagtcgtaacctacgccgtacgacggattccgtaggacgtaccgacggtctagtctaagttcgtgtacgacgtaaacgtccgtttacccccggactttcgttaacggtagtttacggttcggggtacccctacccctaagtcgtcgggtaaccgg

SEQ ID NO: 157611 - DNA, 828 bp, Homo sapiens
  misc_feature: GYAE6OF01CVNIF.24.78.H01.1.454.CMB.1.raw
  modified_base (242)..(242): a, c, t, g, unknown or other
  misc_feature (242)..(242): n is a, c, g, or t
tcagactactatgtcacgaccggtgctcgatttagtgtgagtagtttgggtttggcacgaccggtgctcgatttagtgtgagtagtttgggttggggagagctgctcagttaggacccagagggaaccatggaaaccccagcgcagcttctcttcctcctgctactctggctcccagccatcaccggaggtaattgtgttgacgcagtctccaggccaccctgtctttgtctccgagggganagacgcccacctctcctgcacgggccagtcagagtgttagcagcagctacttagcctaggaccagacaacgaaacctggcctggcctcccgagtcctcctcatctatcggtcgccgtaccacgacgggccacggtgggccgtcggccggtaacgtacggtttacgaaggtcggacgtacggttacgggtaccggttttacgggggtaaccgtaacggttaacccgtttaccgtaaccgtttaccgttacccgtaacttacccgtaacgttacccggaaccgtaacggtaaccggttacgggtaacccgggtaaccccgggtaaaacggtttacgtttttacggtaccgttaaggtttacggtttaaacgttttaaccgtttacgggttacccgttaaaccgggtttccgtttacccgggttttttcccgggttacccccgttttacccgtttacccccgttttaacccggttttaaccggtttaacccggttttaaaccgttttaccccgggttttttacccgggggttaccccgggtttaaccgggggttttaccccggtaacgggggtttccgttaaaccgggg

SEQ ID NO: 157612 - DNA, 735 bp, Homo sapiens
  misc_feature: GYAE6OF01CR0VK.24.78.H01.1.454.CMB.1.raw
  modified_base (208)..(208): a, c, t, g, unknown or other
  misc_feature (208)..(208): n is a, c, g, or t
  modified_base (463)..(463): a, c, t, g, unknown or other
  misc_feature (463)..(463): n is a, c, g, or t
  modified_base (609)..(609): a, c, t, g, unknown or other
  misc_feature (609)..(609): n is a, c, g, or t
  modified_base (716)..(716): a, c, t, g, unknown or other
  misc_feature (716)..(716): n is a, c, g, or t
tcagactactatgtcacgaccggtgctcgatttagtgtgagtagtttgggtttggcacgaccggtgctcgatttagtgtgagtagtttgggttgggagagctgctcagttaggacccagaggaaccatcggaaacccagcgcagcttctcttcctcctgctactctcggctcccagccatcaccggaggaattgtgttgacgcagtcncagcacctgtcttgactcgagggggatagacgcccacccttctcccgtggacgacgggcccaaggttcaaggagttggttaagcgaacgcgaagtccttaaacgttcggtccgttacgggaacccaggaccaacggtaaacccgttgggcccttacgggcctaccgaggtccctaccgttcaagttcctagtcggtcgacccgtcaaccggcggtcctaacgtcgggacgttccggacggtacgtacggtttacncggttaggccgtaggtcggtacgtttacgggacgacggtactttacctaacgttcctacacttaccagtacccgagaacggtcgtagggaacccgtaccggttaaattagttttaccgacggttaagttaggttacgtttaaccgngtttaaccgacgttttccgtggtttcccggttccttccgtacctttacccttaggttaccgttaccgttttaaccggtttccgggtaaacccttccggggtttaccngggtttcccggttaaaggg

SEQ ID NO: 157613 - DNA, 618 bp, Homo sapiens
  misc_feature: GYAE6OF01BUGDG.24.78.H01.1.454.CMB.1.raw
  modified_base (241)..(241): a, c, t, g, unknown or other
  misc_feature (241)..(241): n is a, c, g, or t
tcagactactatgtcacgaccggtgctcgatttagtgtgagtagtttgggtttgggcacgaccggtgctcgatttagtgtgagtagtttgggtttggggagagctgctcagttaggacccagagggaaccatggaaaccccagcgcagcttctcttcctcctgctactctggcctcccagccatcaccggaggaattgtgttgacgcagtctccaggcaccctgtctttgctccagggganagagccacctctcctgcagggccagtcagagtgttagcagcagcacttttttacgcctcggtaccagcagaacctggcctcggcctcccagcctcctcgactctacgtgtgtcgtccgacgacggctacgtcggcgtcggacggacgtacggtcgacggtcgacgagtcggtcgtttgggactagtaccttcgtacgttctacgtactcgtacgtaccgtacgacggtacgtaggaaccgtaccggtaagttacgtttacggacgtaagttacgttacttacgttagtacgtagttccgttggtttccggtcccttcgttcctaccgttattacgttacttacgtttcggaccgtacgggaacctaacgtggtaacg

SEQ ID NO: 157614 - DNA, 611 bp, Homo sapiens
  misc_feature: GYAE6OF01BHLPL.24.78.H01.1.454.CMB.1.raw
  modified_base (269)..(269): a, c, t, g, unknown or other
  misc_feature (269)..(269): n is a, c, g, or t
  modified_base (293)..(293): a, c, t, g, unknown or other
  misc_feature (293)..(293): n is a, c, g, or t
  modified_base (331)..(331): a, c, t, g, unknown or other
  misc_feature (331)..(331): n is a, c, g, or t
  modified_base (598)..(598): a, c, t, g, unknown or other
  misc_feature (598)..(598): n is a, c, g, or t
tcagactactatgtcacgaccggtgctcgatttagtgtgagtagtttgggtttggggagaggagcccagcactagaagtcggcggtgtttccattcggtgatcagcactgaacacagagactcaccatggagtttgggctgagcttgggttttcctcgtcgcttcttttaagaggtgtccagtgtcgaggggcagctggtggagtcgtgggggcgcgtggtcccaacgtgggagtccctgagctctctgtgccgcctccgatcaccttnaatcttatgcatgcagtcggtccncaggctccgaggcgaggggctgggagtgggtcgccgtntattctttattggatagggtaaagttaactcgtaaattagttatacgataacggtaccttcgggtaggaaacggggtcccgttacacctagtcctaccagacgaactaacttaccaaactaacttactcttagtttactagtactaaatcgtactacgtactgacgtatcgtagacgtacgacgtctagtacttatagtgacgtaaccgtaacgtcccgttccccgacctttcgtaccgttagttacggtcgggtaccctaccctancggtggtacccgg

SEQ ID NO: 157615 - DNA, 575 bp, Homo sapiens
  misc_feature: GYAE6OF01B2ABJ.24.78.H01.1.454.CMB.1.raw
tcagactactatgtcacgaccggtgctcgatttagtgtgagtagtttgggtttggggagagctgctcagttaggacccagagggaaccatggaaacccagcgcagcttctcttcctcctgctactctggctcccagccatcaccggaggaattgtgtgacgcagtctcaggcaccctgtctttgtctccgaggggagagacgccaccctctcctgcacggcagtcagagtgtagcagcagctactagcctggtaccagcaagaacctggcctggcctccaggcctcctcatctagtggtcgctccgacgagggccacgtggcgtcgacggacaggttcaggtgactaggtcggtacgttgggaactaggtacttcacgtctacatcaatcgaacagacgtaggaccgaccggtaattagtttcgacgtagttaggttaattaccgtgtaccgagttgtttcgttcggtccctaccgttcctacttatcgtacttacgtttcggccgtagggttccgaggtcttagggactatacgaacgcgtaaacgttggtcgtcaggacctaccgtgttaccg

SEQ ID NO: 157616 - DNA, 651 bp, Homo sapiens
  misc_feature: GYAE6OF01BLHNC.24.78.H01.1.454.CMB.1.raw
  modified_base (199)..(199): a, c, t, g, unknown or other
  misc_feature (199)..(199): n is a, c, g, or t
tcagactactatgtcacgaccggtgctcgatttagtgtgagtagtttgggtttggggagagctgctcagttaggacccagagggaaccatggaaaccccagcgcagcttctcttcctcctgctactctggctcccagccatcaccggaggattgtgttgacgcagtctccaggcaccctgtctttgtctccgagggganagagccaccctctcctgcagggccagtcagagtgttagcagcagctacttagcctggtaccagcaagaaacctggcctggcctcccgaggcctcctcatctagtcggtcgccgtaccaccgacgggcccacgttcggccggttccggccgggtaacagggtttccaaggttcgggcgtacgggttgggtcgttttggggaactaggtacctttccgacgttcctacattccgtaatcgaaccgtacggacgtacgggacgaccccggtaaagtacgttttggacgtagttagttatttacgtgtactagtcgttgtttcggtccttccttccgttccttagtcgttacttacgttttcggccgtacgggttccgtagggtccgttcggtaggtatacggtaacggtaccgtaacgttcgggtacggtacgttacgccgtaccgtcgttaccg

SEQ ID NO: 157617 - DNA, 597 bp, Homo sapiens
  misc_feature: GYAE6OF01B6I6A.24.78.H01.1.454.CMB.1.raw
  modified_base (300)..(300): a, c, t, g, unknown or other
  misc_feature (300)..(300): n is a, c, g, or t
  modified_base (336)..(336): a, c, t, g, unknown or other
  misc_feature (336)..(336): n is a, c, g, or t
  modified_base (357)..(357): a, c, t, g, unknown or other
  misc_feature (357)..(357): n is a, c, g, or t
  modified_base (363)..(363): a, c, t, g, unknown or other
  misc_feature (363)..(363): n is a, c, g, or t
tcagactactatgtcacgaccggtgctcgatttagtgtgagtagtttgggtttggggagaggagcccagcactagaagtcggcggtgtttccattcggtgatcagcactgaacacagaggactcaccatggagtttgggctgagctgggttttcctcgtcgctcttttaagaggtgtccagtgtcaggggcagctggtggagtcgtgggggcggcgtggtccaaccgtggggaggtccctgagactctcctgtgcggcctccgattccaccttcaatacttatggcatgcactgggtccncaggcctccgaggcaaggggctggagtgggtgccgntatcttattgatggaagtatnaaattntatgcagactcgtgaacgggccgttcaccatcaccgagagacaacttaccaaacaatactctgtttctgactaaatcgactacgtcctagctatacgtaggacggaacgtacggtcttgtacttaacgttacgtgtacggacgtaaacgttcccgttcccccggtaccctttaccgttacgttaacgtttaggttccggggtaccgtaccccctacgtcggtacggtacccggg

SEQ ID NO: 157618 - DNA, 748 bp, Homo sapiens
  misc_feature: GYAE6OF01DQPCE.24.78.H01.1.454.CMB.1.raw
  modified_base (239)..(239): a, c, t, g, unknown or other
  misc_feature (239)..(239): n is a, c, g, or t
  modified_base (252)..(252): a, c, t, g, unknown or other
  misc_feature (252)..(252): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggcctcccagccatcaccggaggaattgtgttgacgcagtctccaggccacctgtctttgctcgaggganagacgccacctcncctgcgagggccagtcagagtgttagcagcagtctacttacgcctaggtaaccagtacaacgaaacccgtggccgtacggcctacccgacggtcctccgtacattccgtagtcggtcgccgtaccaccggacggacccacgtcggacgtcggacgacgtaggttcaaggtcggacgtaggtcggtacgtttcggggactacggtacttacgaccgttctactactacaactccgaacgtacggtaccggtacggtaaccggaaccccgtaaaggtttacgtttttacggaccgttaaggtttacgtttaaacgtttacccgttaggtacccgttaaggttcccgtttacgggtttttaccccggttccccccgtttccgtttacccccttaccggtttaacgttacccgggtttaaacccttttaccgggtttttacccgggaaccccgggttttaccggggttaccccgttaaggggttcccgttaaaccggggg

SEQ ID NO: 157619 - DNA, 705 bp, Homo sapiens
  misc_feature: GYAE6OF01EKJEU.24.78.H01.1.454.CMB.1.raw
tcagactactatgtcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtcttgtctcgaggggagagacgccaccctctcctgcagggccagtcagagtgttagcagcagctacttagcctaggtaccagacgaacgaaccgtgccgtggcctaccgacggtcctccgtactattccgttagttcgggtcgacccgttacccgaaccggtacgggaccctaacgtcgggaccggtccggaccgggtaccgtaggttccgaaggtcgggacgtagggttggtccgtttagggactaggtacctttcacgttctagtactcactcgaacgtagacgtacggacgacccgtaagttaatttcgacgtagtagttaacgttcgttagtcgtacgtcgtttcgttccgttcccttcgttcccttaccgttagttacgtttaccgttacgttttacgggacccggtttacgggttaccgtacgggttacggttacgggtaaccgttaaggaccgtaaacggtaccgtaaaggttcgggttacggacccgttaccggtaccgtaacgtccgtttaccgg

SEQ ID NO: 157620 - DNA, 267 bp, Homo sapiens
  misc_feature: GYAE6OF01B55UW.24.78.H01.1.454.CMB.1.raw
  modified_base (261)..(267): a, c, t, g, unknown or other
  misc_feature (261)..(267): n is a, c, g, or t
tcagactactatgtcacgaccggtgctcgatttagtgtgagtagttgggtttgggacagacttcactctcatcatcgacagactggagcccgaagatttgcagtgtattactgtcagctgtttggtccctctcctcctatgtactacttttggccagggttccaggctggagatcaagcgaactgtggctgcaccatctgtcttcatccttccgcatctagaacatagtagtctgaggcggctggacaaggcgactagagnnnnnnn

SEQ ID NO: 157621 - DNA, 640 bp, Homo sapiens
  misc_feature: GYAE6OF01E580Y.24.78.H01.1.454.CMB.1.raw
tcagactactatgtcacgaccggtgctcgatttagtgtgagtagtttgggtttggggagaggagcccagcactagaagtcggcggtgtttccattcggtgatcagcactgaacacagaggactcaccatggagtttgggctgagctgggttttcctcgtcgctcttttaagaggtgtccagtgtcaggggcagctggtggagtctgggggcgcgtggtccaacctgggagtccctgagactctcctgtcgccggcctcccgattcaccttcaatacttatggcatgcacgtgggtcccgcaggctccgaggccaagggggctgggagtggggtcgccgtctattctttagttgagtaggaataatcaaattattatgcaagtacctccggtaggaacgggtcccgttacacctatcctcagaacgactaacttccaaactaattacctcttacgtttctagactaaagtgacctacgtccctgaccgtatcgtaggacggtaacgaccggtcttacgttacttaagtttacgtacggtacggaaccgtaaaccggtcccgtttccccccgggtacctttaccgttaacggtagtttacggttcgggggtacccgtaccccctacgtagtcgggtaccggg

SEQ ID NO: 157622 - DNA, 614 bp, Homo sapiens
  misc_feature: GYAE6OF01BZJLO.24.78.H01.1.454.CMB.1.raw
  modified_base (241)..(241): a, c, t, g, unknown or other
  misc_feature (241)..(241): n is a, c, g, or t
  modified_base (572)..(572): a, c, t, g, unknown or other
  misc_feature (572)..(572): n is a, c, g, or t
tcagactactatgtcacgaccggtgctcgatttagtgtgagtagtttgggtttggcacgaccggtgctcgatttagtgtgagtagtttgggtttgggggaggaactgctcagttaggacccagagggaaccatggaagccccagctcagcttctcttcctcctgctactctggctcccagagaccaccggagaaattgtgttgacacagtctccaggcaccctgtctttgctccagggganagacgccaccctctcctgccaggccagccggagtgttagtaagtacttaggctggtaccaacagaaacctggaccaggctacccgaggctccgtcattctatgactgtcctaccaacgtacgggtcacgttcgggccgtcccccgcgtaaggttcaggtcggctaggtcgggtactgggacaggtacttcgactcgtcaccgtcacgcacgcctagcgccgtagtaagtagtttgtacggtttactacgttgtcagtcgagtccgttaccgccttcgggccgtacgttaccgtttcggggccgggggtacctagggggtcgaaggacgggnggtaaccggacgttcggtacggctaggcctaccgattcccgg

SEQ ID NO: 157623 - DNA, 584 bp, Homo sapiens
  misc_feature: GYAE6OF01BW2C9.24.78.H01.1.454.CMB.1.raw
  modified_base (541)..(541): a, c, t, g, unknown or other
  misc_feature (541)..(541): n is a, c, g, or t
tcagactactatgtcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgtctccgaggggagagacgcccaccctctcctgcagggccagtcagagtgttagcagcagctacttagcctggtaccagcagaaacctggcctggcctcccaggcctcctcatctatggtgccgtccaccgacgggccacgtcgggcgtcggcggacgtacggttcgaggtcggcgaggtggtcgtttgggactagtacttcgacttctcactcatcgacgagacgtggacgacccgtaagtatttgactagtgttattactgtctagtcgttgtttcgtcccttcgttcccttaccttacgttcgttaccttcgtttacggcccgtagggttccacgggtcgtagggtacgtanacggtacgacgtaacgtcggtcggctacgcctaccgtgttccg

SEQ ID NO: 157624 - DNA, 612 bp, Homo sapiens
  misc_feature: GYAE6OF01C1S86.24.78.H01.1.454.CMB.1.raw
  modified_base (490)..(490): a, c, t, g, unknown or other
  misc_feature (490)..(490): n is a, c, g, or t
  modified_base (600)..(600): a, c, t, g, unknown or other
  misc_feature (600)..(600): n is a, c, g, or t
tcagactactatgtcacgaccggtgctcgatttagtgtgagtagtttgggtttggcacgaccggtgctcgatttagtgtgagtagtttgggttggggagagctgctcagttaggacccagagggaaccatggaaacccagcgcagcttctcttcctcctgctactctggctcccagccatcaccggaggaattgtgttgacgcagtctccaggccaccctgttctttgtcctccgagggggagagacgcccaccctctccgtgcagggccagtcagtagtgttagcagcagctaactagcctggtaccagtacacgaaacctggcctggcctcccaggtcctcctcactctagtcggtcgccgtacccacgacgggccctacgtcgggccgtccggcggtactacgggtttcaggtcgggctacgggtcggtcgttgggacaggtaccttcgactcgtcatctagcgagcgacgtgacgtaccgaagttntttacgacgtagttcgttacttacgtcgtcgtagtccgttcgtttccggttccccttcgtcccttacgttacgttccgttacttacgtttccggtacgttacgggttccngggtcgtacggg

SEQ ID NO: 157625 - DNA, 592 bp, Homo sapiens
  misc_feature: GYAE6OF01AVE8R.24.78.H01.1.454.CMB.1.raw
  modified_base (301)..(301): a, c, t, g, unknown or other
  misc_feature (301)..(301): n is a, c, g, or t
  modified_base (578)..(578): a, c, t, g, unknown or other
  misc_feature (578)..(578): n is a, c, g, or t
tcagactactatgtcacgaccggtgctcgatttagtgtgagtagtttgggtttggggagaggagcccagcactagaagtcggcggtgtttccattcggtgatcagcactgaacacagaggactcaccatggagtttgggctgagcttggggttttcctcgtcgctcttttaagaggtgtccagtgtcaggggcagctggtggagtctgggggcggcgtggtccaacctgggaggtccctgagactctcctggtgcggcctccgattccaccttcaatacttatggcatgcacgtgggtccncaggctccgaggcaaggggctgggagtggggtcgccgctatcgtttattcgatggtaagtaatcaaattattaatgacagacctcgtaggaaacggggtccggttacacctatcctaccgagagaactaacttccaaacaactactcttgtttactagactaaatcgactacgctcgcgtatctagagacgacgtcttgtacttattactggtcgacgaaagtaccgttccccggtaccttcttaccgtatttacggttcggggtaccgaccccctntacgtcggtaccgg

SEQ ID NO: 157626 - DNA, 681 bp, Homo sapiens
  misc_feature: GYAE6OF01CYFVJ.24.78.H01.1.454.CMB.1.raw
  modified_base (209)..(209): a, c, t, g, unknown or other
  misc_feature (209)..(209): n is a, c, g, or t
  modified_base (237)..(237): a, c, t, g, unknown or other
  misc_feature (237)..(237): n is a, c, g, or t
tcagactactatgtcacgaccggtgctcgatttagtgtgagtagtttgggtttggcacgaccggtgctcgatttagtgtgagtagtttgggttgggagagctgctcagttaggacccagagggaaccatcggaaaccccagcgcagcttctcttcctcctgctactctggctcccagccatcaccggagtaattgtgttgacgcagtcnccaggcctacctgtcttgctcgaggganagacgcccaccgtctccgagcgtacgggccaagtcaggtagtagttagcacgctagtcctacttcgccttaggtaccagcacgaaccgtcggacctacgctacccgagtcctcgtacacgtctagtcggtcgtaccgtacccgaacggtcggtcctacgtcgggtaccgtacgacggaaccgtaggttcgaaggtcggacgtacggtcggtacgtttacggggactacgtacttacgtacgttctacgacttacgtacgtacgtacgtaccggtacgtacggtaccgtaccgtaagttacgtttcggacgtacgttacgttacgttacgtcgtacgtacgttccgttacggtttccggtacccttccgttaccgttaccgttagttaccgttaaccgttacggtttccggaacccgttacgggtttacccgtggtcgttaacgg

SEQ ID NO: 157627 - DNA, 685 bp, Homo sapiens
  misc_feature: GYAE6OF01EDKRV.24.78.H01.1.454.CMB.1.raw
  modified_base (178)..(178): a, c, t, g, unknown or other
  misc_feature (178)..(178): n is a, c, g, or t
  modified_base (312)..(312): a, c, t, g, unknown or other
  misc_feature (312)..(312): n is a, c, g, or t
tcagactactatgtcacgaccggtgctcgatttagtgtgagtagtttgggtttggggagaggagcccagcactagaagtcggcggtgtttccattcggtgatcagcactgaacacagaggactcaccatggagtttgggctgagcttgggttttcctcgtcgcttcttttaagaggtntccagtgtcaggggcagctggtggagtcgtgggggcgcgtggtccaaccgtgggacgtccctgacgacctctcctggtcgccggcctccggattcgaccttcaattacttatggcattgctacgtcgggtcccnccgaggtcctaccgagggtcgaagggggtctagggacggtggggtcgccgtcttagtctttagttggataggaaagttatcgaaattattactgactacgtacctcgggtacggaacgggttcccgttacaaccttacgtccgtaccgaagtaacgaactaacttaacccaaactaattaccttcgttacgtttactacgtactaagtacgtactacgtccgtgacgtacgtcgtagacggtaccgacggtacttagtacttagtacgtagtacgtaacggtaaccgttccgttacccccggttacctttaccgttaacgtacgtttaccgggtttcgggtacccgtaccccgttagtacgtgggtacccggg

SEQ ID NO: 157628 - DNA, 720 bp, Homo sapiens
  misc_feature: GYAE6OF01EMTV6.24.78.H01.1.454.CMB.1.raw
  modified_base (239)..(239): a, c, t, g, unknown or other
  misc_feature (239)..(239): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggctcccagccatcaccggaggtattgtgttgacgcagtctccaggcaccctgtcttgctccgagggganagacgcccaccctctcctgccagggccagtcagagtgttagcagcagtctacttacgccgtagtaccagacaagaacctggaccctggcctaccgaggtcctccgtactatcctagtggtcgccgtaccaccgacggccacgtcggcgtcggacggacgtaggttcaggtcggacgaggtcggtacgtttagggactaagtaccgttcacttcgtacacgttaccaagttaccggaacaggtaccgtagggaaccgaccccgtaaagtttacgtttcggaccgttaagtttacgttaactttaccgtacggttaccgtacggttcccggttttacgggttttacccgggttacccccctttccgtttacccccgtttaacgtttaaaccggtttaccggtttaaaccccgtttaaccgggttttttcccgggacccggtttaaccggggtttaccccgtagggttcccgtttaaacggggg

SEQ ID NO: 157629 - DNA, 559 bp, Homo sapiens
  misc_feature: GYAE6OF01DIC9X.24.78.H01.1.454.CMB.1.raw
  modified_base (203)..(203): a, c, t, g, unknown or other
  misc_feature (203)..(203): n is a, c, g, or t
  modified_base (423)..(423): a, c, t, g, unknown or other
  misc_feature (423)..(423): n is a, c, g, or t
  modified_base (438)..(438): a, c, t, g, unknown or other
  misc_feature (438)..(438): n is a, c, g, or t
tcagactactatgtcacgaccggtgctcgatttagtgtgagtagtttgggtttgggggaggaactgctcagttaggacccagagggaaccatggaagccccagctcagcttctcttcctcctgctactctggctcccagccatcaccggaggtaattgtgttgacgcagtctccaggcaccctgtctttgtctccgagggganagacgccaccctctccgtgcagggccagtcagagtgttagcagcagctacttagcctggtaccagcaagaaacctgcctggcctccaggctcctcatctatggtcgccgtccaccgacggcctacgtcggcgtccgcggacgaggttccgagtgcgagtggcgtttggacagtctcactctacatcatcgacagacgtcggacgaccgtaagttatttgntacgttgtattactntacgagtcgttgtttcgtcccttcgttcctcttatcgttactactttggacctgggttccagggtctaggacgtactacgtaacggacgtaaagtggtcggtactggacctacgtagttcg

SEQ ID NO: 157630 - DNA, 548 bp, Homo sapiens
  misc_feature: GYAE6OF01DHVGV.24.78.H01.1.454.CMB.1.raw
  modified_base (139)..(139): a, c, t, g, unknown or other
  misc_feature (139)..(139): n is a, c, g, or t
  modified_base (187)..(187): a, c, t, g, unknown or other
  misc_feature (187)..(187): n is a, c, g, or t
  modified_base (194)..(194): a, c, t, g, unknown or other
  misc_feature (194)..(194): n is a, c, g, or t
  modified_base (235)..(235): a, c, t, g, unknown or other
  misc_feature (235)..(235): n is a, c, g, or t
  modified_base (438)..(438): a, c, t, g, unknown or other
  misc_feature (438)..(438): n is a, c, g, or t
  modified_base (443)..(443): a, c, t, g, unknown or other
  misc_feature (443)..(443): n is a, c, g, or t
  modified_base (457)..(457): a, c, t, g, unknown or other
  misc_feature (457)..(457): n is a, c, g, or t
  modified_base (464)..(464): a, c, t, g, unknown or other
  misc_feature (464)..(464): n is a, c, g, or t
  modified_base (506)..(506): a, c, t, g, unknown or other
  misc_feature (506)..(506): n is a, c, g, or t
  modified_base (539)..(539): a, c, t, g, unknown or other
  misc_feature (539)..(539): n is a, c, g, or t
tcagactactatgtcacgaccggtgctcgatttagtgtgagtagtttgggtttggcacgaccggtgctcgatttagtgtgagtagtttgggttggggagagctgctcagttaggacccagaggaaccatggaaaccccngcgcagcttctcttcctcctgctactctggctcccagccatcaccggngaattgngttgacgcagtctccaggccacctgtcttgtctcagggganagacgccacctctacctgcagggccagtcagagtgttagcagcagctactagcctggtaccagcagaaacctggacctggctcccgaggtcctccgtcactctagtcggtgcgtcctaccgacgggccaacgtggcgtcgcggacgtggttcaggtcggacaggttggcgtttagggacagacttcactctcagtcactcgangtacnggagcccgtaagtntttacgntagtatacttagtcgtcaggtctgtttcgccgttctcctctnttacgttactacgttttcggacttagggttccnggtgtacgg

SEQ ID NO: 157631 - DNA, 609 bp, Homo sapiens
  misc_feature: GYAE6OF01DJWOS.24.78.H01.1.454.CMB.1.raw
  modified_base (200)..(200): a, c, t, g, unknown or other
  misc_feature (200)..(200): n is a, c, g, or t
  modified_base (338)..(338): a, c, t, g, unknown or other
  misc_feature (338)..(338): n is a, c, g, or t
  modified_base (602)..(602): a, c, t, g, unknown or other
  misc_feature (602)..(602): n is a, c, g, or t
tcagactactatgtcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgtctccgagggganagagccaccctctcctgcagggccagtcagagtgttagcagcagctacttagctggtaccagcaagaaacctggcctggcctcccaggcctcctcatctagtggtgcgtccaccgagggccacgtggcgtcgcggacnggttcagtggcagtggcgtttagggacaggtacttcactctcattacatacgaactacgacgtgggaacgacccgtaagttacgttttgccttaagttcgttaatttacgtggtacctaggttcctttggttttccggtacccctttcttccctttaccttagttcgtttaaccttacggttttcggaccgttacgggttcccgaggtcgtagggtacgtagttacggaacgacgttaaccgtggtacggtctacgaccacgtnttaccgg

SEQ ID NO: 157632 - DNA, 560 bp, Homo sapiens
  misc_feature: GYAE6OF01B80J4.24.78.H01.1.454.CMB.1.raw
  modified_base (464)..(464): a, c, t, g, unknown or other
  misc_feature (464)..(464): n is a, c, g, or t
tcagactactatgtcacgaccggtgctcgatttagtgtgagtagtttgggtttggggagaggagcccagcactagaagtcggcggtgtttccattcggtgatcagcactgaacacagaggactcaccatggagtttgggctgagctgggttttcctcgtcgctcttttaagaggtgtccagtgtcaggggcagctggtggagtcgtgggggcggcgtggtccaacctgggaggtccctgacgactctcctgtgccggcctcccgattccaccttcaatacttatggcatgcacgtgggtccgccaggcctccgaggcgaaggggctgggaggtggggtggccgtctattcgttattgatggaaagtatacaatattatgcagacctcgtgaacgggccgttcacctatctcagacacaactaccaactaactactctgttctgacaatgactagctgcgatcgngagacacggtctgtctacttacgtgtgacgaaacgtcttaccccgtcccttacttacgtattacggttcgggtaccgtaccctacgcgtggtacgg

SEQ ID NO: 157633 - DNA, 792 bp, Homo sapiens
  misc_feature: GYAE6OF01AG902.24.78.H01.1.454.CMB.1.raw
  modified_base (241)..(241): a, c, t, g, unknown or other
  misc_feature (241)..(241): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgtctccgagggganagagccaccctctcctgcagggccagtcagagtgttagcagcagctacttagcctggtaccagcagaacctggcctggctccgaggctcctcatcctagtcggtcgccgtaccacgacgggcctacgtcgggtcgtcggaccggacgtacggttcaggtcggacgtaggtggtacggttttacggggacgtacggtacctttaccgtactccgttacgacttaccgtaacgtaccggaacgtacggtaccgttacggggaacccgtaacccgggttaaacggtttaacgtttttacggaaccggtttaacggtttaggttttaacgttttaccggttacgggttaacccgttaaggtttcccgggttttacgggttttttccccgggtttaccccccggttttacccgtttacccccgttttaccccggtttaacggtttttacccgtttaaccccggttttaacccgggtttttttccccggggtaaccccggtttaacccgggggttttaccccggtaacgggggttaacccggttttaaccggggggg

SEQ ID NO: 157634 - DNA, 893 bp, Homo sapiens
  misc_feature: GYAE6OF01BFWLH.24.78.H01.1.454.CMB.1.raw
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctgcctcccagccatccgaccggaggtaattgtgttgacgcagtcctccgaggccacctgtctttgcctccgaggggagagacgcccaccctctcctgcgacgggccagtcagagtagaagaagacaactacttacgccgtaggtactacaaacgacgaaaccgtcggacccacggccctacccgacggtcctccgtactactctagttacggtactaccgtaccgagaccggacgggaccctacggttcgggtacctcccgacggtacccgtaacgggtttaccgaacgggtccgggtacgtacggggttcgggtaccggtagggaaccgtacgggttacgtttacccgacctttaccgtacctaacccgtacttaccgaacggtcccgttaacggtttccgacggttaaccgtacggtttaccgttaacgggttaaacggtttttacgggttttttacccggggttaacccgggttttttaaccgtacccgggtttacggttaccccgaagggtttaccccgtaccggggttttccccgtttaccccggggtaaccccggttttccggggaccccgttttaaccccgggtttaaaccccgggggggttttcccggggggggtacccccggggggtaaaaccgggtttacgggggggggttaaacgggttaaaccggggggaaaccccgggttaaaaccggggttcccgggtttaaacccggggg

SEQ ID NO: 157635 - DNA, 837 bp, Homo sapiens
  misc_feature: GYAE6OF01BZ9WE.24.78.H01.1.454.CMB.1.raw
  modified_base (156)..(156): a, c, t, g, unknown or other
  misc_feature (156)..(156): n is a, c, g, or t
tcagactactatgtcacgaccggtgctcgatttagtgtgagtagtttgggtttggggagaggagcccagcactagaagtcggcggtgtttccattcggtgatcagcactgaacacagaggactcaccatggagtttgggctgagctgggttttccncgtcgcttcttttaagaggtgtccagtgtcgaggggcagctggtggagtcgtgggggcggcgtggtccaaccgtggggaggtccctgagactctcctgtcgccggcctcccgattccaccttcaattacttatggctatcgcacgtcggggtcccgccgtaggcctaccgagggcgtaaacgggggcctggggaggtcgggggtcgcccggtacttagttccttttaagttttggaacgttagggtaaaagttaaactactaaaagtttatttaagtggtacctaacggtaccgtttacccggggttacgggaaaaccgggggttccccgggtttacaaaccccgttagttacccgttacccggaagtaaacggaaccttaaacctttacccaaaactaaacttaccttaccgtttacgttttacctacgtaaacctaaacgttacggtaacttaacggcccgttacggacgtaacttaccgtgggtaaaccggtaccgaaccgggttcttacggtttacttaacgtttacggttcggtaacgtaaccggtaaaacggttcccccgtttaccccccgggttacccttttacccggtttaaccgttaacgtttttaccgggttacccggggggttacccccgtacccccttaacggtcgggttacccggggttaacccgggg

SEQ ID NO: 157636 - DNA, 602 bp, Homo sapiens
  misc_feature: GYAE6OF01EYCYD.24.78.H01.1.454.CMB.1.raw
  modified_base (200)..(200): a, c, t, g, unknown or other
  misc_feature (200)..(200): n is a, c, g, or t
  modified_base (435)..(435): a, c, t, g, unknown or other
  misc_feature (435)..(435): n is a, c, g, or t
  modified_base (585)..(585): a, c, t, g, unknown or other
  misc_feature (585)..(585): n is a, c, g, or t
tcagactactatgtcacgaccggtgctcgatttagtgtgagtagtttgggtttggggagagctgctcagttaggacccagagggaaccatggaaacccccagcgcagcttctcttcctcctgctactctggctcccagccatcaccggaggaattgtgttgacgcagtctccaggcaccctgtctttgtctccagggganagacgcccaccctctcctgcgagggccagtcagagtgtagcagcagctacttacgcctggtaccagcaagaaacctcggcctggcctccaggcctctcatctatggtcgcgtcccgaccgacgggccacgtcggcgtccggcggacgtaggttcgaggtggcgtaggtcggtcgttttacgggactagtactttcaccgttctctatcatcgacacgacgtggacgccgtaagtntttgactagttgtattactgtacgtgttcgttcgtttccggtccctttctccctttacctattccgttacttcgttttacggccgttacgggttccgacggtcgtgggtaacgtacgtacgaaggtccgtaacgtcggtacggtcgtacnccgtaccgtctttccgg

SEQ ID NO: 157637 - DNA, 750 bp, Homo sapiens
  misc_feature: GYAE6OF01A2L7J.24.78.H01.1.454.CMB.1.raw
  modified_base (197)..(197): a, c, t, g, unknown or other
  misc_feature (197)..(197): n is a, c, g, or t
  modified_base (240)..(240): a, c, t, g, unknown or other
  misc_feature (240)..(240): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggctcccagccatcaccggaggaattgngttgacgcagtctccaggcaccctgtctttgtctccagggganagagccacctctcctgcagggccagtcagagtgttagcagcagctacttagcctggtaccagcagaaacctggcctggctcccaggctcctcatcctagtggtacgcgtccaccgtacggggccctacgtcgggaccgtccggaccgggtaactacggggtttccaacgggttcgggactaacgggttcgggtccggttttacgggggaccgtaacggtacccgtttacctaaccgttccgtaccgtaacttaccgtaacgttacccgaaccgtaacggaaccgtttacgggaaccggtaccccggtaaaggttaccgtttttacggaccgttaagggtttacgtttaaacgtttaccgttcgttacgtacggttacgtttcggttttaaccgggttcccccgttccgtttacccctttacccgttagtttaccggttaaccctttaaccggttttttccgggtacccggtttaaccggggtttccccgtaggggtcccgtttaaggggg

SEQ ID NO: 157638 - DNA, 779 bp, Homo sapiens
  misc_feature: GYAE6OF01A9LMT.24.78.H01.1.454.CMB.1.raw
  modified_base (157)..(157): a, c, t, g, unknown or other
  misc_feature (157)..(157): n is a, c, g, or t
  modified_base (310)..(310): a, c, t, g, unknown or other
  misc_feature (310)..(310): n is a, c, g, or t
tcagactactatgtcacgaccggtgctcgatttagtgtgagtagtttgggtttggggagaggagcccagcactagaagtcggcggtgtttccattcggtgatcagcactgaacacagaggactcaccatggagtttgggctgagcttgggttttccncgtcgcttcttttaagaggtgtccagtgtcgaggggcagctggtggagtcgtgggggcgcgtggtccaacgtgggacgtccctgagactctcctgtcgccggcctccgattccaccttcaattacttatggcagttcgcacgttcgggtcccnccgaggcctacgacggcgaagggggcctagggacggttggggcggcccgtacttagttccttttaagtttggaagttagggtaaaacgttaaattacctaaaagtttaagtttagtgaccgtaacgtaccgttaccggtacgggtaaaccggggttccccggtttacaacccgtattacccgtaccgtaacgaacgtaactaaaccgttaacccaaaacgtaaacttaaccttaccgtttacgttttcctacggtaacctaaagtccgtaactaacggtcctacgtacgtaacttcgtaaggacggtaccgtaaccggttcgttacgttacttaacgttacgttagtacggtaacgtaaaccggtcccgtttacccccgggttacccgtttacgtttaacgttacggtttacgggttaccggggttaccccggttacccccgttaaacgtcggttaccgggtacccggg

SEQ ID NO: 157639 - DNA, 631 bp, Homo sapiens
  misc_feature: GYAE6OF01BXOU4.24.78.H01.1.454.CMB.1.raw
  modified_base (349)..(349): a, c, t, g, unknown or other
  misc_feature (349)..(349): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgtctccgaggggagagacgcccaccctctcctgcagggccagtcagagtgttagcagcagctacttagcctggtaccagcagaacctggcctggcctccgaggcctcctcactctagtggtnccgtaccaccgacgggcccaacgtcgggccgtcggaccggtacgtacggttcagggtcggacgtaggtggtccgtttgggacgtagtacttccacgtctcatacgactacgacgagacgtcggacgcccgtaagtatttacggacgtaggttacgttacgttacgtacgtacgtacggtcgttcggttccggttaccccttccgttcccttccgttacttccgttaaccgtttaccgttttccgggtcccggttaacgggtttcccgtaggtccgtacgggg

SEQ ID NO: 157640 - DNA, 549 bp, Homo sapiens
  misc_feature: GYAE6OF01A4PQL.24.78.H01.1.454.CMB.1.raw
  modified_base (240)..(240): a, c, t, g, unknown or other
  misc_feature (240)..(240): n is a, c, g, or t
  modified_base (380)..(380): a, c, t, g, unknown or other
  misc_feature (380)..(380): n is a, c, g, or t
  modified_base (456)..(456): a, c, t, g, unknown or other
  misc_feature (456)..(456): n is a, c, g, or t
  modified_base (506)..(506): a, c, t, g, unknown or other
  misc_feature (506)..(506): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgctccgagggganagacgccaccctctcctgcagggccagtcagagtgtagcagcagctacttagcctggtaccagcagaacctggcctggcctccaggcctccgtcatctagtggtcgccgtccacgacgggccacgtggccgtcgcggacnggttcaggtggcagtggtcgtttgggactagtacttcactctacactcactcgacagtactcggacgaccgaagtntttcgctagtgttattacgtgtacagtcttgtttcgtccctcttcctctnttcgtacttacgtttcggaccgtacgggttcctggtcgtacgg

SEQ ID NO: 157641 - DNA, 601 bp, Homo sapiens
  misc_feature: GYAE6OF01BDCUV.24.78.H01.1.454.CMB.1.raw
  modified_base (99)..(99): a, c, t, g, unknown or other
  misc_feature (99)..(99): n is a, c, g, or t
  modified_base (240)..(240): a, c, t, g, unknown or other
  misc_feature (240)..(240): n is a, c, g, or t
  modified_base (349)..(349): a, c, t, g, unknown or other
  misc_feature (349)..(349): n is a, c, g, or t
  modified_base (361)..(361): a, c, t, g, unknown or other
  misc_feature (361)..(361): n is a, c, g, or t
  modified_base (403)..(403): a, c, t, g, unknown or other
  misc_feature (403)..(403): n is a, c, g, or t
  modified_base (407)..(407): a, c, t, g, unknown or other
  misc_feature (407)..(407): n is a, c, g, or t
  modified_base (428)..(428): a, c, t, g, unknown or other
  misc_feature (428)..(428): n is a, c, g, or t
tcagactactatgtcacgaccggtgctcgatttagtgtgagtagtttgggtttggcacgaccggtgctcgatttagtgtgagtagtttgggtttggganagctgctcagttaggacccagaggaaccatggaaaccccagcgcagtcttctcttcctcctgctactctggctcccagcctatcacggaggaattgtcgttgacgcagtcctccagcacctgtctttgctaccgagggganagacgccctacctctaccgtgaccgagggcctaggtcaagagtgttagcacgctacgctacttagccttggtaccagccagaaacctggcctaggcctaccgagctccnactctatcggtnaccgcaacgcggccacgtggcgtacgcgacagttcagtcgcngtgnttgggcacgactcactcctanatcagtcgacgagtacgtggaacgacccgtaagttaacgtttcgaaccgttgttacgttaacgttaccgtgttcccaaggttcctttggttaaccggttccctcttaccgtaccttgtaccgtactttaccgttttcggaccttaacgggttccctaagggtcccgttacggg

SEQ ID NO: 157642 - DNA, 652 bp, Homo sapiens
  misc_feature: GYAE6OF01E5HCB.24.78.H01.1.454.CMB.1.raw
tcagactactatgtcacgaccggtgctcgatttagtgtgagtagtttgggtttggcacgaccggtgctcgatttagtgtgagtagtttgggtttggggagagctgctcagttaggacccagagggaaccatggaaacccccagcgcagcttctcttcctcctgctactctggctcccagccatcaccggaggaattgtgttgacgcagtctccaggcaccctgtctttgtctccgaggggagagacgcccaccctctcctgcagggccagtcagagtgttagcagcagctacttagcctggtaccagacagtaaaccctggccgtggcctacccgaggtcctcctcactctagtggtcgccgtccaccgacggccacgtcggcgtcgcggacgtaggtcgaggtcgcgaggtcggtcgtttggggactaggtacctttccacttcgttacactcactacgactacgtacgtacgggacgtacccgtaaagttcgtttacgacgttagttacgttatttacgtcggtactacggttcgtttcggtttcccgttacccctttcctttacccgttacccttttagtttacgttttacccgttaccgtttttccgggacccggttacggggtttcccgacgggttcgttaacgggg

SEQ ID NO: 157643 - DNA, 667 bp, Homo sapiens
  misc_feature: GYAE6OF01D4HFI.24.78.H01.1.454.CMB.1.raw
  modified_base (276)..(276): a, c, t, g, unknown or other
  misc_feature (276)..(276): n is a, c, g, or t
  modified_base (314)..(314): a, c, t, g, unknown or other
  misc_feature (314)..(314): n is a, c, g, or t
  modified_base (373)..(373): a, c, t, g, unknown or other
  misc_feature (373)..(373): n is a, c, g, or t
  modified_base (525)..(525): a, c, t, g, unknown or other
  misc_feature (525)..(525): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatcggaaaccccagcgcagcttctcttcctctgctactctggctcccagccatcaccggaggtattgtgttgacgcagtctccgaggcaccctgttctttcgctaccgaggggagagacgcccacctctcctgcgaggccagtcagngttgtacgcagcagtcttacgttacgccttcggtaacnggaccaacggaacctcggacctcggcctccgagtcctaccactactcgtagtcggtacnccgtaccacggcgggaccctaggtcggccgtacggacgggtactacgggttcgacgggtcgaccgtagggttcgggttacgtttacggggacttacggttaccttccgtacgttcctcgtacgttcctaacgtaccgacgaacgggttaccncggggaaccgtacccggtaagtttaacgttgtaccgtaagtttcgtaaacttcgtagtcaggttcctttggttacccgttccctcttaccgttctacgttcgttacttccgtttaggcccgtagggtttccaggtcggtagg

SEQ ID NO: 157644 - DNA, 719 bp, Homo sapiens
  misc_feature: GYAE6OF01AT9UA.24.78.H01.1.454.CMB.1.raw
  modified_base (341)..(341): a, c, t, g, unknown or other
  misc_feature (341)..(341): n is a, c, g, or t
tcagactactatgtcacgaccggtgctcgatttagtgtgagtagtttgggtttggggagaggagcccagcactagaagtcggcggtgtttccattcggtgatcagcactgaacacagaggactcaccatggagtttgggctgagctgggttttcctcgtcgctcttttaagaggtgtccagtgtcaggggcagctggtggagtcgtgggggcggcgtggtccaaccgtgggagtccctgagactctcctgtgcggcctccgattcaccttcaatacttatcggcatgctacgtgggtccgccaggcctccgaggcaaggggctgggagtggggtggcccgngttatcgtttatttggattaggaagtaatcaaattattaatgactaggaccttaccggtagggaaacggggtcccggttacaacccgtattcccgtccaaggaacgtaacctaagtttaccccaaataaacgttaccttcgtttagtttaccgtacgactaaagtcgaactacgtccgtaggtaccgtacgtacgttacggaacgggtacgaccgggtacttcggttacttaacgttaacgtacgttacggaaccggtaaaccgttcccgtttaccccccgggttaccccttttcgtttaaacccggtaacgtttttacggggtttccgggggtaccccgttacccccgttaacgtaacgggttcgggttaacccggg

SEQ ID NO: 157645 - DNA, 655 bp, Homo sapiens
  misc_feature: GYAE6OF01AF4JG.24.78.H01.1.454.CMB.1.raw
  modified_base (210)..(210): a, c, t, g, unknown or other
  misc_feature (210)..(210): n is a, c, g, or t
  modified_base (242)..(242): a, c, t, g, unknown or other
  misc_feature (242)..(242): n is a, c, g, or t
  modified_base (370)..(370): a, c, t, g, unknown or other
  misc_feature (370)..(370): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtcnccaggcaccctgtctttgtctccgaggggganagacgcccacccttctcctgcagggccagtcaggagtgtagcagcagcttactagcctggtaccagcaacgtaacctggcctggcctccgaggcctcctacactcttagtggtcgccgtaccgaccgnggcccacgtcgggcgtcggcggtacgtacgggttcagggtcggacgtacggtcgggtcgtttgggactacgtacttcgaccttctactacgtctaacgtcgacgacgtaccgtacggtacgtacccgtaagttacgtttcgacgttaggttacgttacgtttaccgtaggttaccgtaggttcgtttcggtttcccgtacccttccgttccctttaccgtacgtttccggttactttaaccggtttcgtacccggttacgggttccctggggttccgttaacggg

SEQ ID NO: 157646 - DNA, 696 bp, Homo sapiens
  misc_feature: GYAE6OF01CK6RK.24.78.H01.1.454.CMB.1.raw
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggctcccagccatcgaccggagaattgtgttgacgcagtctccgaggccaccctgttctttgtcctcgaggggagacgacgccctaccctctcctgcgacgggccagtcagagtgttagcagcacgactacgtacgccgtacgtaccagacaacgaaaccgtcgccgtacggcctcccgaggtcctctcgtaactcgtagtcggtcgccgtaccctaccggacggcccacggtcggccggtcggaccggtacgtacggttcgaggtcggctagggtcggtcggtttagggactacggtacctttacgacctactctactctaacgtaccgtaacacggtacgtacggaaccgtacccgtaagttacgtttgacgtagttcgttaacgttacgtcgtacgtacggttctttcgggtttacccgttcccctttccgttaccctttaccgttacgtttacccgttaaccgtttcccggtttaccggtacccggttacccgggtttaccgtcggggtccgttaaacggggg

SEQ ID NO: 157647 - DNA, 868 bp, Homo sapiens
  misc_feature: GYAE6OF01B1WDC.24.78.H01.1.454.CMB.1.raw
  modified_base (241)..(241): a, c, t, g, unknown or other
  misc_feature (241)..(241): n is a, c, g, or t
  modified_base (255)..(255): a, c, t, g, unknown or other
  misc_feature (255)..(255): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggctcccacgccatcaccggaggtaattgtgttgacgcagtctccaggcacctgtcttgtctccgagggganacgacgccacctcnccgtgcgagggccagtcaggagtgttagcagcagacttactacgcctaggtaccagcaacgaaacctggacctggacctccgaggtccctccttcgaattccgttagtcgggtcgccgtaccgaacccggtacgggtaccctaacggtcgggtccgtaccgggaccgggtaaccgtacggggtttaccaaaggggtttcgggaccggtaacgggtttcggggttacccggtttttaacgggggaaccgtaaaccgggttaacccgtttaaccggtaacccgtttaccgttaccgtaaacgtttaccgtaaaccggtttacccggaaacccggtaacgggtaacccgggttaacggggtaacccggtaacccccgggttaaaacggttttaccgttttttaccgggaacccgtttaacgggtttaacggtttaaccgttttaacgttaccggttaccgtaacggtttacccgtttttaccgggttttacccgggtttcccccgtttacctttaccccgtttacgtttaaccgtttaccgtttaaacccgtttacggttttacccgggtacccggtttaaaccggggtttcccgtacggggttccgttaacgggg

SEQ ID NO: 157648 - DNA, 593 bp, Homo sapiens
  misc_feature: GYAE6OF01EHO66.24.78.H01.1.454.CMB.1.raw
  modified_base (245)..(245): a, c, t, g, unknown or other
  misc_feature (245)..(245): n is a, c, g, or t
  modified_base (342)..(342): a, c, t, g, unknown or other
  misc_feature (342)..(342): n is a, c, g, or t
  modified_base (486)..(486): a, c, t, g, unknown or other
  misc_feature (486)..(486): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaagccccagctcagcttctcttcctcctgctactctggctcccagatgcccaccggagactatttgtgttgacacagtctccagccacctgtctttgtctccgaaggggaancgcccaccctctcctgccgagggccagtgacaatgttaggaagttgtagcctggtatcaacacaaacagtcggaccaggtccctccccggcttcctnacttctatgactgactactccgaaagtacgggccacgtcggaccactacccaagaccgtaggttcaggtggacgtaggtgggtccgtagggacagtacttcgactccgtacacctatcgagcagtgtagcgcgtagtaacgttntttgacgtttagtttattacgtcgtcagtccgtaccgtagactaaccgtccgtacccttacgttcccggacccgtacggtaccacgtacgtacgacctagtaacccg

SEQ ID NO: 157649 - DNA, 674 bp, Homo sapiens
  misc_feature: GYAE6OF01AVZ44.24.78.H01.1.454.CMB.1.raw
  modified_base (242)..(242): a, c, t, g, unknown or other
  misc_feature (242)..(242): n is a, c, g, or t
  modified_base (664)..(664): a, c, t, g, unknown or other
  misc_feature (664)..(664): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggctcccagccatccaccggaggtaattgtgttgacgcagtctccaggccacctgtctttgctccgagggganagacgcccaccctctcctgcgacgggccagtcagtagtgttagcagcagtactacgtacgcctacggtaccagacgaacgaaccgtcggcccgtcgggtccctcccgaggtccttccgtactacttcgtagttcggtacgccgtaccaccggtacgggccctacggtcggccggtaccggacggtacgtacggttcgacgggttcggacgtagggttcgggtaccggtttaggggactacggttaccgttccgtactcctactctacgtacgtcgaacgtacggaccgtacggaccgtaccgtaagttacgtttcgacgttgttacgttacttacgtacgttacgacgttcgttacggttccgttccctacttcccgttcttacgttccgttacgttcgtttccggacgttacgggttccgnggtcgtacgg

SEQ ID NO: 157650 - DNA, 734 bp, Homo sapiens
  misc_feature: GYAE6OF01BEMSM.24.78.H01.1.454.CMB.1.raw
  modified_base (247)..(247): a, c, t, g, unknown or other
  misc_feature (247)..(247): n is a, c, g, or t
  modified_base (364)..(364): a, c, t, g, unknown or other
  misc_feature (364)..(364): n is a, c, g, or t
tcagactactatgtcacgaccggtgctcgatttagtgtgagtagtttgggtttggcacgaccggtgctcgatttacgtgtgagtagtttgggtttggggagagctgcgtcgagttaggacccagaggggaaccatcggaaaccccagcgcagcttctcttcctcctgctactcgtggctcccagccatcaccggaggaattgtgttgacgcagtctccaggcaccctgtctttgtctccgagggganagacgcccaccctctcctgcacgggccagtcagagtgtagcagcagctacttagcctaggtaccagcaagaacctggcctaggcctcccgaggtcctcctctacgtctagtgggtcnccgtccaacgacggcctacggtcggcgtccggacggtacgtaggttcgacggtcggcgtaggtcgggtacgtttacggggactacggtaccttacgtaccgttctacgtactccgtaacgtaccggaacgtaacggtacgttacggggaaccggtaccccggttaaagttaccgtttttacggaccgttaagggtttacggtttaactttacgttacggttaccgtaaccggttccgttttacggttttcccgggtttacccccttccgtttaccccttaccggtttacgttaccgtttaaccgttttaccggttttccggggtacccggtttaccgggggttttccccgacgggttccggttaaacggg

SEQ ID NO: 157651 - DNA, 761 bp, Homo sapiens
  misc_feature: GYAE6OF01CGOT2.24.78.H01.1.454.CMB.1.raw
tcagactactatgtcacgaccggtgctcgatttagtgtgagtagtttgggtttggcacgaccggtgctcgatttagtgtgagtagtttgggtttggggagagctgctcagttaggacccagaggaaccatcggaaacccagcgcagcttctcttcctctgctactctggctccagccatcacggagtatgtgtgacgcagtctccaggcctacctgtcttgtctcgaggggagagacgccaccctctcctgcgagggccagtacgaggtagttcgtaacgcgtacgcgtacgtacctacgttacggaccgttacgggtaaccaaggtaccgaacggtaaacccgtcggacccgtcggtacccttaccccgaacggtcctaccctacgtaacgttccgtaacgttcgggtaccggtcccgtaaccccgaaccgggtacgggtacccctaacggtccgggtccggttaccggggacccgtaacggtacgggtttccgaaggggtccggtacggtacgggttcgggttaccgtttacgggggactaacggttaccgttaccgtacgtcctacgtacgtacgtaacgtaccgaacgtaccgaccggtcggaaccgtacccgtaagttacgtttacgacgttagttacgttacgttacgtacgtacgtacgttcgttccgtttaccgtcccgttccgtcccttacttacgtttaccgttactttcggttccggtacccggttagggttccgtacggtcgttaacgg

SEQ ID NO: 157652 - DNA, 687 bp, Homo sapiens
  misc_feature: GYAE6OF01ANHJ7.24.78.H01.1.454.CMB.1.raw
  modified_base (647)..(647): a, c, t, g, unknown or other
  misc_feature (647)..(647): n is a, c, g, or t
tcagactactatgtcacgaccggtgctcgatttagtgtgagtagtttgggtttggggagagctgctcagttaggacccagagggaaccatggaaaccccagcgcagcttctcttcctcctgctactctggctcccagccatcaccggaggtaattgtgttgacgcagtctccaggcacctgtctttgtctccgaggggagagacgcccaccctctcctgcgacgggccagtcagagtgttagcagcagcttacttacgccgtcggaccagacaacgaaaccgtcggaccgtcggccctcccgaggtccctccgtacacgttctagtcgggtcgtcccgtacccgaaccggacggtacctacgtcgggcggtccggacgggtacgtaggttcgacggtcggacgtaggtcggtcgtttacggacgtacgtaccttcgacgttcctccgtaccgtacgacgaccgtagaccgttaagcgtacgtagtaaagttcgtttacggtacgtttaactcgtagacacgtctacgtccggttaccgcgtccggtaccgttaccggttacgggttccgggggacggggtacgtaagggggtacgaacgggtacggaacggacgtaacgtcgggtacggcttacggacctaaccgtntttccgtacgtttctacgtacctttcccgttcccggtaac

SEQ ID NO: 157653 - DNA, 699 bp, Homo sapiens
  misc_feature: GYAE6OF01D3I6G.24.78.H01.1.454.CMB.1.raw
  modified_base (245)..(245): a, c, t, g, unknown or other
  misc_feature (245)..(245): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggccaccctgttctttgtccgtccgagggganagacgcccaccctctcctgcacgggccagtcagtagtgtagcagcagaccttacgttacgccgtaggtaaccaggaccgaacgtaaacccgtggcccgtcggaccctcccgaggtcctcccgttcacgttcgtacgcgggtacgccgttccacccgtacgggcctacggtcggccgtcggacggtaacgtcggttcgaaggtcgggctaggttcggtcgttgggaactagtaccgttcacgttctacgtaactccgtaacgtacgacgtacgtacgtacggaaccgtacccgtaagttacgtttcggacgttaagtttaggttactttacggtcgttacgtacggttccgtttacgggtttccgttccccttccgttacccttcttacggttaccgtttaccgtttaccggttttcgggacccgtttaacgggtttccggagggttcgtaacgg

SEQ ID NO: 157654 - DNA, 679 bp, Homo sapiens
  misc_feature: GYAE6OF01ETZIY.24.78.H01.1.454.CMB.1.raw
  modified_base (200)..(200): a, c, t, g, unknown or other
  misc_feature (200)..(200): n is a, c, g, or t
tcagactactatgtcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgtctccgagggganagagccaccctctcctgcagggccagtcagagtgtagcagcagctacttagcctggtaccagcagaaacctggcctggctccaggcctcctcatctatggtcgcgtccaccgacgggccacgtggcgtcggcggacgtacggttcaggtcggacgtaggtcgggtcgttttacggggactaggtactttaccgaccttacctctaagtacctaacgttaccggaactacggtaaccgttggggaaccgtacccccggtaaagttacgttttacggaccgtaaggttacgttaacgtttacgtgttaccgtaagttcgtttcggttttacggtcccctttacgttccccgttacgttagttacgtttaaccgttacggtttttccgggtaccgttacgggttccgtacgggtcgttagggtacgtacgtacgtaacgaccgtaacgttcggtcggtacgtacgacctaccgtgttacccg

SEQ ID NO: 157655 - DNA, 787 bp, Homo sapiens
  misc_feature: GYAE6OF01CC5EO.24.78.H01.1.454.CMB.1.raw
  modified_base (200)..(200): a, c, t, g, unknown or other
  misc_feature (200)..(200): n is a, c, g, or t
tcagactactatgtcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgtctccgagggganagacgcccacctctcctgcaggccagtcagagtgtggcagcagctacgttacgcctggtaaccagacaacgaaaaccgtggccgtcggcctcccgaggcctcctactacttctagtggtcgccgtacccgaccgacgggcctacgtcggccggttccgcgggactacgggttcgaggtcggacgtaggtcgggtcgttttaggggaacctaggttaccgtttacctaaccgttcttaccgtaacttaccgaacgttacccggaacgtaacggtaccgtacgggtaaccggacccggtaaagttacgttttgaccgtagtttacgttaacgtttaacgtcggttacgtacggtccgttttcgggtttacccgtccccttttacgtccccctttacggtttaaccgttttaccgtttaaccgtttacgttttaccggggtaccccggtttaccggggtttaccgtacgggttaccggtaaggggttaacgttaacggtttaacccggtaaacgggttaccgggtaaacggtttcggggttaccgggtacccgttacccgggtaacctaacccgttaacgttttcccggg

SEQ ID NO: 157656 - DNA, 694 bp, Homo sapiens
  misc_feature: GYAE6OF01EAICH.24.78.H01.1.454.CMB.1.raw
  modified_base (199)..(199): a, c, t, g, unknown or other
  misc_feature (199)..(199): n is a, c, g, or t
tcagactactatgtcacgaccggtgctcgatttagtgtgagtagtttgggtttggggagagctgctcagttaggacccagacggaaccatggaagccccagcgcagcttctcttcctcctgctactctggctcccagataccactggagaagtagtcatgacgcagtctccagccacctgtctgtgtctcgagggaaancgcccaccctctcctgcgacgggccagtgaacagttggttaggagttgtacgcctggtactacaacaacaaacagtcggccgaggccctccccggctaccctctacttcgtatgatcgacactaccgaagtcgggcctacgtcggactacgtaccccaaggtaccgtaggttccgagggttcggaccgtaggggttcgggtacgtacgggaactacggtaccttctacctcctacaaccgatacgacgacgtaggtacgtaacggtacgtcgttaaggtaaagtttcgttttacggacttttaacggttttatttacgttcgtaacgtaacgtccgtaaccggttacgaacccgtaacggttcccggtaccccgttacggtttcccgggacccgtacgggaacctacggtacgtacggaacctaccgtaacccgaaggttaccgtgggaccgtacctacgtaccctaacgttattcccgttcgttaccttacccg

SEQ ID NO: 157657 - DNA, 744 bp, Homo sapiens
  misc_feature: GYAE6OF01ADIHF.24.78.H01.1.454.CMB.1.raw
  modified_base (141)..(141): a, c, t, g, unknown or other
  misc_feature (141)..(141): n is a, c, g, or t
  modified_base (240)..(240): a, c, t, g, unknown or other
  misc_feature (240)..(240): n is a, c, g, or t
  modified_base (304)..(304): a, c, t, g, unknown or other
  misc_feature (304)..(304): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccngcgcagcttctcttcctcctgctactctggctcccagccatcaccggagaattgtgttgacgcagtctccaggcaccctgtctttgtctccgagggganagacgcccaccctctcctgcacgggccagtcagagtgtagcagcagctacttcgcctggtaccngcagaaacctggcctggcctcccgagtcctcctcatctagtggtcgccgtaccgaccgacgggccctacgtcgggccgtccggacggacgtaggtttcagggttcggacgtaggttcggtccggtttacgggaccgtacggtacccttaccgtaccttccgttactacgttaccgtacgtaccgaacgtaacggtaccggttacgggaacccggtaacccggtaaaggtttaacgttttacggaccgttaagggtttacgtttaaacgtttaccgtacggttaccgtacggttcccgttttcgggtttcccggttaccccgtttcccgttacccctttacccgtttacgtttacccggtttaaccgtttacccgggtttttacccgggaccccggttttaacccggggtttaccccgacggggtttccgttaaaccgggg

SEQ ID NO: 157658 - DNA, 275 bp, Homo sapiens
  misc_feature: GYAE6OF01DQKB1.24.78.H01.1.454.CMB.1.raw
  modified_base (236)..(236): a, c, t, g, unknown or other
  misc_feature (236)..(236): n is a, c, g, or t
  modified_base (246)..(246): a, c, t, g, unknown or other
  misc_feature (246)..(246): n is a, c, g, or t
  modified_base (258)..(258): a, c, t, g, unknown or other
  misc_feature (258)..(258): n is a, c, g, or t
  modified_base (264)..(275): a, c, t, g, unknown or other
  misc_feature (264)..(275): n is a, c, g, or t
tcagactactatgtcacgaccggtgctcgatttagtgtgagtagtttgggtttgggacagacttcactctcatcatcgacagactggagcccgaagattttgcagtgtattactgtcagctgtttggtccctctcctcctatgtactacttttggccagggttccaggctggagatcaaagcgaactgtggctgcaccatctgtcttcatcctccgccatctagaacatagtagtntgagcgggcnggaccaaggcanatagcnnnnnnnnnnnn

SEQ ID NO: 157659 - DNA, 836 bp, Homo sapiens
  misc_feature: GYAE6OF01EY9VB.24.78.H01.1.454.CMB.1.raw
  modified_base (100)..(100): a, c, t, g, unknown or other
  misc_feature (100)..(100): n is a, c, g, or t
  modified_base (288)..(288): a, c, t, g, unknown or other
  misc_feature (288)..(288): n is a, c, g, or t
  modified_base (312)..(312): a, c, t, g, unknown or other
  misc_feature (312)..(312): n is a, c, g, or t
  modified_base (314)..(314): a, c, t, g, unknown or other
  misc_feature (314)..(314): n is a, c, g, or t
  modified_base (338)..(338): a, c, t, g, unknown or other
  misc_feature (338)..(338): n is a, c, g, or t
  modified_base (620)..(620): a, c, t, g, unknown or other
  misc_feature (620)..(620): n is a, c, g, or t
  modified_base (726)..(726): a, c, t, g, unknown or other
  misc_feature (726)..(726): n is a, c, g, or t
tcagactactatgtcacgaccggtgctcgatttagtgtgagtagtttgggtttgggggaggagcccagcactagaagtcggcggtgtttccattcggtgntcagcactgaacaaccagaggacgtcaccaactggaggtttgggtcgtgagctgggttttccgttcgtcgctctttaagtaaggtgtcacgtgtcgagggcgagcgtggtggaggtcgtggggcggggcggtgggtccgaacctacgggagggtcccgtcgaggactctcctcgtgcggccgtcccgntcctactctactactactagtcgngngctctcggtccggtccggaccggnaccgtaccgtaccggtccgaaacggggggccgttaggggtacggttcgggggttacggggtcccgggtccggttacgttaccgttttaagttttcggttaagtttacgggtaaacgttaaacgttaacgttaaaatttaactttaacgttacggtacgtaacggtacccgttacccggttacggtaaaccggggtacccgggttaccggtaacccgtacgtaccgtacccgtaacggtaaccgaaacctaaacgttaccctaaaccaaattaacccttaccntagtttcccttacgtcttaaacttgaaccttaaacgtcccgtacgtaccgtaacttaccgttacggtaacggtaccgtaacgggtaccgttacgttaccgttaacntttaccgttacggttacggtaccggtaaacggtaacgtttaccccccgggtaacccccgtttacccgtttaaccccgggtaaccgttttaacgtttaccgggggttcggg

SEQ ID NO: 157660 - DNA, 726 bp, Homo sapiens
  misc_feature: GYAE6OF01C9ZWF.24.78.H01.1.454.CMB.1.raw
  modified_base (275)..(275): a, c, t, g, unknown or other
  misc_feature (275)..(275): n is a, c, g, or t
  modified_base (300)..(300): a, c, t, g, unknown or other
  misc_feature (300)..(300): n is a, c, g, or t
  modified_base (386)..(386): a, c, t, g, unknown or other
  misc_feature (386)..(386): n is a, c, g, or t
  modified_base (392)..(392): a, c, t, g, unknown or other
  misc_feature (392)..(392): n is a, c, g, or t
tcagactactatgtcacgaccggtgctcgatttagtgtgagtagtttgggtttgggggaggagcccagcactagaagtcggcggtgtttccattcggtgatcagcactgaacacagagactcaccatggagttgggctgagcttgggttttccctcgtcgcttcttttaagaggtgtccagtgtcaggggcagctggtggagtcgtgggggcgcgtggtcccaaccgtgggacgtccctgagactctcctgtcgccggcctcccgattcaccttnaatactatgcatgctactgggcccncaggcctccgaggcgaagggggctgggacgtgggtcggccgtcttagttctttaatttgaagttgggaaacttaatcctaaagttntttaanggcaagacctccggtagaacggggtccgttcaccatcctacagaacgacctaacttaccaaactaactactacttcgtttctacgtaactaaatcgaacgtacgtcccgtagtaccgtaagtccgttacggaacgggtaccggtaaccggtccttacgttaaccttagtttaacccgttgtaccggtaaaccggttaaaaccgttaccccggtttaccccccccggtacccctttttaacccggtttaaccggtaaacgttttaaccgggtttacgggggttacccccgtacccccccgttaagtaccgggtacgggtacccggttacccgggg

SEQ ID NO: 157661 - DNA, 760 bp, Homo sapiens
  misc_feature: GYAE6OF01E4O8Y.24.78.H01.1.454.CMB.1.raw
tcagactactatgtcacgaccggtgctcgatttagtgtgagtagtttgggtttggggagaggagcccagcactagaagtcggcggtgtttccattcggtgatcagcactgaacacagaggactcaccatggagtttgggctgagctgggttttcctcgtcgctcttttaagaggtgtccagtgtcaggggcagctggtggagtcgtggggggcgcgtggtccaaccgtgggaggtccctgagactctcctgtcgccggcctcccgattcaccttcaatactatggcatgcacgtgggtcccgccaggcctccgagggcaagggggctggggaggttggggtcgggcccgtcgttaattcttttaagttttggaagttagggtaaagttaaatccaaaatttagtttaatcggacctaaggtaaccgttcccgggttagggaaaacgggggtcccccggtttacaaccccgtattacccgtacccgaaggaacgaacctaaactttaccccaaaactaaacttaccttctttacgtttacctaggtaacctaaaactcggtaaccttacgtccctcggaccgtaacttccgtaggaacgggtaccgaccgggttcttagttaccgttaatttaccgtgggttacgaaccggtaaacggtaccccgtttccccccgggtaccccttttacgtttaacccggtaagttttacggttccgggggttacccggaccccccttacgtacgtccgggttaacccggg

SEQ ID NO: 157662 - DNA, 615 bp, Homo sapiens
  misc_feature: GYAE6OF01BCQ90.24.78.H01.1.454.CMB.1.raw
  modified_base (241)..(241): a, c, t, g, unknown or other
  misc_feature (241)..(241): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgtctccgagggganagacgcccaccctctcctgcgagggccagtcagtagtgttagcagcagtctacttagcctggtaccagacaacgaacctggcctggcctcccaggctcctcatctagtcggtgccgtaccgacgacggccacgtcggcgtcgacggtactacggttcaggttcggacgtagtcggtcgtttagggactaggtacttcactctacgtatacagtacacgtagacgtggacgtaccgtaagtacgtttagacgtacgttagttaacgttacgtacgtacgtacgtcgttcggtttaccgtcccttcgttacccttacgttacgtacgtttaccgttacgtttcggtacccggttaggttaccgtggtcggtaacgg

SEQ ID NO: 157663 - DNA, 690 bp, Homo sapiens
  misc_feature: GYAE6OF01AGTD5.24.78.H01.1.454.CMB.1.raw
  modified_base (249)..(249): a, c, t, g, unknown or other
  misc_feature (249)..(249): n is a, c, g, or t
  modified_base (453)..(453): a, c, t, g, unknown or other
  misc_feature (453)..(453): n is a, c, g, or t
  modified_base (540)..(540): a, c, t, g, unknown or other
  misc_feature (540)..(540): n is a, c, g, or t
  modified_base (558)..(558): a, c, t, g, unknown or other
  misc_feature (558)..(558): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggcctcccagccatcgaccggaggtattggtgttgacgcagtcctccgaggccacccttgtcttttgcctcgaggggganacgacgcccacccgtctccgtggccgacggggccaggtccaggtacggttgttacggaccgagccgtaggtacttaaccgttacggcccttacgggtaaccccaaggtaccgaaccggtaaaacccgttcgggacccttcggggccctacccggacggtccttacccgtctacttcgtacgtgggtccgtccgtaccgacccgngggcccacggttcggccgtcggtacggacgtaggtcgtaggtcggacgtcggtggtcgtttgggactacggtacttacactcctacntcagtccgacgtcgacgnggacgaccgtagtattcgatgttacgtagttacgtcgtactacggttcgttacggttccgtcccgttcttccgtaccttgttccgttaacttcggtttaccgtaccggttcggtttaccgtggtcggtacgg

SEQ ID NO: 157664 - DNA, 257 bp, Homo sapiens
  misc_feature: GYAE6OF01DMF20.24.78.H01.1.454.CMB.1.raw
  modified_base (251)..(251): a, c, t, g, unknown or other
  misc_feature (251)..(251): n is a, c, g, or t
  modified_base (257)..(257): a, c, t, g, unknown or other
  misc_feature (257)..(257): n is a, c, g, or t
tcagactactatgtcacgaccggtgctcgatttagtgtgagtagttgggtttgggacagacttcactctcatcatcgacagactggagcccgaagattttgcagtgtattactgtcagctgtttggtccctctcctcctatgtacacttttggccagggttccaggctggagatcaagcgaactgtggctgcaccatctgtcttcatcttcccgccatctgaacatagtagtctgagcggctggcaaggcncatagn

SEQ ID NO: 157665 - DNA, 942 bp, Homo sapiens
  misc_feature: GYAE6OF01BN2RV.24.78.H01.1.454.CMB.1.raw
  modified_base (155)..(155): a, c, t, g, unknown or other
  misc_feature (155)..(155): n is a, c, g, or t
  modified_base (172)..(172): a, c, t, g, unknown or other
  misc_feature (172)..(172): n is a, c, g, or t
tcagactactatgtcacgaccggtgctcgatttagtgtgagtagtttgggtttgggagaggagcccagcactagaagtcggcggtgtttccattcggtgatcagcactgaacacagaggactcaccatggagtttggctgagcttgggttttccncgtcgcttcttttaagnggttgtccagtgtcgagggcagcgtggtggagtcgtgggggcgcgtggtccaacgtgggacgtcctgaacgcttctccgtgtcgccggtccctccgtattccgaccttcaacttacgttagtggactagtcgacctacgttcggggtcccgaccgtaacgggccttacccggaaggggtaccggtaaacggggggtccgttaaggggtacgggttcgggggttaccggccccgttagtttaacgtttaccgtttttaaggttttacgaaaggttttaacgggtaaaacgtttaaactaccgttaaaacttttaagtttaacggacggtacctaaacggttacccggttaacccgggtagggtaaacccggggttccccgtttaacccaaaccgttaccgttacccgtaacccggaaacggtaaaccggtaaacccttaaaacctttaccccgaaaaacttaaaccgtttaaccgttttaccgtttacggtttttaacccgtaacgggtaaaccttaaaacggttaccggtaacccgttaacggttaccccggtacggtaccgttaacgttaccggtaacggggaaacccggtacccggttacgggttaccgttaccggtttaaccgttaacgtttaccgggtacggtaaccgggtaaacggtaaaccgttccccggtttacccccgttaacccttttacgtaaccggtttacgtttaccgggttccggggaaccccttaccccgtaagttccgggtcggttaacccgggg

SEQ ID NO: 157666 - DNA, 659 bp, Homo sapiens
  misc_feature: GYAE6OF01D82NQ.24.78.H01.1.454.CMB.1.raw
  modified_base (348)..(348): a, c, t, g, unknown or other
  misc_feature (348)..(348): n is a, c, g, or t
tcagactactatgtcacgaccggtgctcgatttagtgtgagtagtttgggtttggggagaggagcccagcactagaagtcggcggtgtttccattcggtgatcagcactgaacacagaggactcaccatggagtttgggctgagctgggttttcctcgtcgctcttttaagaggtgtccagtgtcaggggcagctggtggagtcgtgggggcggcgtggtccaaccgtgggaggtccctgagactctcctgtgcggcctcccgattccaccttcaattacttatggcatgcacgtgggtcccgccaggcctccgaggccgaagggggctaggaggtggggtcgccgtnttattctttatttggatgggaaagttaatactaaattattatgcaagtacctccggtaggaacggggtcccgttacaacctattccgtaccgaagaacgtaacctaacttacccaaactaacttaccttacttacgttttcctagtaactaaagtcgtaacctacgtccgtagaccgtagtccgtaggacggtaccgtacggtcttagttacttattacgtggtacgaacgtaaacgtcccgttcccccggtaccctttcgttacgtagtttacggttcggggtcccgtaccccctagtcgtcggtaccgg

SEQ ID NO: 157667 - DNA, 890 bp, Homo sapiens
  misc_feature: GYAE6OF01B9K7K.24.78.H01.1.454.CMB.1.raw
  modified_base (562)..(562): a, c, t, g, unknown or other
  misc_feature (562)..(562): n is a, c, g, or t
tcagactactatgtcacgaccggtgctcgatttagtgtgagtagtttgggtttggggagaggagcccagcactagaagtcggcggtgtttccattcggtgatcagcactgaacacagaggactcaccagtggagtttgggctgagtcgttgggttttcctcggtcgtcttacgttttaaggaggttcgtccgtaggttggtccggagggggccaggtcgttgggtggtaggttcgggtggggggcgcggttcggtaccgaacggtggggacgtcctggacgtcctcgtacgtggtcgcccgtcctaccgtattacctaccttactaattaccgttgcgactacgtcgccggtacggtcgggtcccaccggaggtaccctacgggaggggaaccgggtacggggtccgttagggggtacgggttcggggtccgcccgttagtttacgtttacgttttaaggttggaaaggttaacggtaaattaactacttaaaagtttgtaaggtcgaaccgttaaggtacccggttacggggaacggtaaccggttccgttacaaccgttntaccgtacgaagtaacgtaacctaactaaccaaacgttactaccgtttgtttactacgtaagtaaccgtaaacgttcgtaaccttcggtactaccgtacgtaacgttacggtaagggaacccgtacggtacttcggttaaccgttacgttaaacccgttgttaccgggtaaccgtaaaaccggggttaccccgttaaccccccgggtttaccccgttttaccggtttaacgggttaaacccgttttacgggggttaccccggggtttaccggtaccccccggtttaaaccccgtgggttaaacgggggttcccgggttaaacccgggg

SEQ ID NO: 157668 - DNA, 648 bp, Homo sapiens
  misc_feature: GYAE6OF01B7VPD.24.78.H01.1.454.CMB.1.raw
  modified_base (292)..(292): a, c, t, g, unknown or other
  misc_feature (292)..(292): n is a, c, g, or t
  modified_base (313)..(313): a, c, t, g, unknown or other
  misc_feature (313)..(313): n is a, c, g, or t
  modified_base (355)..(355): a, c, t, g, unknown or other
  misc_feature (355)..(355): n is a, c, g, or t
  modified_base (636)..(636): a, c, t, g, unknown or other
  misc_feature (636)..(636): n is a, c, g, or t
tcagactactatgtcacgaccggtgctcgatttagtgtgagtagtttgggtttggggagaggagcccagcactagaagtcggcggtgtttccattcggtgatcagcactgaacacagaggactcaccatggagtttgggctgagcttgggttttcctcgtcgcttcttttaagaggtgtccagtgtcaggggcagcgtggtggagtcgtggggggcggcgtggtccaaccgtggggacgtccctgacgactctcctgtcgccggcctcccgattccaccttcaataccttancggacatgcacgtgggtcccnccaggcctccaggcgaagggggctgggagtgggtcggccgtntatcttattgatggaaatatacaattatatgcaagtactccggtggaaacgggtcccgttacacctatcccgtaccagaacgaaccaacttacccaaactaacttactctttagtttactagtactaaatcgtaactacgcctgacgtaagttcgtaggacggtacgtacggtacttcgttactaacgttacgtggtacgaacggtaaacgtacccgttcccccggtaccgttttactaccggttactttacggttcggggtacccgtacccccgttacgngtccgggtacgg

SEQ ID NO: 157669 - DNA, 684 bp, Homo sapiens
  misc_feature: GYAE6OF01EY2QH.24.78.H01.1.454.CMB.1.raw
tcagactactatgtcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgtctccgaggggagagagcccaccctctcctgcacgggccagtcagagtgttagcagcagctactagcctggtaccagcaagaaacctggcctggcctccaggcctcctcatctagtggtcgccgtccgaccgcgggccacgtcgggcgtcggcggacgtaggttcaggtcggcgaggttggtcgttttgggactacggtaccttacacgttcctacgtaactctaacgtccgacgtacgacgtacgggacggaccccggtaaagtagttttcggacgtagttagttactttacgtcgttactagttcgtttcgttttacggtcccctttcttcccctttaccttagttacgtttaccgtttaaccgtttttccgggacccggttacggggtttacccgtacgggttcgtagggtaaccgtagtttaaccggaaacggttaccggtaacggtttcgggtcgggttaccttacggacccttaacccgtcgtttacccgg

SEQ ID NO: 157670 - DNA, 732 bp, Homo sapiens
  misc_feature: GYAE6OF01B16VI.24.78.H01.1.454.CMB.1.raw
  modified_base (200)..(200): a, c, t, g, unknown or other
  misc_feature (200)..(200): n is a, c, g, or t
tcagactactatgtcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgtctccgagggganagcgcccaccctctcctgcagggccagtcagagtgttagcagcagcttactagccgtgtaccagcaacgaaacctggcctcggcctcccgacggcctcctcatctagttggtcgccgtccaccgacgggccacgtcggcgtcggcggtactcggttcaggtggacgtacggtcggtcgtttcgggaacgtagtaccttcgaccttctaccgaacttcacgttaccgaactacggtaccgtcgggaaccgaccccggtaaagttacgttttacgacgttaggtttacgtttaacgtttacgtcgttaccgtaggtttccgttttacgggttttcccggtcccctttacccgttcccgtttacctttaagtttccgtttaacccgtttacgtttttccgggtaccccgggttacggggttacccgtacggggttaccggttacgggtaacgttaccggttaaccggtaacggttacccggtaaacgtttcgggtccggtaccgttacccgaccgttacccgttacgtttacccg

SEQ ID NO: 157671 - DNA, 779 bp, Homo sapiens
  misc_feature: GYAE6OF01CPDQP.24.78.H01.1.454.CMB.1.raw
  modified_base (115)..(115): a, c, t, g, unknown or other
  misc_feature (115)..(115): n is a, c, g, or t
  modified_base (386)..(386): a, c, t, g, unknown or other
  misc_feature (386)..(386): n is a, c, g, or t
  modified_base (443)..(443): a, c, t, g, unknown or other
  misc_feature (443)..(443): n is a, c, g, or t
tcagactactatgtcacgaccggtgctcgatttagtgtgagtagtttgggtttggggagaggagcccagcactagaagtcggcggtgtttccattcggtgatcagcactgaacanagaggactcacatggagtttgggctgagtcgttgggttttcctcgtcgtcttacgttttaaaggaggtgtccaggtgtcgaggggcagcgtgggtggagtcggtgggggcgcgtcggtaccaaccggtgggacggtcctggacgtactcgtccgtggtcgccggtccctaccgtattacctaccttactaaacttacttagtcggactagtcgacgtaccggttcgggccccacgagggtccctaccggaaggcggaaggggtctaggggngggtcggggtcgccgtattagtcgtttagtagtagtaaggtaataactataatagtnagacacggtacgtcggtaggacggtccgtaacactatccgacgagacaactaacttaccaaattactacttcgttgttacacgtaactaaacgtcgtaacctcggtcctagtacgttaacgtcggtaacgggaacgtaaccgtcccgggttactttacggttacctttaacggttacgtacgggtaaccgtaaacccgttaaaccgggttcccccgttttaaccccccggttaacctttacgggttaaaccgggtttacggttttaccccggggtttacccgggtaccccccgttaaacccgttaccggttacgggttccggggttaaacccgggg

SEQ ID NO: 157672 - DNA, 277 bp, Homo sapiens
  misc_feature: GYAE6OF01DH3Q6.24.78.H01.1.454.CMB.1.raw
  modified_base (262)..(262): a, c, t, g, unknown or other
  misc_feature (262)..(262): n is a, c, g, or t
  modified_base (270)..(277): a, c, t, g, unknown or other
  misc_feature (270)..(277): n is a, c, g, or t
tcagactactatgtcacgaccggtgctcgatttagtgtgagtagttgggtttgggacagacttcactctcatcatcgacagactggagcccgaagattttgcagtgtattactgtcagctgtttggtccctctcctcctatgtactacttttggcctagggttccaggctggagatcaagcgaactggtggctgcaccatcgtgtcttcattccttcccgcatctgaactatagtagtctggaggtcgggctggcaagggcnctaatagnnnnnnnn

SEQ ID NO: 157673 - DNA, 878 bp, Homo sapiens
  misc_feature: GYAE6OF01DB3IR.24.78.H01.1.454.CMB.1.raw
  modified_base (175)..(175): a, c, t, g, unknown or other
  misc_feature (175)..(175): n is a, c, g, or t
  modified_base (291)..(291): a, c, t, g, unknown or other
  misc_feature (291)..(291): n is a, c, g, or t
tcagactactatgtcacgaccggtgctcgatttagtgtgagtagtttgggtttggggagaggagcccagcactagaagtcggcggtgtttccattcggtgatcagcactgaacacagaggactcaccatggagtttgggctgagcttgggttttcctcgtccgcttcttttaagnggtgtccagtgtcaggggcagctggtggagtcgtgggggcggcgtggtccaaccgtgggacggtccctgacgactctcctgtcgccggcctcccgattccaccttcaatacttagnggcatgcactcgggtccgccaggctccgaaggcgaaggggctggaggtggggtcggccgtcttattctttagtttaggattagggaaattaatactaaattaattagtgctaagaccttaccggtagggaaacggggcccggtttacaccctaagttccctaccaacgtacgtaaacctaaacgttaacccctaaacgtaaacttaacctttacgtttacggtttttaccgttacgtaaccgttaaaacgttaccggttaaaccgtttaaccggtacccgttacggtaacccggtaaacgtttacccgtacgggtaaaccggggtaacccggtaaccggggttacccgtttacggtttacccgttttaaacgtttaacccgtttacgggttaccgtaaacccgggtaaaaaccggtttaacccccggtttttacccccccccggggtttacccccttttttaacccggtttaaacccggtttaaaccggtttttaaaccgggttttacccgggggggtttaaccccgggtaaccccccccccggttttaaaccggtaaccggtttacccgggggttaaaccccgggg

SEQ ID NO: 157674 - DNA, 725 bp, Homo sapiens
  misc_feature: GYAE6OF01DMFDL.24.78.H01.1.454.CMB.1.raw
  modified_base (238)..(238): a, c, t, g, unknown or other
  misc_feature (238)..(238): n is a, c, g, or t
tcagactactatgtcacgaccggtgctcgatttagtgtgagtagtttgggtttggcacgaccggtgctcgatttagtgtgagtagtttgggttggggagagctgctcagttaggacccagagggaaccatggaaaccccagcgcagcttctcttcctcctgctactctggctcccagccatcaccggaggtaattgtgtgacgcagtctccaggccacctgtctttgctcgagggganagacgccaccctctcctgcgacgggccagtcagagtgttagcacgcagctactacgcctaggtaaccagacgaacgaaaccgtcggacctcggcctcccgaggcctcctcacttccgtagtcggtcgccgtcccgaccgtacggcctacgtcggaccggtcggaccggtacgtacggttacgaggtacggcgtaggtcgggtcgtttacgggacgtaacgtaccgttcctaaccttccgtactactaccaacgttaccgaacgtacggtacgtacgggaaccggtacccggtaaagttacgttttacggtacgttaacggttacgtttaacgttaccgtggttaccgtacgttccggtttacggttttcccgggttccccttacccgtttaccccttaccttaacgtttaccggtttaaccgtttaccggtttttccgggtaccccggttacggggtttacccggtagggttcccggttaaccgggg

SEQ ID NO: 157675 - DNA, 581 bp, Homo sapiens
  misc_feature: GYAE6OF01C1JOI.24.78.H01.1.454.CMB.1.raw
  modified_base (311)..(311): a, c, t, g, unknown or other
  misc_feature (311)..(311): n is a, c, g, or t
  modified_base (386)..(386): a, c, t, g, unknown or other
  misc_feature (386)..(386): n is a, c, g, or t
  modified_base (404)..(404): a, c, t, g, unknown or other
  misc_feature (404)..(404): n is a, c, g, or t
  modified_base (427)..(427): a, c, t, g, unknown or other
  misc_feature (427)..(427): n is a, c, g, or t
  modified_base (458)..(458): a, c, t, g, unknown or other
  misc_feature (458)..(458): n is a, c, g, or t
  modified_base (506)..(506): a, c, t, g, unknown or other
  misc_feature (506)..(506): n is a, c, g, or t
tcagactactatgtcacgaccggtgctcgatttagtgtgagtagtttgggtttggggagaggagcccagcactagaagtcggcggtgtttccattcggtgatcagcactgaacacagaggactcaccatggagtttgggctgagcttgggttttcctcgtcgcttcttttaagaggtgtccagtgtcaggggcagctggtggagtcgtgggggcggcgtggtccaaccgtggggaggtccctggacgactctcctgtgccggcctcccgattccacctttcaatacttagtggccatgcacgtgggtcccnccgaggctccgaggcgaaggggtctgggaggtggggtggccgtatattcttattggataggaattatacaaattnttatgactagactccggnggaacgggtccgttacaccatcncagacgacaactcaaacatactctgtttcanactaatgactacgctgcgtatcagagactcggctagtctatactgtanacgaaacgttcctccccgtacctttacgttacgtagtttcggttcggggtaccgtcccctaagtgtggtaaccgg

SEQ ID NO: 157676 - DNA, 712 bp, Homo sapiens
  misc_feature: GYAE6OF01AXT7Y.24.78.H01.1.454.CMB.1.raw
  modified_base (646)..(646): a, c, t, g, unknown or other
  misc_feature (646)..(646): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatcggaaaccccagcgcagcttctcttcctcctgctactctcggctcccagccatccgaccggagtaattgtgttgacgcagtcctccgacggcctacccttgttccttttcgtccgtccgagggggtagacgtaccgcccacccctcgtccgtgaccgacggaaccagtacgaggtagttgtaacgcagcagtctacgtacgtccgtacggtaaccacgactaacggaacctcggcctcggcctacccgaggcccttctactattcgtagtcggtcgccgtaccgacggaccggcctacggtcgaccggccggacggtaccgtaggttacgaggtacggacggtacggtcgggttacggttacgggtacgtacgtaccttaccgtactacgtactactacgtacgtacgtacgtacgtacgtacggtaccgacgtaacgttacgttacgtacgtagttagttacgtacgttacgtcgtagttcgttacgtttccgttccgttccgttaccgttccnccgtttttttttttttttttacgactttaccgtttccgtacggttaccggtacgtcggtcgtacgg

SEQ ID NO: 157677 - DNA, 724 bp, Homo sapiens
  misc_feature: GYAE6OF01DKU8O.24.78.H01.1.454.CMB.1.raw
tcagactactatgtcacgaccggtgctcgatttagtgtgagtagtttgggtttgggggaggagcccagcactagaagtcggcggtgtttccattcggtgatcagcactgaacacagaggactcaccatggagtttgggctgagcttcgggtttttcctcgtcgcttcttttaagaggtgtccagtgtcaggggcagctggtggagtcgtgggggcgcgtggtcccaaccgtgggacggtccctgacgtactctccgtgtcgccggccctccgattccaccttcaatacttatggcatgacacgtgggccctaccgacggcctaccgagggaccgaagggggtctaggggaggtggggtcggccgcttagtttcgttaagttttgaagttagggtaaagttaatctaaagttactttatggacaacgtaccgtccggtagggaaccggggtccggttaccaacgtacttccgtacgagaacgaacctaaaccgttaccaaaactaacgttactacctttacgtttactacgtaataaacgtacgtaacctacgccgtacgtcgtacgtactacggacggaccgtcgtcgttagttcttacgttacgttgtacgtaccggaaagttacccgtttcccccggtaccctttaccgttaacggttaacgtttcggttaccgggggttacccgtaccccgttacggtacgtccgggtcggttaaccgggg

SEQ ID NO: 157678 - DNA, 897 bp, Homo sapiens
  misc_feature: GYAE6OF01CM0J7.24.78.H01.1.454.CMB.1.raw
  modified_base (155)..(155): a, c, t, g, unknown or other
  misc_feature (155)..(155): n is a, c, g, or t
  modified_base (171)..(171): a, c, t, g, unknown or other
  misc_feature (171)..(171): n is a, c, g, or t
  modified_base (516)..(516): a, c, t, g, unknown or other
  misc_feature (516)..(516): n is a, c, g, or t
tcagactactatgtcacgaccggtgctcgatttagtgtgagtagtttgggtttggggagaggagcccagcactagaagtcggcggtgtttccattcggtgatcagcactgaacacagaggactcacagtggagttggctgagtcgttggtttccncgtcgcttctttaagnggtgtccagtgtcgaggggcaggcgtggtggagtcggtgggggcgacgtggtaccaacggtgggacgtcctgaagtctcgtcctgtcggccggccctaccgtattcctaaccttctaaaagttcttagcggactagtcgaccgacggttcgggccccgacgagggcccttaccgaaggggacgtaacgggggccttagggtacggggtcggggtcgcccggtatttaacgttccgtttaagttacgggacgttaaggggttaaactaaacgttacgtaaattttaagtaacggtcgaacgtacggttaccgtaccggggttaagaacccggggtttcccgttaanaacccgtacgtttacccgaacccggtaaacgtaaaccgtaaaccgttaaaaccgttaaaccgtaaaacctttaaaacccggtttaccctttaaccggttttacggttttaaccggtaaaccggttaaaacttaaacggtaaccgttaaaccgttaacggttaccgttaaccgggtaacgttaccggtacggttaccggggaaaccggtaccgtaaccggggttactttacggtaaccttaacggtttaacgtcggtaaaccggtaccggtaaaaccgtttccccggttaccccggttaccgtttaaccggttaaccggttaacgtttacgggtacccgggttacccgtaccccgttacgtcgggttaccgggtaacccggg

SEQ ID NO: 157679 - DNA, 688 bp, Homo sapiens
  misc_feature: GYAE6OF01B8K54.24.78.H01.1.454.CMB.1.raw
  modified_base (310)..(310): a, c, t, g, unknown or other
  misc_feature (310)..(310): n is a, c, g, or t
  modified_base (354)..(354): a, c, t, g, unknown or other
  misc_feature (354)..(354): n is a, c, g, or t
tcagactactatgtcacgaccggtgctcgatttagtgtgagtagtttgggtttggggagaggagcccagcactagaagtcggcggtgtttccattcggtgatcagcactgaacacagaggactcaccatggagtttgggctgagcttgggttttcctcgtcgctcttttaagaggtgtccagtgtcaggggcagctggtggagtcgtgggggcggcgtcggtccaaccgtgggacgtccctgagactctcctgtcgccggcctccgattccaccttcaattacttatcggctatgcctacgtgggtcccnccaggcctccgaggcgaaggggctgggagtcggggtggcccgtnttattcgtttatttggattagggaaattaatacgaaattattagtgactaagtaccttccggtaggaacggggtcccgttacaccgtatcctaccgaagacgtaactaacttaccaaactaacttacttctttacgtttactacgtaactaaacgtacgtactacgtacctacgtacgtacgttacgtaggtacggtacgtacggtcttacgtacttagttacgtgtacgacgtaaacgtacccgtttaccccggtaccctttacgttaccgttaagtttacggttaccggggttacccggtacccccgttaacgtacggttcgggtaaccggg

SEQ ID NO: 157680 - DNA, 648 bp, Homo sapiens
  misc_feature: GYAE6OF01BG7HW.24.78.H01.1.454.CMB.1.raw
  modified_base (282)..(282): a, c, t, g, unknown or other
  misc_feature (282)..(282): n is a, c, g, or t
  modified_base (318)..(318): a, c, t, g, unknown or other
  misc_feature (318)..(318): n is a, c, g, or t
  modified_base (341)..(341): a, c, t, g, unknown or other
  misc_feature (341)..(341): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaacccagcgcagcttctcttcctcctgctactctggctcccagccatcacggaggaattgtgttgacgcagtctccaggcaccctgtctttgtcgtccgaggggagagacgcccaccctctcctgccgagggccagtcagagtgttancgagcagctactacgcctggtaccagcagtaaaccncggcctggcctccgaggcctccncattctagtggtcgccgtaccaccggacggtccacgtcggcggtcggacggtacgaggttccagggtggaccgtaggtgggtccgtttagggactaaggttctttccgaccttcctaccacctagacccgtacggccgtccctccgattacgtacggtaattagttttccgaactttactttttaccgtttctacggttaacaacgtagttacgttaggtacgtaccgtccggtacccttacggttacttccggtttaacgggtacccgtaacgggtaaccctaaggtcggacgtacgtaaacccgg

SEQ ID NO: 157681 - DNA, 802 bp, Homo sapiens
  misc_feature: GYAE6OF01ELTYM.24.78.H01.1.454.CMB.1.raw
tcagactactatgtcacgaccggtgctcgatttagtgtgagtagtttgggtttggggagaggagcccagcactagaagtcggcggtgtttccattcggtgatcagcactgaacacagaggactcaccatggagtttgggctgagctgggttttcctcgtcgcttcttttaagaggtgtccagtgtcaggggcagctggtggagtcgtgggggcgcgtggtccaacgtgggagtccctgagctctcctgtgccggcctccgattccaccttcaatacttatggcatgcacgtcgggtccgccgaggcctccgagggcgaagggggtctgggaggtggggtgctagtttgtttggttgagtaggaacttatagtaatacgtaatgactaggacgttccggtaggaacgggtcccgtaagtttacccaaccgtacgttcccgtaccgtaacggtaacgtaaaccgtaacgttttacccggaaagggttaaacgtttaacggtttttttaacgtaacgttttaccgtttacggtaaacgtttacgttaacggtaaaccgtaacggttaacccgttagggtaaacggtaaacggttaaccggggaaacgggtaaacccgggtacggtaaccgttttaacgttacggtttaacgttttaacggtcgggtttaaccgggtacggtaaaacggttaagggaaaaacggtccggtaaaggggttaacggggtaacggtttaacggggtttaacggggaaggggtttacgggggtaaccggttccggtttacggaacggggtttacccgggg

SEQ ID NO: 157682 - DNA, 589 bp, Homo sapiens
  misc_feature: GYAE6OF01BVOAV.24.78.H01.1.454.CMB.1.raw
  modified_base (245)..(245): a, c, t, g, unknown or other
  misc_feature (245)..(245): n is a, c, g, or t
  modified_base (438)..(438): a, c, t, g, unknown or other
  misc_feature (438)..(438): n is a, c, g, or t
  modified_base (448)..(448): a, c, t, g, unknown or other
  misc_feature (448)..(448): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggctcccagatgccaccggagacattgtgttgacacagtctccagcccaccctgtctttgtctccaagggggaaanacgcccaccctctcctgcagggccagtgactaagtgttaaggaagttgtagcctggtatcaaacacaaacatggccaggcctccccggctcctcatctatgatgcataccaagtcgggccacgtggactactcccgaagacctaggttcaggtggacgtaggtcgggtcgtggacagtacttcactctcaccntcagctagtntagacgtctagtaagtagtttcgacgttaagtttacttactgtacgagccgtacgtcgaacctaacggtccgtaccccttacggtttcccggacccgttacgggaaccctacggacgtacggacctacgtacccgtaaacg

SEQ ID NO: 157683 - DNA, 904 bp, Homo sapiens
  misc_feature: GYAE6OF01EOD17.24.78.H01.1.454.CMB.1.raw
  modified_base (105)..(105): a, c, t, g, unknown or other
  misc_feature (105)..(105): n is a, c, g, or t
tcagactactatgtcacgaccggtgctcgatttagtgtgagtagttttgggtttggggagagctgctcagttaggacccagagggaaccatggagccccagctcngcttctcttcctcctgctactctggctcccagatgccaccggagacattgtgttgacacagtctccagcccaccctgttctttgtcctaccgaaggggaaagcgcccaccctctccgtgcacgggccagtcgaactagttaggtaggtaagtttggtacgtcgtaggtactaaccaacaacaaacagtcggaccgacgcccgtcccggcctccttacacttacatagtgtactcgtactaacgtacggaacttaacggggcccaactcggtcccgaaagtacccccgaagggtaacctaagggggtttccaacggttaggggtccgtaaggttcggggggtaccttacgggggtaaccctaacggaccttttacccaacccgttaccttaccgaacccgtaacgttacccgaaggttaccgtaagggtaccgtttaacgggtaaacggtaacccgttttagggtaacgtaacgttttttaacggtaacctttaacggttttaacgtttaacccgttaacggtacccgtaacgggttacccgtaaacccggtttaccgggtaaccccggtaaaccccgttttacccgggggtaccccccttacccgggttttaaccccgggtaacccccggtttaccgggggaaacccgttacggaaacccgttaccggtaaaaccccgtaaaccggttccccgttaaaaccggggtaacccgtttcccgggttacggtaccccgtttaccgaaccccgtttaaccccgtaaccgttttcccctttaacggtttcccccgttttaccccg

SEQ ID NO: 157684 - DNA, 637 bp, Homo sapiens
  misc_feature: GYAE6OF01A71OS.24.78.H01.1.454.CMB.1.raw
  modified_base (242)..(242): a, c, t, g, unknown or other
  misc_feature (242)..(242): n is a, c, g, or t
  modified_base (339)..(339): a, c, t, g, unknown or other
  misc_feature (339)..(339): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggctcccagccatcaccggagaattgtgttgacgcagtctccaggccaccctgtctttgtcctccgagggganagacgcccaccctctccgtgcagggccagtcagagtgtagcagcagctactagcctggtaccagcaagaacctggcctggactaccgaggcctcctnattctagtcggtcgccgtccaccgagggccctacgtcggccgtcggcggacgtggttcaggtcggctaggtcggtcgtttagggactacgtaccttcacttctcatcactcgacagtacgtggaccgaccgtaagttacgtttacggacgtaaggttcgttaactttacgtacgtacgtacgttccgtttacggtttccggttccccgttcttccccgtttaccgttacgttaccggttaacctttacggttttaccgggacccgtttaacgggtttcccgacgggttcgtaacgggg

SEQ ID NO: 157685 - DNA, 622 bp, Homo sapiens
  misc_feature: GYAE6OF01DWGF9.24.78.H01.1.454.CMB.1.raw
  modified_base (334)..(334): a, c, t, g, unknown or other
  misc_feature (334)..(334): n is a, c, g, or t
  modified_base (341)..(341): a, c, t, g, unknown or other
  misc_feature (341)..(341): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgtctccgaggggagagacgccaccctctcctgcagggccagtcagagtgtagcagcagcctacttagcctggtaccagcaagaacctggcctggcctccgagctccncatctangctgtcctccgaccgacgggtcccctaggtcctcccagccgtaggttcgtgggtcggtggtcgtcgggacagtacttcactcgtactacgtactcgacgtccgtcctccgtagtcgtagtacgttacgtttcgtacttacttttacgtttcttacgttacctaactacttaagtggttacgtaccgtcggtcccgttaccgttaaccttccggttttacggacccggtaaggggtaacccgtaaacgtacgggtaacgtaacttaccgaaacgttaaacgg

SEQ ID NO: 157686 - DNA, 660 bp, Homo sapiens
  misc_feature: GYAE6OF01BPFVY.24.78.H01.1.454.CMB.1.raw
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggctcccagccatcgaccggaggaattgtgttgacgcagtctccaggccacctgttctttgtctccgaggggagagacgcccaccctctccgtgcacgggccagtcagagtgtagcagcagtctacttacgcctggtaccagacaagaaccgtggcctggccctcccgaggtcctcctctacttcgtagttcggtcgtccgtcccgaaccgacggggcctacggttcggccgtcggacggtacgtaggttcgaggttcggcgtaggtcgggtcgtttgggactacgtacttacgtacctcgtctacgtctagtaccgacgaacgtacgtcggaccgtacccggtaagttacgtttacggacgtagttacgttaatttacgtcgtaccgtgtccgtttcggtttccggttcccgttccgttcccttacgttacgttccgttaaccgtttaccgttttcgggccgttacggggttccgtacgggtcgtacggg

SEQ ID NO: 157687 - DNA, 758 bp, Homo sapiens
  misc_feature: GYAE6OF01EZSLE.24.78.H01.1.454.CMB.1.raw
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgttctttgtcctccgaggggagagacgcccaccctctccttcgagggccagtcagtagtgtagcagcagctacttacgcctggtacagcaagaaaccgtggcctggcctcccgaggcctcctctactctagtcggtcgccgtacccacgacgggcccaggtcgggccggtccgacggtacgtacgggtttcaggttggacgtaggttcgggtcgtttagggactacggtacttaccgtactctactactctactaccgacgtaacgtaccgtacgggaaccgtaccccggtaaaggttacgtttttacggacgtagggtttaacgtttaacgttttaccggttacggttaccgttaacggtttccggttttcgggtttttaccccgggtttacccccttttacccgtttcccccgtttaacccggtttaccgtttaaccggttttaacccgtttaacccgggttttttcccgggtaccccgggtttaaccgggggttaccccggtaaccggggttaccggttacggggttaaaccgg

SEQ ID NO: 157688 - DNA, 698 bp, Homo sapiens
  misc_feature: GYAE6OF01EFBNH.24.78.H01.1.454.CMB.1.raw
  modified_base (293)..(293): a, c, t, g, unknown or other
  misc_feature (293)..(293): n is a, c, g, or t
  modified_base (312)..(312): a, c, t, g, unknown or other
  misc_feature (312)..(312): n is a, c, g, or t
  modified_base (351)..(351): a, c, t, g, unknown or other
  misc_feature (351)..(351): n is a, c, g, or t
  modified_base (388)..(388): a, c, t, g, unknown or other
  misc_feature (388)..(388): n is a, c, g, or t
tcagactactatgtcacgaccggtgctcgatttagtgtgagtagtttgggtttggggagaggagcccagcactagaagtcggcggtgtttccattcggtgatcagcactgaacacagaggactcaccatggagtttgggctgagcttgggttttcctcgtcgcttcttttaagaggtgtccagtgtcagggggcagctgggtggagtcgtggggggcgcgtggtccaaccgtggggacggtccctggagacctctcctgtcgccggcctcccgattccaccttcaatacttanggcatgcacgtgggtccanaggctccgaggcgaaggggctgggacgtgggtcgccgtntagtcttagttgataggtaatatactaaattattagngcaagtactcggtaggaacgggtcccgttacacctagtcctacgaagacgaactaactttacccaaactaacttaccttcgttcgttttaccgtacgtactaaagttcggtaaccttacggtcccgtgggacgtacgttaccggtgggaaccgtacgtaaccggtcgttacgttaccttaagttaccgttggtacgtaaccgtaaacgttccccgttacccccggttaccctttaccggttaaccggtacgttttacgggttacgggggtccccgttaacccccgttagtaccggttccgggtacccggg

SEQ ID NO: 157689 - DNA, 799 bp, Homo sapiens
  misc_feature: GYAE6OF01C7N5U.24.78.H01.1.454.CMB.1.raw
  modified_base (246)..(246): a, c, t, g, unknown or other
  misc_feature (246)..(246): n is a, c, g, or t
  modified_base (251)..(251): a, c, t, g, unknown or other
  misc_feature (251)..(251): n is a, c, g, or t
  modified_base (263)..(263): a, c, t, g, unknown or other
  misc_feature (263)..(263): n is a, c, g, or t
tcagactactatgtcacgaccggtgctcgatttagtgtgagtagtttgggtttggcacgaccggtgctcgatttagtgtgagtagtttgggttggggagagctgctcagttaggacccagagggaaccatcggaaaccccagcgcagcttctcttcctcctgctactctggcctcccagccatcgaccggaggattgtagttgacgcagtctccgaggccaccttgttcttgtccgtcgagggganagacnccacctctccgngcgacggcctagtcaagtgtacgtacgcacgcgagtaccttacgtagccgttacggtaccacgacgaacggtaaccgcggaccgtcggaccctaccgacggtccctacctaccacgtactacgtcggtccgccgtacccaacccgggacgggtaccctaggtccgggccggtaccgggacggtaaccggtacggttcgtagggtaccggtacggtacgggttcgggtaccgggtttacgggaactaacggttaccctttaccgtacgtttacctaccgttactacgtaaccgttaccggaaccgtaacggttaccggtaaccgggtaaccgggtaacccgttaaaggtttacgttttacggaaccgtttagggttaccgttaacgtttaccgttacgttacgtaccggtttaccgttccgggttttaacccgtcccgtttaaccgttccccgtttacgttacgtttaccggttacccgttttaccggttttaccgggttacggttacccggggtttacggtcgttgggtaaacggg

SEQ ID NO: 157690 - DNA, 746 bp, Homo sapiens
  misc_feature: GYAE6OF01DWPLA.24.78.H01.1.454.CMB.1.raw
  modified_base (172)..(172): a, c, t, g, unknown or other
  misc_feature (172)..(172): n is a, c, g, or t
  modified_base (305)..(305): a, c, t, g, unknown or other
  misc_feature (305)..(305): n is a, c, g, or t
  modified_base (347)..(347): a, c, t, g, unknown or other
  misc_feature (347)..(347): n is a, c, g, or t
  modified_base (377)..(377): a, c, t, g, unknown or other
  misc_feature (377)..(377): n is a, c, g, or t
  modified_base (394)..(394): a, c, t, g, unknown or other
  misc_feature (394)..(394): n is a, c, g, or t
tcagactactatgtcacgaccggtgctcgatttagtgtgagtagtttgggtttggggagaggagcccagcactagaagtcggcggtgtttccattcggtgatcagcactgaacacagaggactcaccatggagtttgggctgagctgggttttcctcgtcgctcttttaagnggtgtccagtgtcagggggcagctggtggagtcgtgggggcggcgtggtcccaaccgtgggacggtccctgacgactctcctgtgccggcctcccgattcacttcaatacttatggcatgcacgtcgggtccnccaggcctccgaggcgaagggggctgggaggtgggtcggccntatctttattgatggaaagtatcgaaattntatgactacgctccggnggaacgggccggttacaccgtatccctacaagtacgaactaacttacccgaaactaacttacgtactttacggttacttagaaaccgtaaagttacgtaacccgtttaacgaccccgtttagggacccggttaactaccggttacgggaacgggtaaccgaccgggttccgttaggttacctttaacgtttaccggtttaggttaccggtaaaccgggtaaacgttaccccggtttacccccccgggttacccttttaccggtttaaacccggttagtttttaaaccggggtttccgggggttaacccggtacccccccgttaacgttaccggttccggggttaaacccggg

SEQ ID NO: 157691 - DNA, 629 bp, Homo sapiens
  misc_feature: GYAE6OF01A3ABC.24.78.H01.1.454.CMB.1.raw
  modified_base (241)..(241): a, c, t, g, unknown or other
  misc_feature (241)..(241): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgtctccgagggganagacgccaccctctcctgccagggccagtcagagtgttagcagcagctactagcctaggtaccagcagaacctggcctggcctacccgaggcctcctacattcctatcgggtcaccgtccaaccgagggcccacgtggccgtcgacggactaggttcaggtgggcaggtcggtcgtttcgggactacggtacttacgactctactactacgactacgacgagtacgtcggaacgtacccgtaagtacgtttacgacgtagttacgttaacttacgtggtacctacgtcgtttcggtttaccggttccccgttacgttcccttaccgttacgttcgttaccgttaccgttttacggtacccggttagggttcccgtaggtccgtacggg

SEQ ID NO: 157692 - DNA, 612 bp, Homo sapiens
  misc_feature: GYAE6OF01AN8MW.24.78.H01.1.454.CMB.1.raw
  modified_base (316)..(316): a, c, t, g, unknown or other
  misc_feature (316)..(316): n is a, c, g, or t
  modified_base (337)..(337): a, c, t, g, unknown or other
  misc_feature (337)..(337): n is a, c, g, or t
  modified_base (349)..(349): a, c, t, g, unknown or other
  misc_feature (349)..(349): n is a, c, g, or t
tcagactactatgtcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgtctccaggggagagagcccaccctctcctgcagggccagtcaggagtgtagcagcagctacttagcctggtaccagcagaaacctggcctggcctcccgaggcctcctcatctatggtgcgtccaccgnggccacgtggcgtcgcggacnggttcagtggcnggtggctttgggacagtacttcactctcatcatcgacagactgggacgacccgaagttagttttcgacgtagttagtacttacgtgtctacggtcgtttacggtttccggttccccttccttcccgttaccgtttacgttacggtttaaccttacgtttttccgggccgttacggggttccctacgggtcgttacgggacgtacgtacgaaccgtaccggtaacgttcggtcgggtaccttacggacctaacccggtattccg

SEQ ID NO: 157693 - DNA, 533 bp, Homo sapiens
  misc_feature: GYAE6OF01A25P8.24.78.H01.1.454.CMB.1.raw
  modified_base (199)..(199): a, c, t, g, unknown or other
  misc_feature (199)..(199): n is a, c, g, or t
  modified_base (489)..(489): a, c, t, g, unknown or other
  misc_feature (489)..(489): n is a, c, g, or t
  modified_base (530)..(530): a, c, t, g, unknown or other
  misc_feature (530)..(530): n is a, c, g, or t
tcagactactatgtcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgtctccagggganagagccaccctctcctgcagggccagtcagagtgttagcagcagctacttagcctggtaccagcagaacctggcctggcctccgaggcctcctcatctatggtcgccgtccaccgacgggccacgtggcgtcgcggacaggttcaggtggcagtcggctttgggacagtacttcactctcatcatcgacacgacgtaggacgacccgaagtatttcgctagtgtattacgtgtcagtctagtttcggtcccttctcctctattcgtacttcgtttcggccgtcgggtcgnggtcgtggagtatacgagacgtaacgtgtcggctgctcgtntcg

SEQ ID NO: 157694 - DNA, 717 bp, Homo sapiens
  misc_feature: GYAE6OF01BC3NP.24.78.H01.1.454.CMB.1.raw
  modified_base (242)..(242): a, c, t, g, unknown or other
  misc_feature (242)..(242): n is a, c, g, or t
  modified_base (611)..(611): a, c, t, g, unknown or other
  misc_feature (611)..(611): n is a, c, g, or t
  modified_base (702)..(702): a, c, t, g, unknown or other
  misc_feature (702)..(702): n is a, c, g, or t
  modified_base (711)..(711): a, c, t, g, unknown or other
  misc_feature (711)..(711): n is a, c, g, or t
tcagactactatgtcacgaccggtgctcgatttagtgtgagtagtttgggtttggcacgaccggtgctcgatttagtgtgagtagtttgggttggggagagctgctcagttaggacccaggagggaaccatggaaaccccagcgcagcttctcttcctcctgctactctggcctcccagccatcacggagattgtgttgacacagtcctccgaggccacctgttctttgctccgaagggganagacgcctaccctctcctgcagggcctagccggtagtgtagtaagtacgttaggctacggtaaccaacgaacgaaaccgtggacctaacgggcccttacccgacggtcccttacctactaacgttacctagttaggtacgttacggtacctacccgtaaaacggtaccggggtaccctaacgttaccgggggacccccgttccccggaccgtacgggttacacggtggtaccgagggtttcgggtacgtacggggactacggtaccttcgacctctcccgaacgtccgagccgacgccgtaagaccgtaccttagtaagttcgttttacggtcgtttaactcgtgtacgcgtcgtacgtcccggttacncccggtggccgttaacgttaccgggttcgggggaacccggggtaccggaggggttaggaggtaacgggacggtaacgtgtcggaggttacncgtacccgnttacgg

SEQ ID NO: 157695 - DNA, 598 bp, Homo sapiens
  misc_feature: GYAE6OF01ECFOQ.24.78.H01.1.454.CMB.1.raw
  modified_base (428)..(428): a, c, t, g, unknown or other
  misc_feature (428)..(428): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagaggaaccatggaaaccccagcgcagcttctcttcctcctgctactctggctcccagccatcaccggagattgtgttgacgcagtctccaggcaccctgtctttgctccgaggggagacgacgcccaccctctcccgtgccacgggccagtcagtagtgtagcagcacgtctacttagccttggtaccagcaagaaccgtggcctaggcctccgagcctcctcactctagtggtcgcgtccacgacggcacgtgggctcggcgagtggtacaggtcgctaggtggtcgtttgggacctagtaccttcncttcgctatctactcgacagacgtggacgccggtaagttctttgaccgtagttgttacttacgttgtacgtcggtgtttcggttccgttccccgttcttcccgtacctttagttaccgttactttacggtttccgtacccggttagggttaccccgtggttcgtaacggg

SEQ ID NO: 157696 - DNA, 892 bp, Homo sapiens
  misc_feature: GYAE6OF01EZQF0.24.78.H01.1.454.CMB.1.raw
  modified_base (224)..(224): a, c, t, g, unknown or other
  misc_feature (224)..(224): n is a, c, g, or t
  modified_base (319)..(319): a, c, t, g, unknown or other
  misc_feature (319)..(319): n is a, c, g, or t
  modified_base (483)..(483): a, c, t, g, unknown or other
  misc_feature (483)..(483): n is a, c, g, or t
tcagactactatgtcacgaccggtgctcgatttagtgtgagtagtttgggtttggggagaggagcccagcactagaagtcggcggtgtttccattcggtgatcagcactgaacacagaggactcaccagtggtaggtttgggctgagtcgttcgggttttcctcgtcgtcttacgttttaaggaggttcgtccaggttggtcgaggggcaggtcgtgggtaggnggtcggtgggggcggtcggttcggtacccaacggtggggacgtccctggacgtccttctccgtgtcgccggtcccttccgtacttcctaccttanaaacttactttagcggactagtcggcctaccgggtcggggtccccgaccgagggtcctaccggacgggtacggaggggtcgtaggggagggttcgggcggcctagttacgtttctttaaggttgaacgtaaggtaaacgttaactactaaagtttagttaacgngaccgtaacgttacccgtacgggtaaggggtaacccgggttcccttacgaaacccttacgttacccgtaaccgtaaggtaaacctaacctaaccgtttaacccaaaacgttaacttaccgtttacgtttacggtttaccgtaacgtaaaccttaaacgtcgtaacgtaccgtcgtaggaaccttacgtacgggtacggaaccgggtacgtaccgggttccttacgttaacgtttaacggttaccgtacggggttaaacctaacccgggttaaaacccggtttccccggtttacccccccggtttaacgttttacccggttttaaacggttacccgggttttacgggttacccccgggggttaccccgtaccccgtttaacgggttaaccggtcggggttaaccccgggg

SEQ ID NO: 157697 - DNA, 731 bp, Homo sapiens
  misc_feature: GYAE6OF01B5OL2.24.78.H01.1.454.CMB.1.raw
  modified_base (242)..(242): a, c, t, g, unknown or other
  misc_feature (242)..(242): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggcctcccagccatccaccggaggaattgtgttgacgcagtctccgaggccacctgtctttgctcgagggganagacgcccacctctaccgtgcgacggccagtcagtagtgttagcagcgagctacgttacgcctaggtaccagtacaacgtaaccgtcggtaccgtcggcccgtcccgaggtccctccgtactactacgtacgtcggtccgtaccgtaccgaacggacggtaccgtcggtcggtccggtaccggaccggtaacggtacggttacggacggtcggtacggtacgggtcggttacggttgggaacctcggttaactccgtacccgtgtactacgtaccgacgtaccgaacggtaacgggtacgtaacggaacccggtaaccggtaaacgtttacgtttacggaagttaccggttagttttaaccgtcgttagtacgttcgttcggtttaaccggttccgtttcccgttaccttaccgttacggttacctttacggttacccggttttacgtttcgggaacccggtttacgggtaccgtggtaccggtaaggg

SEQ ID NO: 157698 - DNA, 583 bp, Homo sapiens
  misc_feature: GYAE6OF01D5KJ7.24.78.H01.1.454.CMB.1.raw
  modified_base (241)..(241): a, c, t, g, unknown or other
  misc_feature (241)..(241): n is a, c, g, or t
  modified_base (272)..(272): a, c, t, g, unknown or other
  misc_feature (272)..(272): n is a, c, g, or t
  modified_base (275)..(275): a, c, t, g, unknown or other
  misc_feature (275)..(275): n is a, c, g, or t
  modified_base (572)..(572): a, c, t, g, unknown or other
  misc_feature (572)..(572): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggccaccctgtctttgtctccagggganagagcccacctctcctgcagggccagtcagngtntagcagcagcctacttagcctggtaccagcaaggaaacctggccctggcctcccgaggcctcctcaatctagtggtcgccgtacccaccgcgggccctacgtcggccgtcgacggacgtacggttcaggtggctaggtggtcgtttgggactagacttcactctcatcactcgacacgacgtcggacgaccgaagtatttcgctagttagttacttacgtgtacgagtcgttcgtttcggttccctccttccgtaccttatccgttacttacgttttcggaccgttagggttcccgngggtctacggg

SEQ ID NO: 157699 - DNA, 613 bp, Homo sapiens
  misc_feature: GYAE6OF01CABBT.24.78.H01.1.454.CMB.1.raw
  modified_base (200)..(200): a, c, t, g, unknown or other
  misc_feature (200)..(200): n is a, c, g, or t
  modified_base (416)..(416): a, c, t, g, unknown or other
  misc_feature (416)..(416): n is a, c, g, or t
tcagactactatgtcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgtctccgagggganagacgcccaccctctcctgcagggccagtgaagaatgtggactagactaacttacgcctaggtacagcaacgaaacctggaccaggcctccgaggcctcctctactatcgcttgtcctccgaccgacgggccccttggcgtcccagtcccgtaggttcgtcgggcgggttggtcgtgggactagtactttcacttctccacatcacgcgcctacgngtctagtaactgttttcactttactttatttcgtacgttaccaaagtactagttggtactatcggtaccttccgtacgttacgttaggaccgaacgggtaacctaaagtgtaacgactaacgaaacgtacgtgacggtctcggactaaccgcttaccgtattccttactacctttcccgtacccgtctaagttaccg

SEQ ID NO: 157700 - DNA, 967 bp, Homo sapiens
  misc_feature: GYAE6OF01D3MSM.24.78.H01.1.454.CMB.1.raw
tcagactactatgtcacgaccggtgctcgatttagtgtgagtagtttgggtttggggagaggagcccagcactagaagtcggcggtgtttccattcggtgatcagcactgaacacagagactcaccatggtagtttgggctgagcttgggttttcctcgtcgcttcttttaagaggtgtccagtgtcgaggggcagcgtggtggagtcgtgggggcgcgtggtaccaaccgtggggacggtccctgacgactcctccgtgtcgccggtccctcccgtattccacctttcaaatttcttagtcggactagtcgctacgtcggggtcccaccgacgggcctaccgagggaccggaaacgggggtccgttggggaggttacggggtcgggacccgtacgtttaatttcgtttaagttttggaagttagggtaaagttaaatacgttaaaattacgtttaagtacggaccgtaaacggtacccgttaacggggttacggtaaaccgggggttccccgtttaaccaaacccgttaacgtttaccccgtaacccggtaaacggtaaaccggtaaaccttaaccgtttaaacccctaaaaaccgttaaacgtttaaccttacccgtttacgtttttacccgtaacggttaaacctaaaaacggttacgtaaacccgttaacggtacccgttaccggtaccggtaacgtttaccggtacgggaaacccgggttaacccggtacccgggttaacgttaccggtttaccgtttaaacgttttaacggtaacggtttacccgggaaaaccggttaaaaaccccgggttcccccggttttaacccccccgggtttaacccctttttaaccgggtttaaacccggtttaaacgggtttttacccgggtttaccccggggggttaaccccggttacccccccggtttaaacgttaccggggttaccgggtttaacccgggg

SEQ ID NO: 157701 - DNA, 969 bp, Homo sapiens
  misc_feature: GYAE6OF01ADLV0.24.78.H01.1.454.CMB.1.raw
tcagactactatgtcacgaccggtgctcgatttagtgtgagtagtttgggtttggcacgaccggtgctcgatttagtgtgagtagtttgggtttggggagagctgctcagttaggacccagaggaaccatcggaaaccccagcgcagtctttctccttcctcctgctactctggcctcccagccatccgaccggtagtactttggtgttagacgctacgttcctccgaggtcctacccttgttccgtttcgtccgtaccggaagggggacacggtaccgacccctaccccgtttcctccgtcggacgtaacgttccgggaccctaacggtaccgtaagggtacggtttaggtttaacggaccgtacggtaccgtaacgtaccgtttaaccgttaccggtcccgttaccgggtaacccacgtaaccgtaaaccggtaaacccggtcgggtcccgttccggtacccgtcccgtaacgggtcccttaccctacgttacgttaccgttacggttaccgggtcgtccccggtaaccgaacccgggtaccgggtaccccgtacgggtcgggtacccgggtccggaccgggtaacggtttaacgggttccggtacgggttacgggtaccgggttacgggtacgggttttaccgggttacgggtaaccgtttaaccggtacctttacccgtaacgttaccccgtaccaaccggttactaccggtacgtaacggttcggtaacgggttaacccggtacgttacccggttaaagggtttaaccgttttacggtttaaaccggttaccgtttttaaaggtttttacccgtaaccgggtagttaacccgtaccggtaacccggtaaccggttaccgaacccggttaacccggtttccccgtaccccggtttaaccccgggtttacccgggacccggttaaccgaccgttaaccggtaaccgttaccgaccgttaaacccgg

SEQ ID NO: 157702 - DNA, 771 bp, Homo sapiens
  misc_feature: GYAE6OF01B3V7M.24.78.H01.1.454.CMB.1.raw
tcagactactatgtcacgaccggtgctcgatttagtgtgagtagtttgggtttggggagaggagcccagcactagaagtcggcggtgtttccattcggtgatcagcactgaacacagaggactcaccatggaggtttgggctgagcttgggttttcctcgtcgcttcttttaagaggtgtccagtgtcaggggcagctggtggagtcgtgggggcgcgtggtccaaccgtgggacgtccctgagctctccgtgtcgccgcctccgattccacttcaatacttatcggcatgcacgtcggtccgcaggcctccgaggccgaaggggctgggaggtgggtcggccgtacgtagttacgttaagttttgaagttaggtaaacgttaaatactaaagttaatttagtacgacgtaaacggtacccgtttaccggtagggtaaaccgggggttccccggtttaccaaacccgtaacgttccgttaccccgaaaggtaaccgtaaacctaaactttaaccccgaaaaaccttaacttaacccgttacgtttcgttttaccgtacgtaaactaaaacgttcgtaaccgttacgtacccgtacgacgtacttacggtacggaaggtaaccgtaccggtgttaccgttattaacgtttacgtacgttacggtaaaccggtaaacggttacccgttaccccgttacccgttttacgttaaccggttagttttaccgggttacggggttacccggttacccctaagtcggtacgggtaccgg

SEQ ID NO: 157703 - DNA, 695 bp, Homo sapiens
  misc_feature: GYAE6OF01E4RFU.24.78.H01.1.454.CMB.1.raw
  modified_base (204)..(204): a, c, t, g, unknown or other
  misc_feature (204)..(204): n is a, c, g, or t
  modified_base (679)..(679): a, c, t, g, unknown or other
  misc_feature (679)..(679): n is a, c, g, or t
tcagactactatgtcacgaccggtgctcgatttagtgtgagtagtttgggtttggggagagctgctcagttaggacccagagggaaccatggaaaccccagcgcagcttctcttcctcctgctactctggctcccagccatcacggagattgtgtgacgcacgtctccgaggcctacccttgttctttgtcctccggagggganacgacgcccaccctctccgtgccgacgggccaggtcaggtagttgttagcagcagtaccttacgtacgtcccgtaggtacccaggaccgaaaggtaacccgtcgggccctcgggccctccccgacggtcctcctcacgtttcgtagtcgggtccgtccggtacccgaccggtaccgggcctacgggtcggccggtacgacggacgtaggttcgacggtcggacgtgggttcggtcggtttaggacctacggtcttacacttcatctacgatcgacagcgtacggaccgaccgtagttacttcgacgttagttagttacgttacgtcgtactacgtttcgttcgttttacccggtcccttcccgttccgttaccgttaggttcccgttaacgtttccgttcgggacccgtttaggtcccgtaggtacggttagacgttagtacggtaacgtcggtaacgttcggtacgccgttacnccctactggtttcccg

SEQ ID NO: 157704 - DNA, 755 bp, Homo sapiens
  misc_feature: GYAE6OF01D93WP.24.78.H01.1.454.CMB.1.raw
  modified_base (193)..(193): a, c, t, g, unknown or other
  misc_feature (193)..(193): n is a, c, g, or t
tcagactactatgtcacgaccggtgctcgatttagtgtgagtagttttgggtttggggagagctgctcagttaggacccagagggaaccataggaaacccagcgcagcttctcttcctcctgctactctggctccagccatcacggagtattgtgtgacgcagtctcagctacctgttcttgtctcgaggganagacgccacctctctgcgacggaccagtcagagttagtacgcagcagtactacgttacgcctaggtacagacaagtaacctggacctcggacccttaccggaggtcctccgttactacgtacgttagtcgggtccgtacccggtacccgaaccgacgggtacctacggttcggtaccggtccggacggttaacgtacgggttaccggaagggtcggtaccggtaggttcgggttaccggttttacgggaaacgttaacggttacctttaccgtacgtttcctaactaacggttactaaccgttacgaaccgtaacggttaccgtagggtaaccgaacgttaagttactttacggacgttaagttacgtttaacttaacgttcgtaacgtacggttacctttggtttacccgttcccttacgttaccctttacgttaccgttacgtttacccttacggttttcggaccggttaccgggtacgtacggtacgtacggtacgtaccgtacgtaaacggtacggttaaacgcggtttacgacgttacgcccttaacggtgttaccg

SEQ ID NO: 157705 - DNA, 705 bp, Homo sapiens
  misc_feature: GYAE6OF01EDJ4S.24.78.H01.1.454.CMB.1.raw
  modified_base (245)..(245): a, c, t, g, unknown or other
  misc_feature (245)..(245): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccgaggccaccctgttctttgtcctccgagggganagacgcctaccctctcctgcagggccagtcagagtgttagcagcagctactagcctggtaccagcaagaacctggcctcggctcccaggcctcctcattctagtcggtcgccgtacccacgtcgggccctacgtcgggccgtcgacggacgtaggttcaggtcgcgtaggtggtcgtttagggactacgtacctacgtaccttcgtactactacgtacgtaccgacgtaacggacgtacgggaaccgtaccgtaacggttacgttttacggcgttaacgttacgtttaacgtttacgtacggttctaacggttccgtttcgggtttacccggtttccccgtttaccgtttacccgtttacccgtttaacgtttacccggttaaccgttttaacccgggttttttccggggaccccggtttaaaccggggtttacccctaacggggttcggttaaccgggg

SEQ ID NO: 157706 - DNA, 737 bp, Homo sapiens
  misc_feature: GYAE6OF01BRYEN.24.78.H01.1.454.CMB.1.raw
tcagactactatgtcacgaccggtgctcgatttagtgtgagtagtttgggtttggcacgaccggtgctcgatttagtgtgagtagtttgggtttggggagagctgctcgagttaggacccagagggaaccatggaaaccccagcgcagcttctcttcctcctgctactctcgctcccagccatccgaccggagtaattgtgttgacgcagtctccgaggcctaccctgtctttgcctccgagggagacgacgacccaccctctcgagccgaggccagtccaggtagtgtagcagcagtcttacgtacgccgtaggaccaggaccaacggaacctggcctacggcctacccgagtccttccactattcgttagtcggtcgtcccgtaccgaccggaccggtccctacgggtcgggtacccgtacgggaccggtacgtttacggggttccgtacggggttcggggttgggttaccgttacggggaccttaagggttaccgtttaccgacccgttaccgtacccgaacgtaccgtacgaccggtcccgtcccgttcgtacgtttacgtaacggttacgttacgtttcggtaccttttacgttttacttcgttaacgtacctaacgttacggtcgttagggtaccgtaccgttccggtacccgttccgttaccgttaccggtttccggaccgtacgggtaaaccctaaggttacggaagttacgaaaccgttaaggtaccg

SEQ ID NO: 157707 - DNA, 710 bp, Homo sapiens
  misc_feature: GYAE6OF01AMAAC.24.78.H01.1.454.CMB.1.raw
  modified_base (200)..(200): a, c, t, g, unknown or other
  misc_feature (200)..(200): n is a, c, g, or t
tcagactactatgtcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgtctccgagggganagagcccaccctctcctgcagggccagtcagagtgttagcagcagctacttagcctggtaccagcaacgaaaccgtggcctggcctcccgaggtcctccgtcattcgtagtggcgcgtccaccgacgggccacgtcggcgtcggacggacgtaggttcgagtcggcgtaggtcggtcgtttagggacctaggtacttaccgacgttcctacgagtaccgtagtaccgacgtaacggtacggtacgggtaccggtaccccggtaaagtttacgttttacggaccgttaaggtttacgtttaactttacggtcgttaccgtacggtttcgtttcgggttttacccgtccctttcccgttcccgttaccgttacgttccgtttaccgtttaccggtttcggtacccgttacggggttaccgtaccgggtacgttacgggtacgtacgttaacggaacggtaccggtaaccgttgggtaccggtccgttacggacccttaaccgttcgtttccg

SEQ ID NO: 157708 - DNA, 777 bp, Homo sapiens
  misc_feature: GYAE6OF01BOV23.24.78.H01.1.454.CMB.1.raw
  modified_base (211)..(211): a, c, t, g, unknown or other
  misc_feature (211)..(211): n is a, c, g, or t
  modified_base (404)..(404): a, c, t, g, unknown or other
  misc_feature (404)..(404): n is a, c, g, or t
tcagactactatgtcacgaccggtgctcgatttagtgtgagtagtttgggtttggggagagctgctcagttaggacccagagggaaccatggaaaccccagcgcagcttctcttcctcctgctactctggcctcccagcctatccgaaccgggaggtaattgtgttgacgcagtcctccgaggcctacctgttcttgtcctccgagggganagacgcccacccttctcctgcgacgggtccagtcagtagtgttagcacgcacgtccttacgtcgcctaggtaccagtacaacgaaccgtggtcctggccctcccgtaggtcccttaccgtccattcgtacggtcggtaccgccgtaccgaccgacgggcctacgtcggcgtcggacgacgtcgtcgagtcggnacggtcggtacgttgggaactggtacccttctactctactacgttctacgtacgacgtaacgaccgtacggaaccgtaccgtaaggttactttaccggagtttacgtttaaggttaacgtttacgttacggttacgtacgttttcgttccgggttttacccgttcccctttaccggttacccgttacctttaacggtttaccgtttaccggttaccggttttccgggacccggtttaacggggtttcccgtacggggttaacgttacgggtaaacggtttaagaacccgggttaaacgtacccgggttaacgttacggggttaccggtacccggttaacgttacccccggttaaacgtaccgttttacccggg

SEQ ID NO: 157709 - DNA, 841 bp, Homo sapiens
  misc_feature: GYAE6OF01CJNI7.24.78.H01.1.454.CMB.1.raw
  modified_base (178)..(178): a, c, t, g, unknown or other
  misc_feature (178)..(178): n is a, c, g, or t
  modified_base (242)..(242): a, c, t, g, unknown or other
  misc_feature (242)..(242): n is a, c, g, or t
  modified_base (326)..(326): a, c, t, g, unknown or other
  misc_feature (326)..(326): n is a, c, g, or t
tcagactactatgtcacgaccggtgctcgatttagtgtgagtagtttgggtttggggagaggagcccagcactagaagtcggcggtgtttccattcggtgatcagcactgaacacagaggactcaccatggagtttgggctgagcttgggttttcctcgtcgcttcttttaagaggtntccagtgtcgaggggcaggctggtggagtcgtgggggcgtcgtggtccaacgtgggacgtcccngacgactctccgtgtcgccggccctcccgattccacctttcaaacttacttagtcggactagtcgcctacgttcggggtacccnccgtacggcctaccggaggccgaagggggtcctggggacggttcgggggtacgcccgtacttagtttcctttaagttttcggaaggttacgggtaaaagttaaacgttccaaaaattttagttaaacgttggaaccctaaacggtaccggtttacccgggtagggtaaaccgggggttcccccgtttaaccaaccccgtaatttccccgtaacccgaagtaaccgtaaaccgttaaaccttaacccgaaaaaccttaaacgttaccttacgtttacgtttccgacgtaaacctaaagtacgtaacgtaccgtccgtacgtacgtacgtacgtaggtaaccgaccgtacgggtacttacggtaccttaacgttacgttcggtaacggtaacggtaaaccggttcccgttacccccccgggttacctttaacggttttaacccgtaacggtttttaccgggtcccgggggtttaccccgtaacccccctttaagggtccgttaccgggtacccgggg

SEQ ID NO: 157710 - DNA, 748 bp, Homo sapiens
  misc_feature: GYAE6OF01BH4ME.24.78.H01.1.454.CMB.1.raw
  modified_base (605)..(605): a, c, t, g, unknown or other
  misc_feature (605)..(605): n is a, c, g, or t
tcagactactatgtcacgaccggtgctcgatttagtgtgagtagtttgggtttgggagaggagcccagcactagaagtcggcggtgtttccattcggtgatcagcactgaacacagagactcaccatggagtttgggctgagcttgggttttcctcgtcgtcttcttttaagaggtgtccagtgtcgagggcagctggtggagtcgtggggcggcgtcggtaccgaaccgtgggacgtcctgacgactctccgtgcgccggcctcccgattccaccttacaacttacgttagtcggactagtcgactaccgtgggtacccacgacggccgtaccggacgggccggaacggggtcgtagggtagggttcgggcggcctagtttacttcgtttaagtttagagttaggtaattaaactagtaaattagttagacgctaacgtacccggttcggtaggtaaaccgggtccgttaaccaccctaacgttcccgtaaccgtaacgtaacgtaaccttaaacgttaacccgtaaacttaaaccgttaccgttacttttacggtttaacgtacgtaaactaacgtacgtaacctaccggtcgtacgtacgtnttaacggtacggacgtaccgtacggttcttcgttacttacgttcgacgttacgaccggtaacgttcccgttaccccgttacgtttacgtacgttacggttacggttccgggttacccctaccgttacgaggttcggtaccggg

SEQ ID NO: 157711 - DNA, 696 bp, Homo sapiens
  misc_feature: GYAE6OF01EYNKU.24.78.H01.1.454.CMB.1.raw
  modified_base (200)..(200): a, c, t, g, unknown or other
  misc_feature (200)..(200): n is a, c, g, or t
tcagactactatgtcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgtctccgagggganagagccaccctctcctgcagggccagtcagagtgttagcagcagctacttagcctggtaccagcaagaaacctggcctggcctcccaggcctcctcatcgtatggtcgcgtccaccgacgggccacgtcgggcgtcggcggactacggttcaggtggctaggtcggtcgttttgggactaggtactttcacttctcgactccagttccgaacacgtacgtagggaaccgtacccggtaaagttacgttttcggaacgttacgttagtttaactttacgttcggttactacggttacgtttcgggttttccgttccccgtttccttccccgttccgttaacgtttcgtttaacccgtttaccgttttccgggtacccgttacggggtttacccgtagggttccgttaacgggtaacgttacgttaccggtaaacggtacccggttaaacgttcgggttaaccggtcgttaacccggtcctaacccgtcgtttaccgg

SEQ ID NO: 157712 - DNA, 729 bp, Homo sapiens
  misc_feature: GYAE6OF01B94A2.24.78.H01.1.454.CMB.1.raw
  modified_base (588)..(588): a, c, t, g, unknown or other
  misc_feature (588)..(588): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatacggaaaccccagcgcagcttctcttcctcctgctactctggcctcccagccatccgaccggagaattgtgtgacgcagtctccgagcctaccttgttctttgtctacggaggggagagacgcccaccttctccgcgcgacggcagtcaggtagtcgtagcgacgctaacgtacttaccgtacggccgttacggaaccacggaccaaccggtaaccgttccggccgttccggacccgtaccgacggtccttacctcgaacgttcgtacgtcggggtacctaccggtccgaaacccggtaggtccctacgggtacggccggttacggccgggtaacgtcgggttacgacgggttcgggaacgtggggttcggtcggtttacggtaacgacgttcctttactaccgtcgtactacttacaccgtacgtacgacgtaccggtacgacccgtaaacggttnttaacgtttcggagttagttacgtacgtttacgacgttacgtgtttccgttcggttcccgttaccttaccttcccttaagtaccgtttcttaccggttacggtttccgacgggtttaccgtacggttacgggtgtaacggg

SEQ ID NO: 157713 - DNA, 755 bp, Homo sapiens
  misc_feature: GYAE6OF01BFOFS.24.78.H01.1.454.CMB.1.raw
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctccttcctcctgctactctggcctcccagccatccaccggaggaattgtgttgacgcagtcctccaggccacccgtgtcctttgtccgtccgaggggagacgagcccaccctcgtccgtgccgaggccagtacagtagtataagaagcaactacttacgccgtaggtactaccaaacacgaaacccgtggacccaggcccacccgacggcctccgtacacttacgttagtaggtaacttaccgtaccaggtccgacggggtccctaacgttcgggtaccgtcccaacggtcccggttaacggttcgaacgggtcgggacggttagggtcgggttccggtagggtaccgtaaggtcggttaccctacgttcccgtacccgtaaccgtacgtacctagaccgtaccgtaccgtacggtacctaacggttcgttaacgtaaggtttacgttttacgtacgtttaacgttttacttaccgtacgttaccgacgtaccgtacgtaaccgtaacgtacggttaggtacccggtacggtacccgtaccgttaaccggttacccgggtttacggggaaccgggtaccgggtaaccgggtaagggttaacggg

SEQ ID NO: 157714 - DNA, 1052 bp, Homo sapiens
  misc_feature: GYAE6OF01CL29C.24.78.H01.1.454.CMB.1.raw
tcagactactatgtcacgaccggtgctcgatttagtgtgagtagtttgggtttggggagagctgctcagttaggacccagagggaaccatggaaacccagcgcagcttctcttcctcctgctactctggctccagccatcgacggagattgtgttgacgcagtctcaggcacctgtctttgctccgaggggagacgacgccaccctctccgtgccgtagggtcccaaggttccaaggtacggttagttaacgcgaggactaacggtcctttaacgttaccggaccgttacgggtaacccaaggaccgtaaacgtaaaacccgttcgggtacccgttacggaccctttacccccggtaaggtaccccttccccttacccgttactttaacgttcggtaccgttttccggttccccttaaccccgaaccgggtaccgggttacccccggtttcgggtttaccccgggttacccccgtaacggggttcccccggtttaacgggggttttcccgggtttccgggggggtcgggtttccgggggtttacccggttaacggggggtaacccgttaagggtttacccgttttttaaccggaccctttaccccgttaaccggtaaaccccggttaacttacccgggaacgggttccccgggttacccttacggtaaaccggtttaccggttaaggttaacgtttttacgttttacgtaccgttttaacgtttttaacgtttccgtacggtttaacctaaaccgtaccgtttagggttccggtttaacggtaccgtttaccgggtaccctttacccggtttaaacgttttaccggtttaacccggggtaaccgggtaaaccggggttaaaccccgttaaacgggttggttaaaacccgggtaaaccgttttaaaaccgaaaacccgggttttttaaacgcggggtttaaaccgcgggtttaacccgaaacccgtttaccccgtttaagtttaccccggttaacccgtttttaacccggttaacctttaccccgggttttcccgttaaccccccggttaacc

SEQ ID NO: 157715 - DNA, 811 bp, Homo sapiens
  misc_feature: GYAE6OF01BBOVI.24.78.H01.1.454.CMB.1.raw
  modified_base (100)..(100): a, c, t, g, unknown or other
  misc_feature (100)..(100): n is a, c, g, or t
tcagactactatgtcacgaccggtgctcgatttagtgtgagtagtttgggtttggcgacgaccggtgctcgatttagtgtgagtagtttgggttgggagngctgctcagttaggaccagaggaaccatacggaacccagcgcagcttcgtcttcctcctgctactcgtgctccagcatcgacgagtatgtgtgacgcagtctccaggccacctgtctttcgcgtccgaggggacagacgcccctaccgtcttccacggacgacgggcctaaggtccgaagtaggttgttaacgcgagcgacgtactaacgttacgccgttagggaaccagacaaggtaaaccgttcgggcctttacggcccgttacccgacgggtcctcccgtactaacgttcgttaacggtcggtaccggtccgttacccgaaccggaacgggtcccgtaacggtccgggtaccggttccggacccgggtaaccgttaggggtttaaccgacgggttcgggttaaccgtagggttcggttaacgggtttcgggtaaccggtaagttaaaccccgttcgtaaccgttccgttacgaacttacgttaccgaacgtaacggtacgtaccgttacggggaacccttaacgggtaaccgtttaaggtttacgtaacgttacggttaacgtttacgttaacgtacggtttaccgtacgttcgttttacccggttaccggttcccttaacccgtttcccgttaaccgttacgtttaccgttacctttaccgggtttcgggacccgtttaaccgggtcgtttaccgggagttaaccgg

SEQ ID NO: 157716 - DNA, 872 bp, Homo sapiens
  misc_feature: GYAE6OF01E3L4S.24.78.H01.1.454.CMB.1.raw
  modified_base (303)..(303): a, c, t, g, unknown or other
  misc_feature (303)..(303): n is a, c, g, or t
tcagactactatgtcacgaccggtgctcgatttagtgtgagtagtttgggtttggggagaggagcccagcactagaagtcggcggtgtttccattcggtgatcagcactgaacacagaggactcaccatggtagtttgggctggagtcgttgggttttcctcgtcgtcttacgttttaagaggttcgtcctaggtgtcgaggggcaggcgtgggtggagtcggtgggggcgtcggttcggtcccaacgtggggacgtcctgacgtctctccgtgtcgccgtccctccgtattccgtaccttanaaactttacgttagtcggctagtcgaccgtacggttcgggtccccgccgtagggccctaccggaacggggtaccggaacggggggttcgtagggggtaggggttcgggggtcccggtacccgttacttttaacgtttaccgttttaaggttttggggaagtttaacgggtaaaagtttaaactacgttaaaagtttcgttaacgtcggaaccgtacggttaacccgttcgggggtaacgggtaacccgggttcccgttaaccacccttacgtaccctaaccggtaagtaaccgtaacccttaacgttaacccgaaaactttaacgttaccgtttacgttaaccgtttaccgtacgtaaacgtaaacgttcgaacccgtttacgtacccgtagtacccggtagttacccggtaagggtaaccggtacccggtaacgttcccgttagttaccgttagttaccgtaggtaccggtaaacgtacccggtttacccttcccccgggttaacttttccggtaaggttcgtttacgggtcccggtacccgtacccgttacgtagggtcggtaccgg

SEQ ID NO: 157717 - DNA, 724 bp, Homo sapiens
  misc_feature: GYAE6OF01BVA91.24.78.H01.1.454.CMB.1.raw
  modified_base (207)..(207): a, c, t, g, unknown or other
  misc_feature (207)..(207): n is a, c, g, or t
tcagactactatgtcacgaccggtgctcgatttagtgtgagtagtttgggtttggggagagctgctcagttaggacccagagggaaccatggaaaccccagcgcagcttctcttcctcctgctactctggctccagccatcgaccggaggtaattgtgttgacgcagtctccgaggccacccttgttctttgtccgtccgagggganagacgccctaccctctcctgacgcggccagtcgagtacggttgtagcgagcagtccttacgttacgccgttaggtaacccagtaccgaacgtaaacccgtcggtacccgtcggtcccgtaccggacggtcctaccgtctaacgtttcgtagttcggtcgccgtacccgaaccggcgggtacccacggttcggccggtcggaccggtacgtaacggttcgaaggtcgacgtcgggtttcgggtcgtttacgggaaccacgttacctttcgacttctcgactacgtactacgacgtacgtacgtacggtacgaacccgttaagttacgtttcgacgttacgttacggttaacttacgttcgtacgtacgtttcgttttccggttccgttccttcccgtttaccttccgttaggtttccgtttaccgtttacggtttacgtccgggttacggtaccgtaggcggttaacggacgttacgtacggaagccgtacgttgtcggcctagactacgtcgttacg

SEQ ID NO: 157718 - DNA, 682 bp, Homo sapiens
  misc_feature: GYAE6OF01CW5HR.24.78.H01.1.454.CMB.1.raw
tcagactactatgtcacgaccggtgctcgatttagtgtgagtagtttgggtttggggagagctgctcagttaggacccagagggaaccatggaaaccccagcgcagcttctcttcctcctgctactctggcctcccagccatcaccggaggattgtgttgacgcagtctccaggcaccctgtctttgtctccgaggggagagacgccaccctctcctgcagggccagtcaggtgtgtagcagcagctactagcctggtaccagcagaacctggcctggctcccgaggcctcctcatctatgacttcgtcctaccaacgtcgggtaccacgtcggcccgtccccgcgtacggttcaggtcggactaggtcggtcgtttacgggaactaacggtcctttccgacttctacacgtcacgtacgaacgtacggtacgtcgggaacgtaccccggtaaagttacgtttcggaccgttagttcgttaagttaccgtagttacgtaacgtcgtttacggttttccggttaccccgttccttacctttaccgttacgttacgtttaacctttaccgttttcgggcccgttaacggggtttcccgaagggttccgtaagggtaacgtacgttacggaaaacggttccggtaaacgtcggttacggtctaggtaccctcggtaactttccgg

SEQ ID NO: 157719 - DNA, 644 bp, Homo sapiens
  misc_feature: GYAE6OF01A0LXL.24.78.H01.1.454.CMB.1.raw
  modified_base (233)..(233): a, c, t, g, unknown or other
  misc_feature (233)..(233): n is a, c, g, or t
  modified_base (239)..(239): a, c, t, g, unknown or other
  misc_feature (239)..(239): n is a, c, g, or t
  modified_base (306)..(306): a, c, t, g, unknown or other
  misc_feature (306)..(306): n is a, c, g, or t
tcagactactatgtcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgtctccgaggggagagacgcccaccctctcctgcagggccagtcagngtgtancagcagctactagcctggtaccagcagaacctggcctggcctccgaggcctcctcatctagtggtcnccgtccaccgcggccacgtggccgtcgcggacgtcggttcaggtggacgtaggtggtacgtttgggactacgtaccttcacttctacattcatcgacgacgtacgtacgggacgacccgtaagttacgtttcgacgtagttcgttaacttacgtcgtcgtacgttcgtttcgtttccggttcccttccgttcccttaccgttacgttcgtttaaccgtttaccggttttccgggtacccggttacgggttcccgagggttaccgtacgggtacgtacgtaaccggtaacggaccgttaacggtcggttcggtccgtacgaccttaccgttcgttaccg

SEQ ID NO: 157720 - DNA, 706 bp, Homo sapiens
  misc_feature: GYAE6OF01CNQ4S.24.78.H01.1.454.CMB.1.raw
  modified_base (201)..(201): a, c, t, g, unknown or other
  misc_feature (201)..(201): n is a, c, g, or t
  modified_base (697)..(697): a, c, t, g, unknown or other
  misc_feature (697)..(697): n is a, c, g, or t
tcagactactatgtcacgaccggtgctcgatttagtgtgagtagtttgggtttgggggaggagctgctcagttaggacccagagggaaccatggaaaccccagcgcagcttctcttcctcctgctactctggctccagccatcaccggaggaattgtgttgacgcagtctccaggcaccctgttcttgtctccgagggganagcgccaccctctcctgcagggccagtcagtagtgttagctagcagctacgttacgctggtaccagcaagaaaccgtcggcctacggcctccccgaggtcctccctactacttcgtagtcggtacgtccgtacccgaccggacgggcctacgtcgggccggtcggacggacgtacggttccgaggtcggacgtagggtcggtacggtttacgggacctacggtaccttcaaccgttcttaccgtacgtactacgttacgaaccgtagtaccgtacgggaaccgtaacccgttaagttacttttacggacgttaggttacgtttaacgttaacgttcgtacgttacgttccgttttacgggtttccgttccccttaccgtttcccgttaccgttacgtttaccgttaccgtttaccggttttcggaacccggttcgggttctacgggtcgtacggacgtacgtacgaacgaccgttagtcggtacggcttagccctntacgttccg

SEQ ID NO: 157721 - DNA, 679 bp, Homo sapiens
  misc_feature: GYAE6OF01BIOLD.24.78.H01.1.454.CMB.1.raw
tcagactactatgtcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgtctccgaggggagagacgcccaccctctccgtgcgacgggccagtcaggtagtgttagcagcagctactcgcctggtaccagacacgaacctggacctggcctccgaggtcctccctcacttccgtagtcgggtcgtccgtaccgaccgacgggcctacgtcgggtcgtcggacggacgtaggttcgaggtcggcgtaggtggtcgtttcgggaactacgtacttcacttctactactctacgtaccgaactacggtacgtcgggaacgtacccgtaaagttacgtttcggacgttaggttacgtttaactttacgttcgtactacggttcgtttcggttttccggtcccctttccgttaccgtttaccgttacgtttccgttaaccgtttaccgttttcgggacccgttacgggttccgtagggtaccgttacggagtacgttaccgaacggtacgtaacggttcggtacgacttagacctcgtagttccg

SEQ ID NO: 157722 - DNA, 793 bp, Homo sapiens
  misc_feature: GYAE6OF01CNS84.24.78.H01.1.454.CMB.1.raw
  modified_base (244)..(244): a, c, t, g, unknown or other
  misc_feature (244)..(244): n is a, c, g, or t
  modified_base (281)..(281): a, c, t, g, unknown or other
  misc_feature (281)..(281): n is a, c, g, or t
tcagactactatgtcacgaccggtgctcgatttagtgtgagtagtttgggtttggcacgaccggtgctcgatttagtgtgagtagtttgggttggggagagctgctcagttaggacccagaggaaccatcggaaacccagcgcagcttctcttcctcctgctactctggcctcccagccatcaccggagaattgtgttgacacagtcctccaggccaccctgttcctttgtcctcggagggganagacgccctaccctctccgtgcgacgggccagtcagngtgtagctagcagtctacgttacgccgttaggtaaccgagacaacgaaaccctcggtcccgtcggtccctaccccgaaggtcccttaccctctaacttaccgtaaggttcggttacgcccggtacccgaaacccggacgggtccctaaccggtcggggtacccggttaccgggacccgggtaaaccgttacggggttttaccaggggttacggacccgtagggttcgggtacgttttacgggggactaacgtaccttcccgaacgttcctacgtaactcgaacttacccggaacgtaacggacgttacggaacccggtaccggtaaacgtttagttttccggaaccgttaagtttacgtttaaccgtttagtacggttaccgtacggtttacttttcgggtttacccgtccccttttaccggttccccttccgtttaacgttccgttaacccgttttacggtttaccgggtaccccggttagggtttacccgtgggttcccggtaaacgggg

SEQ ID NO: 157723 - DNA, 795 bp, Homo sapiens
  misc_feature: GYAE6OF01EOY5G.24.78.H01.1.454.CMB.1.raw
  modified_base (246)..(246): a, c, t, g, unknown or other
  misc_feature (246)..(246): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggctcccagccatcaccggagaattgtgttgacgcagtctccaggccaccctgtctttgtctccgaggggagagacnccctaccctctcctgcgacgggccagtcagtagtgttagcaggcagtacttacgttacgccgttaggtaccaggacaacggtaaaccgtcggacccgtcggccctacccggacggccttcccgtacacgttacctagtcgggtcgcccgttacccgaccggtacgggtaccctacggtccgggtaccgtccgggaccgggacgtacgggttccgaacgggtcggtacgtacggtcgggttaccggtttacggggaacgtacggtacctttaccgaaccttaccgttacctaacgttacctaacgttacccggaactagggtaaccggtcgggaacccgtacccgggtaaagtttacgtttcggaaccgttaggtttaccgtttaagttaccgttacggttacgtacgggtttcccgtttccgggtttttcccggttacccctttcccgtttacccgtttacccttaacgtttaccccggttaacggtttacccgtttttccggggaacccggttccggggtttaacccgtgggttaccggttaaacggg

SEQ ID NO: 157724 - DNA, 720 bp, Homo sapiens
  misc_feature: GYAE6OF01AN10H.24.78.H01.1.454.CMB.1.raw
  modified_base (703)..(703): a, c, t, g, unknown or other
  misc_feature (703)..(703): n is a, c, g, or t
tcagactactatgtcacgaccggtgctcgatttagtgtgagtagtttgggtttggggagagctgctcagttaggacccagagggaaccatggaaaccccagcgcagtcttctcttcctcctgctactctggcctcccagccatcaccggaggtaattgtgttgacgcagtctccaggccaccctgtctttgtcctccgaggggagacgcgccccgaccctctccgtgcgacgggtccagttcgagtagtgttacgcagcacgtcttacttacgccgttaggtaacccagaccgaacgtaaacccgtggccctcgggtccctaccccgaggtcccttccctacacgtttacgtagtcgggtccgacccgtacccgaccggaccgggcccttacggtcgggccgtaccggtacgggacgtacggttcgaggttcggacgtaggtcggtcggtttacggactacgtacttcactcgtctactcgaacgttccgaactacgggtaacgtacgggtaacccgtaacccggttaaaggttcgttttacgaccgttaagttacgtttaacttacgtgtcgaacgttcgtttacgtttccgtcccttacctccgttaccgttattacgttactttccggttacggacccgttagggtcccgtaggtaccgtggtactaccgtacgtaaggtccgttaacgtcggttcgacncgaccctccgtgttccg

SEQ ID NO: 157725 - DNA, 749 bp, Homo sapiens
  misc_feature: GYAE6OF01A6M8E.24.78.H01.1.454.CMB.1.raw
tcagactactatgtcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccgaggcaccctgtctttgtctccgaggggagagacgcccaccctctcctgcgacgggtccagtcaggtagttagttacgcacggcagtactacttagcctacggtaccagacaacggaaaccgtcggcctacggcctcccgaggtcctacctctactctagttcggtacgtccgtaccgaccgacgggtaccacggtcgggtaccggtcggaccggtacgtacgggttacacgggtcgacgtaggttcggtcggttttgggaccgtaaggtaccctttcaccgtttactactatacccgtaagtccgaagtacgtaccgtacgggaaccggtacccgtaaaggtttacttacgtacggtacgttacggtttaacgtttacgtacgtcgtacgttccgtttacggttttccggttcccttaccgttacccgttaccttacgttaccgtttaacctttaccggttttacgggtacccggtttaacgggttcccgtacggtcggttaaggaacgttacgtaacggtaacggttaaccggtacgtggttcggtaccgtacgtaccgtaccgttacgttaccgg

SEQ ID NO: 157726 - DNA, 762 bp, Homo sapiens
  misc_feature: GYAE6OF01CRR8S.24.78.H01.1.454.CMB.1.raw
tcagactactatgtcacgaccggtgctcgatttagtgtgagtagtttgggtttggcacgaccggtgctcgatttagtgtgagtagtttgggttggggagagctgctcagttacggacccaggaggaaccagtacggaaaccccagcgcagcttctcttcctcctgctactctggcctcccagccatccgaaccggaggtaatttggtgttcgacgctacgtctccgacggcctacccgttgttcctttcggtcctaccgggaagggggactacggaccgtcccctaacccttctccgtggaccggacgggcctaggtccgaaggtacgttacgttacgaccgaggactacggtaccttaacgttacggccggtacggtacccgaacgaccgaaccggtaaaccgtcggcccggttcggcctcccggacgtccttacctctagtcctaggtcgtcgccctacgacggacggcctacggcggcgtcggacggtacgtacggttcgaggtcgacgtggtcggtacggttacgacgtacgttcttacctacttcgtacacgttaccacgtaccgacgtacgtacggtacggaacccgtacggttaattcggtttacgacggttaggttaacgtttacttaccggtcttacggttacgtttccgtttccgggtttaccctcctttaccgttccctttacgttacgttccgtttaaccgtttccgtttaccgggtaccgtttccgggtaacggtggtcgttaaacggg

SEQ ID NO: 157727 - DNA, 676 bp, Homo sapiens
  misc_feature: GYAE6OF01CHZHC.24.78.H01.1.454.CMB.1.raw
  modified_base (238)..(238): a, c, t, g, unknown or other
  misc_feature (238)..(238): n is a, c, g, or t
  modified_base (249)..(249): a, c, t, g, unknown or other
  misc_feature (249)..(249): n is a, c, g, or t
  modified_base (273)..(273): a, c, t, g, unknown or other
  misc_feature (273)..(273): n is a, c, g, or t
  modified_base (284)..(284): a, c, t, g, unknown or other
  misc_feature (284)..(284): n is a, c, g, or t
  modified_base (302)..(302): a, c, t, g, unknown or other
  misc_feature (302)..(302): n is a, c, g, or t
tcagactactatgtcacgaccggtgctcgatttagtgtgagtagtttgggtttgggggaggagcccagcactagaagtcggcggtgtttccattcggtgatcagcactgaacacagaggactcaccatggagtttgggctgagcttgggttttcctcgtcgcttcttttaagaggttgtccagtgtcaggggcagctggtggagtcgtgggggcgcgtggtccaaccgtgggagtccngagtctctccngtgccggcctccgattccaccttnaacttacttanggcatgcacgtgggtccncaggctccgaggcgaaggggcttgggaggtcgggtcgggccgtacgttactttctttaagtttggagttacgggaaaagttaaacttctaaaatttaacgtttagttcgacaaggtacccgtcggtaagggaacggggtccccgttacaccgtaactccctaccgaacggagtaacctaacttaccaaataacttactcttacgtttctagaactaatcgactacgcgtgtactactcgtaggaacggtaccacgggtcttacgttcttaattcgttcgagtaaccgtaacgtcccgttccccggtacctttacgttacggttacgttacgggtttcgggtcccgtacccctaatacggtcgggtcgtaccggg

SEQ ID NO: 157728 - DNA, 960 bp, Homo sapiens
  misc_feature: GYAE6OF01C8IYT.24.78.H01.1.454.CMB.1.raw
  modified_base (177)..(177): a, c, t, g, unknown or other
  misc_feature (177)..(177): n is a, c, g, or t
tcagactactatgtcacgaccggtgctcgatttagtgtgagtagtttgggtttggggagaggagcccagcactagaagtcggcggtgtttccattcggtgatcagcactgaacacagaggactcacatggagttgggctgagtcgttgggtttcctcgtcgtcttacgttttaaggnggtcgtacgagtgtcgaggggcaggcgtgggtggacgtcggtcggggcggtcgtcggtaccaaccggtgggacgtcccgtagacgtactcgtccgtggtcgccggtccctcccgtattcccaaccgtttacaaaacttctttacgtcgggacaagttcggaccgtaccggttccggggtaccccgaccgtacgggcccctaccggaacggggtaccggaaacgggggtccgttaggggtacggggttcgggggttaccggaccccggttacgtttaacgtttaccgtttttaaggtttagggaaacggtttaaacggggttaaaggttaaaacctttaacgtaaaaagttttaacgtttagtacgggtacctaacggtacccgttacggggtacggtaaacccggggttcccggttaccaaccgttacgttacccgtacgaacggtaacgtaaacctaacttaaccctaaaactaacttaccgttactttacggtttaccgtaaacgtaacgttaaacgtcgttaaacctaccggtacgtacgggacgttaacgtaacgtacgggaaaccgttaccggtaaccggttacgttaccggttattaaacccgtttcgtacgggtaaccggtaaacccggttaaacccggtttaccccccggttacccccggtttaacccgttttaacccgtttaacccggttacgggtttttacccgggttaaccggggggttaccccccttacccggttaaaccggttaccgggtcccggggttaaaccccgggg

SEQ ID NO: 157729 - DNA, 631 bp, Homo sapiens
  misc_feature: GYAE6OF01B0JQW.24.78.H01.1.454.CMB.1.raw
  modified_base (200)..(200): a, c, t, g, unknown or other
  misc_feature (200)..(200): n is a, c, g, or t
  modified_base (320)..(320): a, c, t, g, unknown or other
  misc_feature (320)..(320): n is a, c, g, or t
tcagactactatgtcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggccaccctgtctttgtctccgaggggngagagccaccctctcctgcgacgggccagtcagagtgttagcagcagctactagcctggtaccagcagaaaccgtgcctggcctcccgaggcctcctcatcctagtgtcgcgtccaccgnggccacgtcggcgtcgcggacaggttcagtggctaggtgtcgtttgggaactggtacttcacgtctacatccagtcgacgacgtacgtcggagtacccggaaagttacgtttacggttaccggtttacttacgttcgtactacggtacctacggtccggtttccgccggtacggtccggttaccgttaccgggttccggggaccgggggtaccgagggggtcggaacgggagggacggaccggtaaggtcggtcggacgtggtaccgaccgtagttcgtcgttaccgttctacgttcccgttcccgtaccg

SEQ ID NO: 157730 - DNA, 826 bp, Homo sapiens
  misc_feature: GYAE6OF01EGLUX.24.78.H01.1.454.CMB.1.raw
  modified_base (191)..(191): a, c, t, g, unknown or other
  misc_feature (191)..(191): n is a, c, g, or t
  modified_base (714)..(714): a, c, t, g, unknown or other
  misc_feature (714)..(714): n is a, c, g, or t
tcagactactatgtcacgaccggtgctcgatttagtgtgagtagtttgggtttggggagaggagcccagcactagaagtcggcggtgtttccattcggtgatcagcactagaacacagaggactcaccagtggtaggtttgggctgacgtcgtttcgggttttcctcggttcgtctttacgttttaaaggnggttcgtccgaggttggtaccgagggggcacggtcggttgggtggtacggtcgggtggggggccgtcggtcggtacccaacggtggggacgttcccgtggaacgtccttcgtccgtggtcggcccggtaccctccggtacttcctaacctttactaaacgttccgttaaggtcggactaatccgggtaccttacggggttccgggtcccgaccgtaacgggtcccctaccgggaaggggtaccgggtaaagggggtccgtaagggggtcgggttcggggtccggtccccttagtttacgtttacgtttttacggttaacgggaagtttaacgggtaaaactttaactacggtaaaattttagtttacggcgaaccgttaacggtccgttacggggtacgggaacccggtttcctaaccgactacgttccgaacgagtaacgaactttaacaaccgtaatacgttcttcgttatacgagaactagtcctagtcgctagacgtgacgtaggaccgtacgtcgttnttacgtattacggtcgacgtaaacgtaccgttaccgttcccgttaccttacgtttacgttaagttcgggttaccgggtccgacccttaccgtaggtccggtcggtaacgggg

SEQ ID NO: 157731 - DNA, 726 bp, Homo sapiens
  misc_feature: GYAE6OF01A7PIS.24.78.H01.1.454.CMB.1.raw
  modified_base (275)..(275): a, c, t, g, unknown or other
  misc_feature (275)..(275): n is a, c, g, or t
  modified_base (390)..(390): a, c, t, g, unknown or other
  misc_feature (390)..(390): n is a, c, g, or t
tcagactactatgtcacgaccggtgctcgatttagtgtgagtagtttgggtttgggggaggagcccagcactagaagtcggcggtgtttccattcggtgatcagcactgaacacagaggactcaccatggagtttgggctgagctgggttttcctcgtcgctcttttaagaggtgtccaggtgtcgaggggcagctggtggagtcgtgggggcgcgtcggtccaaccgtggggagtccctgacgactctcctgtcgcggcctccgatccaccttnaatacttatggcagtgcacgtcgggtccgccaggcctcgaggcgaaggggtctggaggtgggcggccgtcttatctttagttgtaagtagggtaaagtaactactaattacttangacacggtaactccggtagggtaacgggtcccgtttacgacctaacgtcctaccgaagacgtaactaactaccaaactaactaccttacttacgtttactacgtaactaaatacgtactacgtacctggtacgtacgttacgtacggaacggtaaccgacggtacgttacgttacgttaacttacgttggtaacgtaaccggtaaaaccggttaccccggtttaccccggttacccgtttacccggtttaaacgttaccggttttaacgggttccgggggtttaccccgtaaccccccgttaagtaccggttaaccggggtaaccggttccggggg

SEQ ID NO: 157732 - DNA, 954 bp, Homo sapiens
  misc_feature: GYAE6OF01EN9J3.24.78.H01.1.454.CMB.1.raw
tcagactactatgtcacgaccggtgctcgatttagtgtgagtagtttgggtttggcacgaccggtgctcgatttagtgtgagtagtttgggtttggggagagctgctcagttaggacccagagggaaccatacggaaaccccagcgcagcttctcttcctcctgctactctggctccagccatcaccggagattgtgttgacgcagtctccacgcccaccctgtctgttcgtcctaccgaaggggaaacacgcccctaccctctcctgccgacgggcagtgagaagtgtggcagctaacgttcgcctcggtaccagacaacgtaacccgtggacccgacggtaccctcccgacgggtcccttcccgtaccttccgtacgttcgtcctttccgtaccgtaccccgaacccggtaccgggtcccccgttaggggtccctccccgacggttaccccggttacggggttttcccgggttcgggggtcccgggggtttcggggttacccggttacgggggaaccgttacggtttacccgtttttacccgtaccgtttacccgttacccgtaaccccgtaacgttacccggtaacccgggttcccccgggttacccccgttacccggtaaccgtttccggttaaacccgggttaagggtttttaccgttttttaccggtaaccccgtttttaaacgttttttccgttttaaccggtttacccgttaacccttaaaccgtttaaccgttttaaggttaccgggttttaccggtacccggtttacccgggttacccccgttttacccgggttaaaccccgttttaccggggtttttacccggggtaaaccccggggttaaaccgggggtaaaccccttaaaacgggttacccgggtaaaccggtaaccgttaaaccccgggtaaaaaccggttacccgtttggggtacccggtttaccccgg

SEQ ID NO: 157733 - DNA, 732 bp, Homo sapiens
  misc_feature: GYAE6OF01BS3KB.24.78.H01.1.454.CMB.1.raw
tcagactactatgtcacgaccggtgctcgatttagtgtgagtagtttgggtttggggagagctgctcagttaggacccagagggaaccatggaaacccagcgcagcttctcttcctcctgctactctggctccagccatcacggagattgtgttgacgcagtctccaggcacctgttctttgtctccgaggggagagacgccacctctcctgcgacgggccagtcagtagtgtacgcgagcagtctacgttacgccgtaggtaacagacaacgaaccgtcggacctcggcctaccgaggtcctaccgtactacttcgtagtcgggtcgtccgtaccgaaccggacgggtaccacggtcgggcggtaccggaccggtacggtacggttcgaacgggtcggacggtaggtcggttacggtttacgggaactaacggtacctttacgaccgttcgtactaacgtcgtaacgtacgaacgtacggtaacggtacgggaaccgtaaccggtaagttacgtttacgtacgttaggttacgttaacttcgtacgttacgttacggttccgtttcggttttcccgtccctttacccgttacccttacgttacggttactttaaccgttacggtttaccggaccgtttaccgggttccggtacggtacggtacggtaacgtacgtaacggaacggtcgtaaacggttcggtacggtaccgtaccgactaccggtcttaccg

SEQ ID NO: 157734 - DNA, 883 bp, Homo sapiens
  misc_feature: GYAE6OF01B3Q7D.24.78.H01.1.454.CMB.1.raw
tcagactactatgtcacgaccggtgctcgatttagtgtgagtagtttggggtttggcacgaccggtgctcgatttagtgtgagtagtttgggtttggggagagctgctcagttaggacccagagggaaccatcggaaaccccagcgcagcttctcttcctcctgctactctggcctccagcctatccgaaccgggaggtaatttggtgttcggacgcagtcctccgaggccaccctgttcttgtctccggaggggatagacgccctacctctccgtgcgtacgggcctacgtacacggtagttgttaagccacggctacggacttacttacgccgtcggtaccacgtacgacgaaaccgtcggtccgtcggtccctacccggtacgtccgtcctaccgtactaccgttacgtcgggtcggtacccgtacccgaacccgggtaccgggtacccgtaccggtacgggggtcccgtaccggggtaacccggtaccggttaacgggttacgtacgggttacggggtaccttaggggttcgggtacccgggttttacgggggtaaccgttaaccgttaaacccgttcccgtaacgtttacccgtaaccgttacgttaaccctacggtaacccgtaacggtaaccgtaacggggtacgggtaaacccggtaacccggtaaagtttaccgtttacggaccgtttaacgggttacttttaacgttaaccgggttgttaacccgggtagttttaccgggtttaccggtttccggttacccctttcccgttacccgtttaacccctttggttaacccgtttaccgttttaaccgggttttccggttaacccggttaccgggggttaaccttcggggtaaggttaaacccgggg

SEQ ID NO: 157735 - DNA, 804 bp, Homo sapiens
  misc_feature: GYAE6OF01A4FPZ.24.78.H01.1.454.CMB.1.raw
  modified_base (257)..(257): a, c, t, g, unknown or other
  misc_feature (257)..(257): n is a, c, g, or t
  modified_base (424)..(424): a, c, t, g, unknown or other
  misc_feature (424)..(424): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatcggaaaccccagcgcagcttctcttcctcctgctactctggcctccagccatcgaccggagtaattgtgttgacgctacgtcctccgacggcctacccgttgttctttcgtccgtccggagggganacgacgccctaccctctccgtgacgacgggcctagtccgaaggtagttgttaacgcgtagcgtagtaccttacgttacgccgttacggtaaccaggtaccgaaacggtaaccgtcgggcccgtcggaccttacccgaggtcccttccgtactactcgtagtcggtcnccggtaacccacggacggacctacggtacggccgtccggacggtaacgttacggtacgaggttcggacgtacgggtcggttacgttacgggaactaccggttaccttaccgacttaccgtacacttacgaacgttaccgacgtacgtaaccgggtacggaacccgtaaccggttaagtttaccgtttcggaactttggttaacgtttacttcggtacttccggtacggtttccggttttaccgtttcccgggtttaccttaccccgttttcccgtttaaccgttcggtttaaaccgtttacccggtttttaacccgggtttaccgggttaccccggttaaccggggtttcctaaaccggggtttggttaaaacccggggg

SEQ ID NO: 157736 - DNA, 763 bp, Homo sapiens
  misc_feature: GYAE6OF01C4RPS.24.78.H01.1.454.CMB.1.raw
  modified_base (157)..(157): a, c, t, g, unknown or other
  misc_feature (157)..(157): n is a, c, g, or t
  modified_base (288)..(288): a, c, t, g, unknown or other
  misc_feature (288)..(288): n is a, c, g, or t
  modified_base (303)..(303): a, c, t, g, unknown or other
  misc_feature (303)..(303): n is a, c, g, or t
  modified_base (311)..(311): a, c, t, g, unknown or other
  misc_feature (311)..(311): n is a, c, g, or t
  modified_base (318)..(318): a, c, t, g, unknown or other
  misc_feature (318)..(318): n is a, c, g, or t
  modified_base (405)..(405): a, c, t, g, unknown or other
  misc_feature (405)..(405): n is a, c, g, or t
  modified_base (631)..(631): a, c, t, g, unknown or other
  misc_feature (631)..(631): n is a, c, g, or t
tcagactactatgtcacgaccggtgctcgatttagtgtgagtagtttgggtttggggagaggagcccagcactagaagtcggcggtgtttccattcggtgatcagcactgaacacagagactcacatggagtttggctgagtcgttcgggttttccncgtcgtcttcgttttaaaggcggttctccgtagtggtcgagggggcaggcgtgggtggaggtcggtgggggccgcgttcggcctaacggtgggacgttcctgacgtctccgtccgtggtcgccggtacccnccgtattccacttanattacttntcggatntccgcgttacgtccggtcccgctcggtccgtaccgaggtccggaaggggtcgtggggtagggtcggggtacgccttagttaccgttnttttaggtaggtagaaaggttaaatttactaactaagtttactagttcgaataaccggtctacgggtggaaaccccggtcgttacaccgttctaccgtacgaagtaacctaacgtaactaacctaacgtaaaccttttccgttactttcgtacgtacgtaaaccttaagccgttacctacgtaaccgtgacccgtttagcggtaaccggacgttacgaccggtttnttaccgttactacggttgaccgtaacgtaacccggttaaccgttccccgttacccgtttacgtttaacggttccggtttacggttacccggttcccgggtaacccgtacccgtacggtcggtcgggttacgg

SEQ ID NO: 157737 - DNA, 975 bp, Homo sapiens
  misc_feature: GYAE6OF01DABYX.24.78.H01.1.454.CMB.1.raw
  modified_base (142)..(142): a, c, t, g, unknown or other
  misc_feature (142)..(142): n is a, c, g, or t
  modified_base (178)..(178): a, c, t, g, unknown or other
  misc_feature (178)..(178): n is a, c, g, or t
  modified_base (369)..(369): a, c, t, g, unknown or other
  misc_feature (369)..(369): n is a, c, g, or t
  modified_base (953)..(953): a, c, t, g, unknown or other
  misc_feature (953)..(953): n is a, c, g, or t
tcagactactatgtcacgaccggtgctcgatttagtgtgagtagtttgggtttgggagaggagcccagcactagaagtcggcggtgtttccattcggtgatcagcactgaacacgagaggactcaccagtggagttggctgngtcgttgggttttcctcgtcgtcttacgttttaagnggtctccgagtggtcgaggggctaggcgttgggtagggacggttcggtgggggccggtaccggtcggtacccgtaaccgtggggaccgttccctggacgtcctcctccgtggtccgccggtccctaccgtacttaccctaccttaagacttaacgttgcggtactagtcggtactacccggtcgggtaccnccgtacggcctaccggaaggggtaccggaggggtccggttaggggtaacgggtcgggggtaccgtaccccgtttaattttaacgtttcggtttttaaggttaagggaaaccggttttaaagggtaaaagttaaacccttttaggtaaaaactttttagttaccggttaacgggaccccttaaaacggggttccccggtttaaacggggaaccggggttaccgggttaaccccttaacccttaccgtaacttcccgtaaaccgaacgtaaacccgtaaaccttaaccttaaacctaaaccgttttaccgtttaccgtttaacgtttccggtttaacccaacggtttaaaacgttaacgtcccgtttaaaccggtcccgtggttaacccgtaacggtttacgtaccggtaaaccggtgggttaaacccccgtgttacccggtttatttttaaccgacggttacgttaaccgggccggttaaaccggttacccccgtttccccggttaccggtttaccgtttaaacgggtttaccgttaggggtttcccccgggttccccggtaaaccccgttcgttaaacccgggnggggttccccggtaaaacgggg

SEQ ID NO: 157738 - DNA, 748 bp, Homo sapiens
  misc_feature: GYAE6OF01AD1IM.24.78.H01.1.454.CMB.1.raw
  modified_base (202)..(202): a, c, t, g, unknown or other
  misc_feature (202)..(202): n is a, c, g, or t
  modified_base (386)..(386): a, c, t, g, unknown or other
  misc_feature (386)..(386): n is a, c, g, or t
tcagactactatgtcacgaccggtgctcgatttagtgtgagtagtttgggtttgggagagagcccagcactagaagtcggcggtgtttccattcggtgatcagcactgaacacagaggactcaccatggagtttgggctgagtctgggttttcctcgtcgcttacttttaaggagtgtccagtgtcgagggcagctggtggngtcgtggggcgcgtggtccaacgtggaggtccctgagacctctccgtgtcgccggccctacccgattccaccgttacaaacttacttaagcggactaacgtgaccgaccgttcgggtcccgaccgacggtccgtacccggaggaccggaaggggtcctggggtacggtcggggtcggacccgtnttacgttacttttagttcggaggttaggtaaagtaactacgtaaatttagtacgtacggctaacggtaccgttaccggtagggaaacccggggttcccgttaccgaacccctaagttccccgaccgtaggtaaaccaaccttaaacgtaacccaaaacttaaacgttaccttcgtttacgttcctagtaaacctaacgtactacctacgtacccgtcgtacgtgttaaccgtaggaacggtacgtaccgtactttgtaccttaactacgtgaacggaacgttaacccgtcccctacccggttaccttacgttaaccgtaagtttcccgggtgggtaccccctaccgtagtcggtggtacggg

SEQ ID NO: 157739 - DNA, 672 bp, Homo sapiens
  misc_feature: GYAE6OF01EFA5M.24.78.H01.1.454.CMB.1.raw
  modified_base (243)..(243): a, c, t, g, unknown or other
  misc_feature (243)..(243): n is a, c, g, or t
tcagactactatgtcacgaccggtgctcgatttagtgtgagtagtttgggtttggtacgaccggtgctcgatttagtgtgagtagtttgggtttggggagagctgctcagttaggacccagagggaaccatggaaaccccagcgcagcttctcttcctcctgctactctggctcccagccatcaccggagaattgtgttgacgcagtcctccaggccaccctgttctttgtctccgagggganagacgcccaccctctccgtgcgacgggccagtcagagtgttagcagcagtctacttacgcctggtaccagcaacgaaaccgtcggccgtcggcctcccgaggtcctcctacattcgtagtcggtcgccgtccgaaccgagggccctacgtcggccgtccggacggtacgtagggtttcgaggtcggcgtaggttcggtcgtttagggacctagtaccttcacttctactactctacgtccgacacggtacgtacggaccgtaccgtaagttcgttttacgacgttaggttacgttaacgtttcgtacggttacgtacgttcgtttacggtttcccgtacccctttccgttcccgtttacttacgtttacgttacccgtttacgtttccggtacccggttacgggttcccggtaggtcgttggtaaccgg

SEQ ID NO: 157740 - DNA, 849 bp, Homo sapiens
  misc_feature: GYAE6OF01AH14E.24.78.H01.1.454.CMB.1.raw
  modified_base (157)..(157): a, c, t, g, unknown or other
  misc_feature (157)..(157): n is a, c, g, or t
  modified_base (314)..(314): a, c, t, g, unknown or other
  misc_feature (314)..(314): n is a, c, g, or t
tcagactactatgtcacgaccggtgctcgatttagtgtgagtagtttgggtttggggagaggagcccagcactagaagtcggcggtgtttccattcggtgatcagcactgaacacagaggactcaccatggagtttgggctgagcttgggttttccncgtcgcttcttttaagaggtgtccagtgtcgaggggcagctggtggagtcgtgggggcgcgtggtcccaaccgtgggagtccctgacgactctccgtgtcggccgcctcccgattccaccttcaaatcttagtcggcagtcgctacgtcgggtcccnccgaggccctaccggagggtcgaagggggtcctggggaggttcggggtcggcccgtcttagttctttagtttaggagttagggtaaaattaagtactaaagttagttactcggtaacaacgggtacccttccggtagggtaaacccgggggttccgttaccaacccgttagtacccgtaccgaagaacgtaacctaaaccgttaacccaaacttaacgtaccttaccgtttacgtttaaccgtacgtaacgtaaacgttacggtaaccgttaacgtacccgttacgggtaaccgtacgttaccgttacgggaaccgggtaaccgtaccgggttaccgtttaccgttaactttaaccggtttaaccggtacggttaaccggtaaccggttaaaacccggttccccggtttaccccccgggttacccgttttaacccggtttaaccgggtttaaccggttttaccggggttacccggggttacccccggttaaaccccccttaacgggtaacccgggttaccggggttaacccgggg

SEQ ID NO: 157741 - DNA, 716 bp, Homo sapiens
  misc_feature: GYAE6OF01DESLC.24.78.H01.1.454.CMB.1.raw
  modified_base (140)..(140): a, c, t, g, unknown or other
  misc_feature (140)..(140): n is a, c, g, or t
  modified_base (180)..(180): a, c, t, g, unknown or other
  misc_feature (180)..(180): n is a, c, g, or t
  modified_base (214)..(214): a, c, t, g, unknown or other
  misc_feature (214)..(214): n is a, c, g, or t
  modified_base (248)..(248): a, c, t, g, unknown or other
  misc_feature (248)..(248): n is a, c, g, or t
  modified_base (266)..(266): a, c, t, g, unknown or other
  misc_feature (266)..(266): n is a, c, g, or t
  modified_base (636)..(636): a, c, t, g, unknown or other
  misc_feature (636)..(636): n is a, c, g, or t
  modified_base (701)..(701): a, c, t, g, unknown or other
  misc_feature (701)..(701): n is a, c, g, or t
tcagactactatgtcacgaccggtgctcgatttagtgtgagtagtttgggtttggcacgaccggtgctcgatttagtgtgagtagtttgggttggggagagctgctcagttaggacccagaggaaccatcggaaaccccngcgcagccttctcttcctcctgctactctcggcctcccanccatccgaccgggagtattgtgttgacgcagtcnccgagcctaccttgttcttgtcctcggagggganagaccgccaccctctccngcgacggccagtacgagtgtgttacgcagcacgtcttacttacgccgtacggtaaccgacgaaccgtaaacggaaccgtcggacccgtcggaccctacccgtacggtcctaccctctaacttcgtagtcggtcgtacccgtacccgaaccggaccggtaccgtacgttccgggacgttcccggaccgggtacgtacggtttgacgggtcggtaccgtagggttcggtcggtttaacggggactacggttacccttcgtaccttcgtaccgataccgtactaccggaacgagttacggacggtacccgtaaccggtaatttcgttcgacgttgttactagttctacggtactacgttcgttaccggtttcncccgttttcacccgtttacttacgtaacgttccctttacggtttccaacccgggttcggttaacnggttaccggtaacgg

SEQ ID NO: 157742 - DNA, 642 bp, Homo sapiens
  misc_feature: GYAE6OF01C4UOH.24.78.H01.1.454.CMB.1.raw
  modified_base (245)..(245): a, c, t, g, unknown or other
  misc_feature (245)..(245): n is a, c, g, or t
  modified_base (310)..(310): a, c, t, g, unknown or other
  misc_feature (310)..(310): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatcggaaaccccagcgcagcttctcttcctcctgctactctggcctcccagccatcgaccggaggaattgtgttgacgcagtctccaggccaccttgtctttgtctccgagggganagacgccaccctctctcgcgacgggccagtcagagtgttagcagcagctactacgccgtcgaccngacacgaacctggcctcggcctccgagcctcctcactctagtggcgtaccgtcccaacggcgggtaccctaacggtcgggccgttcggaccgtaccggtacggttacgacgggtggacgtaggtcggtacggtttagggacgtaggtccttacacgtctactcgactagtcgacctaggtacgtacggacgaacccgttaagttacgtttacgaccgttggtacttacgttactcgggtactcgttcgttcggttccgtacccttccctccgtacgtttactactttaccggttcgtttccggaccgttacggttcccgaggttcgtaaggg

SEQ ID NO: 157743 - DNA, 573 bp, Homo sapiens
  misc_feature: GYAE6OF01ED3E0.24.78.H01.1.454.CMB.1.raw
  modified_base (240)..(240): a, c, t, g, unknown or other
  misc_feature (240)..(240): n is a, c, g, or t
  modified_base (365)..(365): a, c, t, g, unknown or other
  misc_feature (365)..(365): n is a, c, g, or t
  modified_base (430)..(430): a, c, t, g, unknown or other
  misc_feature (430)..(430): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgtctccagggganagagcccaccctctcctgcgagggccagtcagagtgtagcagcagctacttagcctggtaccagcagaacctggccaggcctccaggctcctcatctatggtactatccagcagggccagtggcncccagccaggttcaggtggcaggtgggtctgggacagtgttcactctacacctatcagcagttcngcagtctagtaagtagttttgactagttttattaccgtgaccctagacctacggtaccaacgtacggttacgtaacccgtcgggaccccgttaccgttacccgtaaccggtttcggggacccggggtaacgggtaaacccggg

SEQ ID NO: 157744 - DNA, 725 bp, Homo sapiens
  misc_feature: GYAE6OF01BOT1R.24.78.H01.1.454.CMB.1.raw
  modified_base (715)..(715): a, c, t, g, unknown or other
  misc_feature (715)..(715): n is a, c, g, or t
tcagactactatgtcacgaccggtgctcgatttagtgtgagtagtttgggtttggtacgaccggtgctcgatttagtgtgagtagtttggggtttggggagagctgctcagttaggacccagagggaaccatcggaaaccccagcgcagcttctcttcctctgctactctggcctcccgagccatcaccggaggaatttggtgttgacgcacgttcctccgacggcctacccgttgttccttttgtccgttaccggagggggacgaacgacgacccctaccccttcctcctaggccgacgggaccaagtcgaggtacgttgttaacgcgagcacgtcttaacttacgccttcggaaccagacaacggtaaccgtggtcccgtcggacctcccgaggtccctaccgttcacttcgtagtcgggtcgacccgtacccgaccggacggggtccctaggttcgggaccgtaccgggcggtaaccgttcggttaccgagggttcggtaccgtaggggtttccggtcggtttacgggaacgtaccgttacgttaccaccgtttcctacgtatacccgtaacgttaccgaccgtacggtacggtacgtacccggaaccgttagttacgtttgacttagttactttacgtacttgtacgtgttcgttcgttaccgtcccttcttaccttgtactcgttacgttcgttacgccgttacgtccgngttcgtgacg

SEQ ID NO: 157745 - DNA, 835 bp, Homo sapiens
  misc_feature: GYAE6OF01AV3WZ.24.78.H01.1.454.CMB.1.raw
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggctcccagataccactggagaagtagtcatgacgcagtctccagcccacctgtctgtcgtctccgaaggggaaacacgcccaccctctccgtgcgacgggccaggtagagtaagttggttcgggcaggtaccaaacgttacggcccgttaggtaacccgaggaccaacggtaaaacccgtcggacccgtaacgggccttaccccgaagggtcccttcccgtcccttactacgtcggaccttccgtccctacccgacccggtaccgggtcccccttagggtcccgtaccccgacgtcccggtacgggttttccggttcgggggtccgggttcggggtccgttacgggggaacttacggttacgtttccaccgttcctacccggaaacctacgtacccgtaacggtcccgggtacccttaccggtaacggtttcctaacggttaaacggttttactttttaccgtaaccttttacgtttttaacgttttccgtacggtttaaccctaaccgttaacggtttagtaccggggttcgtaacccgttccgggtaccctttacccggtttaaccgttaccggttttaccgggaacccggttaaaccggggtaaccctaaagggtacggtaacgtaaccgttaaaccgaaacgttaccggtacggtaccggg

SEQ ID NO: 157746 - DNA, 711 bp, Homo sapiens
  misc_feature: GYAE6OF01A7RZ4.24.78.H01.1.454.CMB.1.raw
  modified_base (157)..(157): a, c, t, g, unknown or other
  misc_feature (157)..(157): n is a, c, g, or t
  modified_base (290)..(290): a, c, t, g, unknown or other
  misc_feature (290)..(290): n is a, c, g, or t
  modified_base (340)..(340): a, c, t, g, unknown or other
  misc_feature (340)..(340): n is a, c, g, or t
  modified_base (395)..(395): a, c, t, g, unknown or other
  misc_feature (395)..(395): n is a, c, g, or t
tcagactactatgtcacgaccggtgctcgatttagtgtgagtagtttgggtttggggagaggagcccagcactagaagtcggcggtgtttccattcggtgatcagcactgaacacagaggactcaccatggagtttgggctgagcgtgggttttccncgtcgctcttttaagaggtgtccagtgtcaggggcagctggtgagtctggggcgcgtggtccaacctgggagtcctgacgactctctgtgcggcctccgatcacttcaatctatgacatgcacgttgggtccncgtaggcctccgaggtaccgaggggtcctggggacggtggggtcgcccgnttagtcctttagtttaggaagttgggaaattaacgtactaaagttatttacggtnaccgtaaggaccttacccgggtaaggaacggggttcccggttacaaccgtaacgttccctaccgaacggtaactaacctaactttaacccaaactaaaacttaccgttaccttacggttttcctaacgggtaactaaacggttacgtaaccgttacgtacccgtaggtacctaacgttacgttacgggaaccggtaccgtaccgggtacttacgttacttaccttaacgtggtacgaaccgtaagttacccgttcccccggtactttcgtaccgttagttcggttccggtaccgtacccctagtcggcggtaccgg

SEQ ID NO: 157747 - DNA, 810 bp, Homo sapiens
  misc_feature: GYAE6OF01AWQ7C.24.78.H01.1.454.CMB.1.raw
  modified_base (177)..(177): a, c, t, g, unknown or other
  misc_feature (177)..(177): n is a, c, g, or t
  modified_base (262)..(262): a, c, t, g, unknown or other
  misc_feature (262)..(262): n is a, c, g, or t
tcagactactatgtcacgaccggtgctcgatttagtgtgagtagtttgggtttggggagaggagcccagcactagaagtcggcggtgtttccattcggtgatcagcactgaacacagaggactcaccatggagtttgggctgagtcttgggttttcctcgtcgcttacttttaaggnggtcgtccaggtgtcgaggggcaggtcgtgggtggaggtccggtggggggcggtcggtcggtacccaacggtggggacgttcccngacgtctccgtcgtggtcggccggtccccgtccgtacttcctacctttacaaacgttacttagtcggctaagtcgacctaccggtcggggtacccgcccgaggccctacggaacggggacggtaacgggggcttagggggacggttcgggggtacgtccccgtattacgtttcgttttaggttggtaatagggtaaacttaaatactaaattactagtcgactacgtccgtaccggtaggaccgggtccgtacaaccgtactaccgtacgacgaacgtaactaacctaccaaactaacttacttactttacgttactacgtactaaacgtacgtaccgtctaccgtcgacgtacgtagtacggacgtaccgaccggttcgttacgttacttacggtttacgttacggtaggtaacccggttaaaccgttccccgttacccccggttacccgtttaccggtttaacgggtttaaccggttttacggggttaaccccgggttccccggtaacccccgttacggttaaccgggtccggggttaacccgggg

SEQ ID NO: 157748 - DNA, 716 bp, Homo sapiens
  misc_feature: GYAE6OF01A4JCH.24.78.H01.1.454.CMB.1.raw
  modified_base (276)..(276): a, c, t, g, unknown or other
  misc_feature (276)..(276): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggctcccagccatcaccggagaattgtgttgacgcagtctccgagcaccctgtcttgtctcgagggagagagccacctctcctgcagggccagtcagagtgtagcancagtcctacgttgcctggtacacgactaacgaaaccgtggaccgttcggccttacccgacggtaccttcctacctaacgttcccgtaagtccgggtcgcccgttacccgaaccggcggttccaacgttcggcgtccggcggactaggttcacggtgcgaagtcggtcgttaggactacgtaccgttcgtaacctcttcgaacttacgaacgttcgaccgacggtaacgtacgggtaaccgtaccccggtaaggttacttttacggaacggttagttacggtttaaactttaccggtacgttaccggtaaggtttccgttacggttttccccggttacccgttccccgttacccgtttaccggttacgtttaccggtttaaacccgtttcgttttaaccggggccgttaaccggggtttccctaagggtccggttaacggg

SEQ ID NO: 157749 - DNA, 703 bp, Homo sapiens
  misc_feature: GYAE6OF01C70HE.24.78.H01.1.454.CMB.1.raw
  modified_base (205)..(205): a, c, t, g, unknown or other
  misc_feature (205)..(205): n is a, c, g, or t
  modified_base (573)..(573): a, c, t, g, unknown or other
  misc_feature (573)..(573): n is a, c, g, or t
  modified_base (661)..(661): a, c, t, g, unknown or other
  misc_feature (661)..(661): n is a, c, g, or t
  modified_base (687)..(687): a, c, t, g, unknown or other
  misc_feature (687)..(687): n is a, c, g, or t
tcagactactatgtcacgaccggtgctcgatttagtgtgagtagtttgggtttggggagagctgctcagttaggacccagagggaaccataggaaaccccagcgcagcttctcttcctcctgctactctggcctcccagccatccgaccggaggattgtgttgacgcagtctcgaggcctacctgtctttgtctaccgagggganacgacgtccctacctctccgtgcgacgggccaagtcaaggtagttgtacgcaagcagcttaacgtcgccgtacggtaccgagaccgaacgtaaaccgtcggtccgtacggacccgttaccgacggtcctcctacgtaacttacttacggtcggttccgaccgtacccgtaccgacggaccctacgtccgggtcgaccggacgggtaacgtacggttcggacggttcggacgtacgggttcggtacgtttacggggacctaggtaccttgtaccgttactacgtactataccgtacggaacgtcggaacgttacggaaccgtaccgttaaagtttcgttacgtacgtagttaacgttacttcgtacgtntacgtgtttaccgttaccgtcctaccgttcctacgttacgttacttcttacgttcggccggttcggtcgaccggtgtacggtacgtanacggagtaccgtagtcctgggtaccnggtacctcgtacttcg

SEQ ID NO: 157750 - DNA, 767 bp, Homo sapiens
  misc_feature: GYAE6OF01CJLUY.24.78.H01.1.454.CMB.1.raw
  modified_base (179)..(179): a, c, t, g, unknown or other
  misc_feature (179)..(179): n is a, c, g, or t
  modified_base (183)..(183): a, c, t, g, unknown or other
  misc_feature (183)..(183): n is a, c, g, or t
  modified_base (247)..(247): a, c, t, g, unknown or other
  misc_feature (247)..(247): n is a, c, g, or t
  modified_base (256)..(256): a, c, t, g, unknown or other
  misc_feature (256)..(256): n is a, c, g, or t
  modified_base (273)..(273): a, c, t, g, unknown or other
  misc_feature (273)..(273): n is a, c, g, or t
  modified_base (282)..(282): a, c, t, g, unknown or other
  misc_feature (282)..(282): n is a, c, g, or t
  modified_base (289)..(289): a, c, t, g, unknown or other
  misc_feature (289)..(289): n is a, c, g, or t
  modified_base (298)..(298): a, c, t, g, unknown or other
  misc_feature (298)..(298): n is a, c, g, or t
  modified_base (308)..(308): a, c, t, g, unknown or other
  misc_feature (308)..(308): n is a, c, g, or t
  modified_base (406)..(406): a, c, t, g, unknown or other
  misc_feature (406)..(406): n is a, c, g, or t
tcagactactatgtcacgaccggtgctcgatttagtgtgagtagtttgggtttggggagaggagcccagcactagaagtcggcggtgtttccattcggtgatcagcactgaacacagaggactcaccatgggagtttgggctggagcgttgggttttcctcgtcgtcttcttttaaagnggtntccagtgtcgaggggcagctgggtggagtcggtgggggcgcgtcggtccaacgtgggacgtccngacgcttcnccgtgcgcgtcctccgnttcaccttnaatactntgacatgcncgtcgggccncgacggcctccgaggaccggaggggtctaggggtacggtggggtcgaccgtacttattcgtttattaggattagggaaatttaacacgttaaagtttnttaagtgaacctacggtaccgttccgggtaagggacggggttccccgttaaacacctacctccgtaccgaagaacgttaactaacgttaaacccaaacgttaacttccgttactttacgtttacgtagtaaacctaaagtccggtaaccctaacggccgtaacggttcgaacgtttcgaaccggaacggtaccgtacggttcttcggttacttacggtttacgtaacggttcgaaacccggttaaaccggttccccggtttacccccggtaaccttttaccgttaacggttacgggttttacccgggtcccgggggttaccccctaccccgttaagtaacggggttcggtaaacccggggg

SEQ ID NO: 157751 - DNA, 798 bp, Homo sapiens
  misc_feature: GYAE6OF01BALKV.24.78.H01.1.454.CMB.1.raw
  modified_base (233)..(233): a, c, t, g, unknown or other
  misc_feature (233)..(233): n is a, c, g, or t
  modified_base (241)..(241): a, c, t, g, unknown or other
  misc_feature (241)..(241): n is a, c, g, or t
tcagactactatgtcacgaccggtgctcgatttagtgtgagtagtttgggtttggcacgaccggtgctcgatttagtgtgagtagtttgggtttggggagagctgctcagttaggaccagagggaaccatggaaaccccagcgcagcttctcttcctcctgctactctggctccagccatcgacggagtattgtgttgacgcagtctccagcacctgtctttgctcgaggganagcgcccncctctcctgcgagggccagtcaggtagtgttacgcgacgcacggtactaaccgttaggccctagggtacccagtaccaacggtaaacccgtcggtccgtacgggtccctaccccggaggtcccttacccgtcctaacgttccgtacgtcggggtacgcccgtacccaccggtacggggacccctaccggttcgggtcccggtacccggtaccgggtaacgtttacggggttaccgtacggggttacgggaccggttacggttacggggttaccgggttttgggaacccggtaacgttaccgtttaccgtaccgtttccgtacctacgttacgtaccgtaccgaacgaccggtacgtacgggaaccgtaaccggtaagtttactttacggacgttaggtttacgttaacgttaccgtaggttaaccctagggttccttttacgggtttcccggtttcccgtacccgtttccgttaccgttaccgtttaccggttaacccgtttaccggttttaccggtacccgggttaccgggtttaccgacggggttccgttaaggg

SEQ ID NO: 157752 - DNA, 745 bp, Homo sapiens
  misc_feature: GYAE6OF01C8KBJ.24.78.H01.1.454.CMB.1.raw
  modified_base (308)..(308): a, c, t, g, unknown or other
  misc_feature (308)..(308): n is a, c, g, or t
  modified_base (333)..(333): a, c, t, g, unknown or other
  misc_feature (333)..(333): n is a, c, g, or t
tcagactactatgtcacgaccggtgctcgatttagtgtgagtagtttgggtttggggagaggagcccagcactagaagtcggcggtgtttccattcggtgatcagcactgaacacagaggactcaccagtggaggtttggctgagtcgttgggttttcctcgtcgtcttacgttttaagaggtgtccagtgtcgaggggcaggctgggtggacgtcgtgggggcgcgtcggtccaaccgtgggacgtccctgacgtctctccgtgtcgccggtccctccgtattccacctttacaaacttactttagnggactatgcctacggtcgggtcccncgaggcctacgaggcgaaggggctaggggaggtcggggtcgcccgtatttaacttcgtttagttgagttacgggaaaatttactactaaagtttattagttcgaaccgtacggtacccgtccgggtaagggtaaaccgggggttcccctttacaacccgtagttcccgtaccgaaggtaaccgtaaccttaaaccgtaacctaaacttaacttacctttactttcgtttactacgtaaactaagtacgtaacctacgtcctgtacgtactcggttacgacgggtacgtaccggttcttacggttacttaagttacgttacggtacggacgtaaccgtacccggttccccgtccttacgtaccgtacgttacggttacggttaccggggttccctacccgtgtcggtaccggg

SEQ ID NO: 157753 - DNA, 806 bp, Homo sapiens
  misc_feature: GYAE6OF01EOL5W.24.78.H01.1.454.CMB.1.raw
  modified_base (316)..(316): a, c, t, g, unknown or other
  misc_feature (316)..(316): n is a, c, g, or t
tcagactactatgtcacgaccggtgctcgatttagtgtgagtagtttgggtttggggagaggagcccagcactagaagtcggcggtgtttccattcggtgatcagcactgaacacagaggactcaccatggagtttgggctgagtcgttgggtttttcctcgtcgcttcgtttttaaggaggtgtccagtgtcgaggggcagcgtggtggagtcgtggggcgcgtggtccaacgtgggagtccctgacgctctccgtgtcgccggtcctccgattcaccttcaattacttagtcggcatgaccacgtcgggtcccnccgaggcctacgacgggcgaacggggtctagggaggtcgggtcggccgtacttagttcttttaagtttggaagttacgggtaaagtaacttactaaaagtttattagtcggactaacggtccgtacccggtaggggaaccgggttccccgtttaccgaaccgtacgttccgtaccgtaacggtaacgtaaccgtaacttaaccctaaactaaacttaaccgttacgtttacgttttacctaacgtaacgtaaagttaccgtaacgtaacgtcccgtacgacgttacgttcgtacgggacggtaccgtaccggttacgttcgttaacgtttacgtttacgttacggttacgggaaccggttaaacccggttaccccggtttacccccggtttcccgtttaaccggtttaaccggtttaacgttttaccggggttcccggggttaccccgtaccccccgtttaaggtaccgggttaccgggttaacccgggg

SEQ ID NO: 157754 - DNA, 675 bp, Homo sapiens
  misc_feature: GYAE6OF01A16WB.24.78.H01.1.454.CMB.1.raw
  modified_base (156)..(156): a, c, t, g, unknown or other
  misc_feature (156)..(156): n is a, c, g, or t
  modified_base (300)..(300): a, c, t, g, unknown or other
  misc_feature (300)..(300): n is a, c, g, or t
  modified_base (387)..(387): a, c, t, g, unknown or other
  misc_feature (387)..(387): n is a, c, g, or t
  modified_base (524)..(524): a, c, t, g, unknown or other
  misc_feature (524)..(524): n is a, c, g, or t
tcagactactatgtcacgaccggtgctcgatttagtgtgagtagtttgggtttggggagaggagcccagcactagaagtcggcggtgtttccattcggtgatcagcactgaacacagaggactcaccatggagtttgggctgagctgggttttccncgtcgctcttttaagaggtgtccagtgtcgaggggcagctggtggagtcgtgggggcggcgtggtccaacgtgggagtccctgagactctcctgtcgcggcctccgattcaccttcaatacttatggcatgcacgtcgggtccnccgaggcctccgagggaccgaaggggcctagggaggtggggtcggccgtcttatcgtttatttgagtaggtaacgtaatacaaattnttatgcagaccttccgggtaggaacgggtcccggttacaaccgtacttaccctaccaagacgtaacctaaccttacccaaactaaacttacttcttcgtttacctacgtactaaagtacgtactacgcctgtacgtntacgtacggacgtacgtaccggtacgttacgtaccttaacgttacgtagtacgtaacggtaacgttcccggtttacccccggtacccttttccgttaacgtacggtttacggttcggggtacccgtaccccgtatacggtcgggtaccggg

SEQ ID NO: 157755 - DNA, 740 bp, Homo sapiens
  misc_feature: GYAE6OF01D6MEP.24.78.H01.1.454.CMB.1.raw
  modified_base (285)..(285): a, c, t, g, unknown or other
  misc_feature (285)..(285): n is a, c, g, or t
  modified_base (294)..(294): a, c, t, g, unknown or other
  misc_feature (294)..(294): n is a, c, g, or t
  modified_base (315)..(315): a, c, t, g, unknown or other
  misc_feature (315)..(315): n is a, c, g, or t
  modified_base (367)..(367): a, c, t, g, unknown or other
  misc_feature (367)..(367): n is a, c, g, or t
tcagactactatgtcacgaccggtgctcgatttagtgtgagtagtttgggtttgggggaggagcccagcactagaagtcggcggtgtttccattcggtgatcagcactgaacacagaggactcaccatggagtttgggctgagtcgttgggttttcctcgtcgtcttacttttaaggaggtgtccaggtgtcgaggggcagcgtggtggagtcgtgggggcgcgtggtccaaccgtgggagtccctgacgtcctctcctgtcgccggtcctccgattccaccttnaatacttanggcatgactacgtcgggtccncgtaggcctaccgaggtccggaaggggtctaggggacggtggggcggccgtnttagtctttagttgagtaggtaataactacaaattatagcgacgagtaccgtcggtaggaacgggtcccgttacaccgtacttccgtaaccgaagtaacgtaacctaaacttaacccaaactaaacttaccgttacgtttacgtttaccgtaacgtaactaaagtacgtacgttacgtaccgtacgtacgtacgttaccgtaacggacggaacccgtacggtacgttacgttaacgttacgttacgttacggtacgtaaaccggtaaaccggttacccgttcccccggttaccgtttaccgttaacgttacgtttacgggttaccgggttacccgtacccccgtaagtaccggttcggtaccggttaccgggg

SEQ ID NO: 157756 - DNA, 995 bp, Homo sapiens
  misc_feature: GYAE6OF01C0TJX.24.78.H01.1.454.CMB.1.raw
  modified_base (153)..(153): a, c, t, g, unknown or other
  misc_feature (153)..(153): n is a, c, g, or t
  modified_base (171)..(171): a, c, t, g, unknown or other
  misc_feature (171)..(171): n is a, c, g, or t
  modified_base (191)..(191): a, c, t, g, unknown or other
  misc_feature (191)..(191): n is a, c, g, or t
  modified_base (974)..(974): a, c, t, g, unknown or other
  misc_feature (974)..(974): n is a, c, g, or t
tcagactactatgtcacgaccggtgctcgatttagtgtgagtagtttgggtttggggagaggagcccagcactagaagtcggcggtgtttccattcggtgatcagcactagaacacagacggacctcacctagtgggtaggttttgggctggngtcgtttcgggttttccncgtcgtcttacgttttaagnggttgtccaggttcgacgaggggctagtcgtgggtggtacggtcggtaggggggccgtcgttcgggaccctaaaccgggtggggtaaccggttccctaggaacgtaccttccgttccggtggtacggcccggttcccttaacccggtaaattttccaaacctttaacgtaaactttaaccgtttaggacgggtacctaagttccggtaaccgtaaccggtttccggggtaccccgaccgtaacgggttcccgtaaaccccggaagggaacccgggtaaagggggtccgtttaaggggggacgggtttccgggggacggtccccggttaattttaaacgttccggttttaaagtttaggaaaggttagggtaaaaaccgtttaaacttaaccgtaaaaagttttacgttaacggttacgaaacccgtaaacggttaccggtaccccggggttaagggtaaacccggggtacccgtttacaaaccccttaagtccgtaaccgaaacggtaacctaaacttaaaccgtaaccctaaaacgttaacttaacctttcgttcggtttaacagtaaacctaaaggtccgtaaacgttcggaccgttagggaacttaacgtaccggtaaggtaacgggacccttacggtacgtttacgttaacgttaacttacggtaccggaaagttaaacccggtaaacgtacccccggtttaccccggttaaccttaacgggttaacgtttaacgggtttaacgggttcccggggttaaaccccacccgttttaaacgngggtaccggtttaaaccgggg

SEQ ID NO: 157757 - DNA, 842 bp, Homo sapiens
  misc_feature: GYAE6OF01C8QY0.24.78.H01.1.454.CMB.1.raw
  modified_base (140)..(140): a, c, t, g, unknown or other
  misc_feature (140)..(140): n is a, c, g, or t
  modified_base (239)..(239): a, c, t, g, unknown or other
  misc_feature (239)..(239): n is a, c, g, or t
tcagactactatgtcacgaccggtgctcgatttagtgtgagtagtttgggtttggcacgaccggtgctcgatttagtgtgagtagtttgggttggggagagctgctcagttaggacccagacggaaccatcggaaacccngcgcagcttctcttcctcctgctactctggctccagcatcaccgggagtaattgtgttacgacgcagtctccaggccacctgttcttgtctcgaggganacgacgcctaccctctaccgtgacgtacgggactacggtcacggtaggtagttacgacgacgacgtacggtacccttaacgtacggtaccttacgggtaaacccacggtaaccgaaccgggtaaaaccgttccggtacccgtacgggtacccgttacccggaacgggttcccttaccctaccgtaacgtttaccgtagttacgtacgtttaccgttacctaaacccggtaacggtacgggtaccgtaccggtccgggtaacccccgtccccgggtaacgttaccggttaccgtacgggttacggcgtaagggttcggtccggtaaccggtagaacggttacccttacgtaaccttaccgtacccgtaccgtcgaacgtccgtacgtaccgtttacggacttaaccggtaggttaactttaccggttttacggttaccgtttaccgtaacgtcgttacccgagaccggttacgttcccgtacccgggacgttaccggtccccgggttaaacgtttacccgggggttcgggggaaacccgggggttacggtaggggttaaccggggaaggtaccgggttaaaccggcgggttaaaccgttcgggg

SEQ ID NO: 157758 - DNA, 764 bp, Homo sapiens
  misc_feature: GYAE6OF01C1JNH.24.78.H01.1.454.CMB.1.raw
  modified_base (157)..(157): a, c, t, g, unknown or other
  misc_feature (157)..(157): n is a, c, g, or t
  modified_base (274)..(274): a, c, t, g, unknown or other
  misc_feature (274)..(274): n is a, c, g, or t
  modified_base (301)..(301): a, c, t, g, unknown or other
  misc_feature (301)..(301): n is a, c, g, or t
tcagactactatgtcacgaccggtgctcgatttagtgtgagtagtttgggtttggggagaggagcccagcactagaagtcggcggtgtttccattcggtgatcagcactgaacacagaggactcaccatggagtttgggctgagcttgggttttccncgtcgctcttttaagatgtgtccagtgtcgaggggcagctggtggagtcgtgggggcgcgtggtccaacctgggaggtccctggagactctcctgtcgcggcctccgattcaccttnaatactatgcatgctagtcgggtaccncaggcctccgagggccgaaggggcctagggaggttggggtcgcccgtatagttccgttaagttttggaattaggggtaaacgtaaagttaccaaaagttatttaagtgtaccgaagtacccgttccggtaagggaacggggtcccgttaacccgactacgtcctaccgaacgaacgtaaccgtaaactttaacccgtaaactaaacgttaaccttccgtttacgtttacgtacgtaacgtaaattaaccggtaacttaacgccttcggtaacgtacttaaccggtagggtacggtacgtaacggtccgttacgttaccgtttaacgttacgttagtacgtaaaccggtaaacggttacccgtttaacccccgggttcccgttttaacccgtttaacggtttaacgtttacggttacccggggttaccgggttaacccccctaacggttacggttaacccgggg

SEQ ID NO: 157759 - DNA, 837 bp, Homo sapiens
  misc_feature: GYAE6OF01EZAH9.24.78.H01.1.454.CMB.1.raw
  modified_base (184)..(184): a, c, t, g, unknown or other
  misc_feature (184)..(184): n is a, c, g, or t
  modified_base (295)..(295): a, c, t, g, unknown or other
  misc_feature (295)..(295): n is a, c, g, or t
tcagactactatgtcacgaccggtgctcgatttagtgtgagtagtttgggtttggggagaggagcccagcactagaagtcggcggtgtttccattcggtgatcagcactgaacacagaggactcaccatggaggtttgggctgagtcgttgggttttcctcgtacgcttacttttaaggaggtnttccagtgtcaggggcagtcgtggtcggagttcgtgggggacgcgtggtccaacgttgggacgtcctgaagcctcgtccgtgtcgccggcctccgtattccgtacccttanaacttaccgttaagtcggactaatcggaacctcggtcggtcccgaccgtaccggcgtccgaagggtccgtaaaggggcgttggaggtcgggtccgacctattagttactttaaggtgtacgttagggaattaaactagtaaattagttacagacccgtagtaccgtcgggttaaacgggaacccgggtcgttaccaaaccgtacgttaccctaacggtaacgtaaccgtaacgtaaacttaaccctaaaaacgtaactttaccgtcgtttacgttacctaagtaacctaaagtaccgtacgtacggtcccgttagacgtaaaccggtctagggtaaacccggtacgtaccgggtttacctaacggttacctttaaacttaccgggttaccggtaaaccgaaaccgggtttaaaaacccctttcccccggggttaaccccccgtttaaccccgtttaacgttaaccgggtttaagtttacccggggtcccggggttaccccctaaaccccgtacggtaacgggttcccggttaaacccggggg

SEQ ID NO: 157760 - DNA, 646 bp, Homo sapiens
  misc_feature: GYAE6OF01A3QR1.24.78.H01.1.454.CMB.1.raw
  modified_base (267)..(267): a, c, t, g, unknown or other
  misc_feature (267)..(267): n is a, c, g, or t
  modified_base (414)..(414): a, c, t, g, unknown or other
  misc_feature (414)..(414): n is a, c, g, or t
  modified_base (422)..(422): a, c, t, g, unknown or other
  misc_feature (422)..(422): n is a, c, g, or t
  modified_base (432)..(432): a, c, t, g, unknown or other
  misc_feature (432)..(432): n is a, c, g, or t
tcagactactatgtcacgaccggtgctcgatttagtgtgagtagtttggggtttggggagagctgctcagttaggacccagagggaaccatggaaaccccagcgcagcttctcttcctcctgctactctggcctcccagccatcaccggaggaattgtgttgacgcagtctccaggccaccctgttctttgtctccgaggggagagacgccaccctctcctgcagggccagtcagagttgtagcagcagtctactacgcctggaccngacaagaacctcggctcggcctccgaggccttcctactacttctagtcggtccgccgtcccgaccggtacggacctacgtcgggtccgtcggccggtaagtcggttcaggttcgcgtaggtcggtgtttcgggaacagtaccttacncttcactntcactacganacgtcgtggaccgaccgttaagttcttgactagttgttacttactcggtacctagttcgtttcgtttcccgtcccttaccgttccccttacgtagttaccgttacgtttacggtttccggtacccggttagggttacccgcggttacggtaggtacgtacgtaccggtaaggtccgttaagtcggggtacgtctaccggaccctagtgttaccg

SEQ ID NO: 157761 - DNA, 886 bp, Homo sapiens
  misc_feature: GYAE6OF01CKI6Q.24.78.H01.1.454.CMB.1.raw
  modified_base (159)..(159): a, c, t, g, unknown or other
  misc_feature (159)..(159): n is a, c, g, or t
  modified_base (460)..(460): a, c, t, g, unknown or other
  misc_feature (460)..(460): n is a, c, g, or t
tcagactactatgtcacgaccggtgctcgatttagtgtgagtagtttgggtttggggagaggagcccagcactagaagtcggcggtgttccattcggtgatcagcactgaacacagaggactcaccagtggagtttgggctgagtcttcgggttttccncgtcgtcttcgttttaaagaggtcgtccagttgtcgaaggggcagtcgtggtggagtcggtgggggacggtcgtcggtacccaaccgtggggtacggtcccctaggtacgtaccttccgttccgtggtaccggccggtcccgttaccccggtatttacccgtaaccctttacaaaactttaccgtttaacgtcgggactagtacgtacccgacgttccggggtccccgacgaacggtccgttacccggaggtacccggaaggggtcgttaacggggacggtttcgggggtccgaccccgtntttaacgttccttttagttacggaggttaaggtaaacgtttacaccttaaaagtttcgttaacgtcgtaccaagggttacctaccgggggttcgaaaacccggggtttcccggttaccacccgtacgttaccgtaccgaacggtaacgtaacttaaaccgttaccctaaagttaacttccgttactttcggttttaccacgtaacgttaaacgtcggttacctaacggttccgtaacggtacccgttacgttaccgggtaagggtaacccgacggttaccggttaccgttaggttacctttaacggttatacggggtactaacgggaaaccgtttccccgttaccccggttacctttacgggttaacgttaccgtttcgggttccgggaccccgtacccctttagcgggttacggttaacccgggg

SEQ ID NO: 157762 - DNA, 970 bp, Homo sapiens
  misc_feature: GYAE6OF01BZIFC.24.78.H01.1.454.CMB.1.raw
tcagactactatgtccacgaccggtgctcgatttagtgtgagtagtttgggttggggagaggagcccagcactagaagtcggcggtgtttccattcggtgatcagcactagaacacgagaggacctcaccagtggtaggtttgggctggagtcggtttcggtttcctcgttcgtacttttacgtttaaggtggttcgtcgtagtcgtacggaggggctaggtcggttggggtgggtacgggttcgggggtcggggggtccggtccggttccggtacccggtaaccgggtcggggggtaccggttcccgtagggaacgttccttcccgttcccgttcgggtccggtcccggtaccccgttacccgttaccgtttacccgtacccgttttaaccttaaacgtttacggttaagtccggaccttaacgtcggtaccgtaccgggttccgggtacccgtaccggaccggtaccctaaccgggacggggacgggtaacggggtcggttaggggtacggggtcggggtccggtcccgttaagttttcgtttacggttttatagggacggttaaagggtaaactttacgtagtttaaacgtttaggtttacgtcggtacccgtaacgggttcccggttacgggggttaacggggtaaccccgggttaccggttaaccctacccttaacgttacccgttaaccggaaacgtaacccgttaaacctaaaccgtttaaccccgaaaaacttttaacccgtaaccggtttaaccgtttacggtttaaccctaagttaaccggttaacgttaaccggtacccttaacgtccgtacgtacgtcgttacgaacggtacgtaccgtagttacttacgtacttacggcggtacgggacgaaccggttacgttccccggtacgtttaccgttagtaccggtttggtacggtacccgggttcccaccggttacgcgggttccggtacg

SEQ ID NO: 157763 - DNA, 855 bp, Homo sapiens
  misc_feature: GYAE6OF01EQ8A4.24.78.H01.1.454.CMB.1.raw
  modified_base (146)..(146): a, c, t, g, unknown or other
  misc_feature (146)..(146): n is a, c, g, or t
  modified_base (671)..(671): a, c, t, g, unknown or other
  misc_feature (671)..(671): n is a, c, g, or t
tcagactactatgtcacgaccggtgctcgatttagtgtgagtagtttgggtttggcacgaccggtgctcgatttagtgtgagttagtttgggttggggagagctgctcagttacggacccaggacgggaaccatacggaaaccccngcgcagtcttctcttcctcctgctactctcggacctcccagcctacgtccgaaccgggtaggtaatttggtgttcgaaccgctacgtcctaccgacggtcctacccgttgttctttcgtccgtaccggaggggacgaacggtccgcccctaccccttcgtcccgtacggaccgacgggacctaacggtaccgtaggtacggttgttacggaccgtagacggtaaccttacgttaaccgtaccggtcccgtacggaacccgaggaaccgtaaaccggtaacccgtccgggtacccgttaccgggtccccttacccggtacggttacccctaccgtttaccgtaacgtttccggtaacggttccggggtcccgtaaaccccgtacccgaaacccgggtccggacccctacggggtcccggtccgggtaccggtaacccgggtaggttaacccggttaccggtagggtaccggttacggtacgggttcggttacggttaacgggacttaccggttcttaccaccgttntaaccgtcgtacgcgtaacgacgacgggtactacggtaccgttacggtagtttccgtagacgtttgtacgttacgttacgtagttctaccggttcgttttaccggtccgttacccgtcttacccgttaacgttcgttaacttccgttccggttaggacccggtttacggtctacgggtgtaacg

SEQ ID NO: 157764 - DNA, 881 bp, Homo sapiens
  misc_feature: GYAE6OF01B8HXT.24.78.H01.1.454.CMB.1.raw
  modified_base (287)..(287): a, c, t, g, unknown or other
  misc_feature (287)..(287): n is a, c, g, or t
tcagactactatgtcacgaccggtgctcgatttagtgtgagtagtttgggtttggggagaggagcccagcactagaagtcggcggtgtttccattcggtgatcagcactgaacacagagactcaccatggagtttgggctgagcttgggttttcctcgtcgcttcttttaaggaggtgtccagtgtcgaggggcagcgtggtggagtcgtgggggcggcgtcggtccaacgtgggacggtccctgacgacctctccgtggtcgccggcctcccgattccgaccttanaaactctttagcggcagttgaccgtaccggttcgggtaccccgccgacgggtccctaccggtaacggggcggaacggggggtccttaggggaggggtttcggggtacggcccgtagtttacgttccgtttagttttacggaagtttacgggtaaaagtttaactacgtaaagtttacgttacgtggaccgtaacggtaccgttaccgggtacggtaaccggggtacccgtttacccaaccgtaacgttccgtacccgtaagtaaccgttaaccgtaaacctttaacccctaaacgttaaacttacccgtttaccgtttacggttttaccgtaacggtaaaccttaaacggtaccgtaaccgttaccggttaccgttaccggaacgttaccggttacgtacgggtaaccggtaacccggtccgggttaccttaacggttaccgtttaagttaccggttacggtaccggtaaccggttaaaccgttaccccggttttacccccggttacccgttttaccggttaccgttaaggtttaccgggttaccggggttaccccgtacccccgttacggtaacgggtcccggttaaccgggg

SEQ ID NO: 157765 - DNA, 693 bp, Homo sapiens
  misc_feature: GYAE6OF01EITGA.24.78.H01.1.454.CMB.1.raw
  modified_base (251)..(251): a, c, t, g, unknown or other
  misc_feature (251)..(251): n is a, c, g, or t
  modified_base (357)..(357): a, c, t, g, unknown or other
  misc_feature (357)..(357): n is a, c, g, or t
  modified_base (496)..(496): a, c, t, g, unknown or other
  misc_feature (496)..(496): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatcggaaaccccagcgcagcttctcttcctcctgctactctggcctccagccatcgacggagattgtgttgacgctagtctccgaggccacccgttgttcgtttcgtctaccggaggggtanacgacgcccacccgtctccgtgcgacgggctagtcagtagtgtacgcagacagtcttacgtacgccgttagaccagcaacggtaccgtggtccgtacgccgtaccncggtcctcgtactaagtcttagtcggtcgtcccgtaccgacgccggtccgacgtcggccgtcggaccgtacgttacggttacgcgttacgggcgttagggttcgggttacgttacgggactacggttaccttcaccttntactacgttcacgtcgtagacggtcgtacggactaccggtaagtttacttcggacgttagttcgttaattccggtagttaccgcggtttacgttccggtttaccggttccccttcttacccgttccgttaacgttcccgtttaaaccgtttccggttttaccgacccgggttaagggttccctagggtagtacgggg

SEQ ID NO: 157766 - DNA, 747 bp, Homo sapiens
  misc_feature: GYAE6OF01BH6E3.24.78.H01.1.454.CMB.1.raw
  modified_base (237)..(237): a, c, t, g, unknown or other
  misc_feature (237)..(237): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtcctccagcaccctgtctttgctcaggganagagcccacctctcctgcagggccagtcagagtgtagcagcagctactagctaggtaccagacacgaaccgtggcctaggcctccgaggcctcctcactctacgtcggtgccgtcccacgacggccacgtcggcggtcgacggacgtaggttaccaggtcggacgtacggttggtaccgtttacggggaaccgtacggtacctttaccgtaaccgttacttaccgtaacgttccaacgttaccggtaacgtaccggtaaccgttagggaaccggtaacccggtaaagtttaccgtttacggtacgtaacgtttacggtttaacgttttaccgtaggtttcctaaacgggtttccgttttacggttttacccgggtttacccccgttacccgtttaccccgtttacccgtttaaggttacccggttttaaacctttacccgggttttttacccggggaccccggtttaaccgggggtttaccccggttaaccgggttcccggttaaagggg

SEQ ID NO: 157767 - DNA, 895 bp, Homo sapiens
  misc_feature: GYAE6OF01BRW26.24.78.H01.1.454.CMB.1.raw
tcagactactatgtcacgaccggtgctcgatttagtgtgagtagtttgggtttggggagaggagcccagcactagaagtcggcggtgtttccattcggtgatcagcactgaacacagaggactcaccatggagtttgggctgagtcgttgggttttcctcgtcgcttcgttttaaggaggtgtccagttgtcgaggggcagtcgtgggtggagttcggtgggggcggtcggtcggtacccaaccgtggggacgttcccgtggaacgtccttcgtccgtgtcggccggtcccttacccgattccacctttacaaatttacttagtcggactagttcgctacggttcgggtaccccgacgtacggtcctaccggaagggaccggtaaaggggggtcctagggggtacgggttcgggggtaccggtccccgttatttaacgtttccgttttaagttttacgggaagtttaacggggtaaaatttaaacgtaccgttaaaaatttcgtttaacgtcgggtaacccgtaacgggttaacccgtttcccggggttaaaggggtaaaccccggggggttaccccgtttacccaaaacccgttttacgttaacccccgggtaaccggtaacgggtaaacccggttaaaccgttaaaccctttaacccggtaaaacttaaacccgtttaacccgtttacgtttacccggttttaccgtaacggtaaccttaaacgttccggtaacttacggtccgtacgtacgtaacgttcggtaacggaccggtaccgtaccggtcttacgtacgttacgtacgtcggttacgaaccgttaccgtcccgtttaccccgtacttagtaccgttaggtttcggtccgggtaccctaccctagtcggtcggtacgg

SEQ ID NO: 157768 - DNA, 755 bp, Homo sapiens
  misc_feature: GYAE6OF01DKH4S.24.78.H01.1.454.CMB.1.raw
  modified_base (122)..(122): a, c, t, g, unknown or other
  misc_feature (122)..(122): n is a, c, g, or t
tcagactactatgtcacgaccggtgctcgatttagtgtgagtagtttgggtttggggagagctgctcagttaggacccagagggaaccatcggaaaccccagcgcagcttctcttcctcctnctactctgcctcccagccatccgaccggaggtattgtgttgacgcagtctccaggcctacccttgttctttgtcctccggaaggggagacgacgccctaccctcctcctgccgacgggccagtcaggtagttgtagcagcacgacttacgtcgtccgtacggtaccagaccaacggtaaccgtcggccgtcggccctacccgaggtcctaccgtctactccgttaggtcggtcgcccgtacccgaaccgggacgggccctacggtcgggtaccggtccggacggtaccgtacggtcgaggtcgcgtaggtcggttagttacggactacgtaccttccgtactctactactacgacgtaccgacgaggtaaccggtacgggaacccgtacccggttaaagtttcgtttacggacgtttacggtttacgtttaaccgttacgtcggttaccgtacgtttccggtttccgggttttaacccgtcccccttacgtttcccttaccgtttacgttcctttaccgtttcggtttccggaccggttaaccgggttccgaccggttgtacggtaaactccgtaacggtaccgtacgtaaccggttcggtaccggtactaccgtacgtaacccttgttaccg

SEQ ID NO: 157769 - DNA, 774 bp, Homo sapiens
  misc_feature: GYAE6OF01E067D.24.78.H01.1.454.CMB.1.raw
  modified_base (159)..(159): a, c, t, g, unknown or other
  misc_feature (159)..(159): n is a, c, g, or t
  modified_base (248)..(248): a, c, t, g, unknown or other
  misc_feature (248)..(248): n is a, c, g, or t
  modified_base (266)..(266): a, c, t, g, unknown or other
  misc_feature (266)..(266): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaacccccagcgcagcttctcttccncctgctactctggcctcccagataccactggaagaagtagtcatgacgcagtctccagccaccctgtcctgtcgtctccgaggggaaancgcccacctctcctgcgnggccagtgagaatgttcgcagcaactgcctggtaccagacaacgtaaacctggaccgacggccctacccgacggtccctccctacctctactcgtcctcgtccctaccccaccggaccgggcccccgttggtaccgtccccgtaccggtacccggtttaccggggtttacccggtttcggggtcccggggtttacggggtttaccgtaccgggggtaaccgtaacgggtttaccttttaacccgtaccggtttacccttaacccgaaccgttaacgttacccgacggtacccccggttacccgtaccgttacgttccgttacgtacgttacgttttacgctttaactttacgttacgtacgttaaccaacgtacttacgtaggttccgtaccgtacggtacccctacgttacccggttacggtttaccggaacccgggtaaccgggtaaccgtaaaccgggtacggtaaacgtaaccgtaaccgtaaaccggttaccgtcggtaccgg

SEQ ID NO: 157770 - DNA, 760 bp, Homo sapiens
  misc_feature: GYAE6OF01B11JK.24.78.H01.1.454.CMB.1.raw
  modified_base (300)..(300): a, c, t, g, unknown or other
  misc_feature (300)..(300): n is a, c, g, or t
tcagactactatgtcacgaccggtgctcgatttagtgtgagtagtttgggtttggggagaggagcccagcactagaagtcggcggtgtttccattcggtgatcagcactgaacacagaggactcaccatggaggtttgggctgagtcgttggggttttcctcgtcgtcttacttttaagaggtgtccagtgtcgaggggcaggctgggtggagtcgtgggggcgcgtggtccaacgtgggacgtcctgagtctctcctggtcgccggcctcccgtattccaccttacaaattactttagnggactagttcgacgtaccgtcgggggtcccaccgaggcctaccgaaggggcgaaggggggccttagggacgggtcggggtcggccgtacgtttattacgttttaagttgaaggtaggtaaaacgttaactactaaagtttatttagacggaccgagtaccgtaccgggttaagggaaccgggttcccgttaaccaactacgttacctaccgtacggaacgtaactaacgttaaccaaactaacttaccgttactttacgtttactacgtaactaagtacgtataccgtacgtacgacgtacgtacgtacggaacggtaccgacggttacttacgttacttaacgttcggttacgtaccggaaccggtaacgttacccggttccccgttacccgtttacgttaacgttacggtttacggtaccgggttaccggtaccccgtagtacggttcgggtaccggg

SEQ ID NO: 157771 - DNA, 853 bp, Homo sapiens
  misc_feature: GYAE6OF01DYJWR.24.78.H01.1.454.CMB.1.raw
  modified_base (190)..(190): a, c, t, g, unknown or other
  misc_feature (190)..(190): n is a, c, g, or t
  modified_base (203)..(203): a, c, t, g, unknown or other
  misc_feature (203)..(203): n is a, c, g, or t
  modified_base (210)..(210): a, c, t, g, unknown or other
  misc_feature (210)..(210): n is a, c, g, or t
  modified_base (287)..(287): a, c, t, g, unknown or other
  misc_feature (287)..(287): n is a, c, g, or t
tcagactactatgtcacgaccggtgctcgatttagtgtgagtagtttgggtttgggagaggagcccagcactagaagtcggcggtgtttccattcggtgatcagcactgaacacagaggactcacatggagtttgggctgagcggtcgtttcgcgtacgcgtacttaagtggtctcagtgcgagggcagngtggtgagtcggnggggcgngtcgccaacgtgggacgtcctggacactcgtcgtagtcgcggccttacccgatccacttactaatcgttagacggtntacgtgccgtacggttccggtccgccgtaacgtccgtaaccgaaccggagggttaaaggggccggtttaagggacgggtttcggggaccgggtccgttacccgtaacgtttacttttaaagtttaacggacggtttaaggaaaacggtttaaactaacgttaaacgttttagttaacgtccggaagtacccggttaccggtttaaccgggtaccggggaacgggggttacccttaccgaaaacgttacctaccggaaccttaacgggaaactaaccggtttaaaccgtaacccgttaaaacttaaacgttacccgtttaaatttcggttaccttagggaaaaccctaaggtaacccggttaaccaacgggtaaccctcgtaacggttacggaaccgttaacggaaccggtccggtaaacgttcgttaccgttccgttaaaacgtcgtgtaaaccgtacgtaaaccggtcccccgtttaccgttaacccgtttcgtaaccgttaacgtttacgggttaccccggggaccctttaacccgggaattttaccggcgggtttaaaccggg

SEQ ID NO: 157772 - DNA, 722 bp, Homo sapiens
  misc_feature: GYAE6OF01C27QK.24.78.H01.1.454.CMB.1.raw
  modified_base (252)..(252): a, c, t, g, unknown or other
  misc_feature (252)..(252): n is a, c, g, or t
  modified_base (270)..(270): a, c, t, g, unknown or other
  misc_feature (270)..(270): n is a, c, g, or t
  modified_base (709)..(709): a, c, t, g, unknown or other
  misc_feature (709)..(709): n is a, c, g, or t
tcagactactatgtcacgaccggtgctcgatttagtgtgagtagtttgggtttggcacgaccggtgctcgatttagtgtgagtagtttgggttgggagagctgctcagttaggacccagaggaaccatggaaaccccagcgcagcttctcttcctcctgctactctggcctcccagccatcgaccggagtaattgtagttgacgcagttccaccgaggcctacccttgttctttcgtccgtaccgagggganagacgccctacctctcgngcgacgggcctaagtcgaagtagtagtacgacagtcagtaccttacgttcgccgtaggtaccgagacgaacgtaaccgtcggaccgtacggcctcccgtacggtccctaccctagacttcgttagtcggtcgtcccgtacccgaaccggacggtaccctaggtccggaccggttccgggacggtaacgtacgggttaccgtaagggtcgggacgtagggttcgggttacggtttacgggactacggtaccttcaaccttcgtactacgtctacgttaccgactaacgtcggaacggaccgtaccgtaagtttcttacggacttagtacttacgttacgtacgacgttactcggtttccgtttccgtacccgttacttccgttacgttacgttacccgttaaccttacgggttttccggaaccggttaccgggttttccngggtccttaaggg

SEQ ID NO: 157773 - DNA, 967 bp, Homo sapiens
  misc_feature: GYAE6OF01D8KTR.24.78.H01.1.454.CMB.1.raw
  modified_base (212)..(212): a, c, t, g, unknown or other
  misc_feature (212)..(212): n is a, c, g, or t
  modified_base (537)..(537): a, c, t, g, unknown or other
  misc_feature (537)..(537): n is a, c, g, or t
tcagactactatgtcacgaccggtgctcgatttagtgtgagtagtttgggtttggggagaggagcccagcactagaagtcggcggtgtttccattcggtgatcagcaactgaaacacgaggacgtacctccacctaggtgggttagggtttcgggctaggcggttcggttttccgggttttcctcggtcttacttttacggttttaaagggnggttccgtaccgagggttcgtacgggagggggtactggtcggtaggggtagggtagggttccggggttcggggggccggttccggttacggtaccccgtaacggggttcgggtaccggtccgtaggaccgttccttccgtcggttggccgcccggttccctaccgtacttacccgtaaccttacgtaacgtttaacgttcggtcgaactcgtacggccgtccggggtcccggtaccgacggtaccggtccgacggggaccgggacggggaacggggttcggtggggtgggtccgggccggtaacctttgttaactttacggtttntaaggtagtaacggtaaaattacgtaaacttaatttcttacgacgtaacggtaaccgtaccggttacggggtaaccgggtacgttacccgttacctaactaccgttaccgaacgtaacgtaacctaaacctacgtaaaccttaacttaacttaccgttacgtttccgtttacaacggtaacttaacgtacgttacctaccgggtacgtacgttaacggttcgtaccgggtaaccggtaccggtaaccggttccttacggttaaccgttaccgttaagttaccggtacggtaccggaaacccgtttaacccggttccccggtttccccgttaaccggtttcggttaaacgggttttcggttaaccccggggtttcccggttaaaccccgtaccccgtttagggaacccgggtttgggtaaacccccggggg

SEQ ID NO: 157774 - DNA, 739 bp, Homo sapiens
  misc_feature: GYAE6OF01DIEZK.24.78.H01.1.454.CMB.1.raw
  modified_base (242)..(242): a, c, t, g, unknown or other
  misc_feature (242)..(242): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggctccagccatcacggaggaattgtgttgacgcagtctccaggccacccttgtctttgcctaccgagggganagacgcccaccctctcctgcgaggggccaggtcaaggtgtgttagctagctagacctactagcctggtaaccagacaagaacctggcctggcctccgagtcctcctacgattctagtcggtcgaccgtacccaaccgacggggtccctaacggttcgggaccgtccggacggggtaacgtaacgggtttccaagggttccggcgtaacgggttcgggtacgggtttacgggaactaacggtaccttccgtaacgttcctaccgtaatccgtacgtacgacgacgtacggtacggacgtacggtaaagttctttacggacgtaggttacttaacgttacgtacggtcgaacggtttccgttaccgggttttcccggtaccccctttaccggttaccctttacccgttaagtttaacccggtttaacccgtttaccgggtttttaccgggaccccgggtttaacggggtttaccccgaggggttccggttaaaccgggg

SEQ ID NO: 157775 - DNA, 973 bp, Homo sapiens
  misc_feature: GYAE6OF01BXPJJ.24.78.H01.1.454.CMB.1.raw
tcagactactatgtcacgaccggtgctcgatttagtgtgagtagtttgggtttggggagaggagcccagcactagaagtcggcggtgtttccattcggtgatccagcactgaaacacagaggactcaccatggtagtttgggctgagtcgttcgggtttttccctcggtcgtcttacgtttttaaaggacggttcgtcccagttggttccgaggggggcaggtccgttggggttacggacggttccgggtgggggggtccgggtccgttcggggtacccctaaaccggttcgggggtacggttcccccgtaggtacgtacctttccctccgttggttcggcccggtccccttaccccgtattttcccaccctttcgtaaaatttaccgtttaagtcggacctagtcgtccgtaacggttccggggtccccaccggacggtcctaccggaggggtaaccgaagggggtcgtaggggacggggttcggggtccggcccgtacgtttaatttaccgttttaagtttcggtaaggttaggtaaaacgtttaacttacgtaaaagtttagtttaacgtacgaaccgttacgtaacccggttcgggtaacggggtaaccgggttaccccgttacccaacccttaaccgttccgtaacgaacggtaaaccgttaaaccgtaaaccttaaaccccgaaactaaaccgtttaacctttcgtttacgttttccaacgtaaacttaaacgtacggtaaccgttaccgtaccgttcgtaacgtgttaccggtaaggtaaaccgggtacctaccgggttccttacggttacttaacgttacggtacggttaccggaaaccggttaacccggtttccccgtttacccccgttaaccgtttcccggtttaaaccgtttggtttaacccgggtttacccgggtacccccggttaaccccgttaggttaaaccggttcggtaacccgggg

SEQ ID NO: 157776 - DNA, 964 bp, Homo sapiens
  misc_feature: GYAE6OF01BQ742.24.78.H01.1.454.CMB.1.raw
  modified_base (215)..(215): a, c, t, g, unknown or other
  misc_feature (215)..(215): n is a, c, g, or t
  modified_base (243)..(243): a, c, t, g, unknown or other
  misc_feature (243)..(243): n is a, c, g, or t
  modified_base (267)..(267): a, c, t, g, unknown or other
  misc_feature (267)..(267): n is a, c, g, or t
tcagactactatgtcacgaccggtgctcgatttagtgtgagtagtttgggtttggcacgaccggtgctcgatttagtgtgagtagtttgggttggggagagctgctcagttaggacccagagggaaccatcggaaacccagcgcagcttctcttcctcctgctactctgcctccagccatcgacggagtattgtgtgacgctagtctcgaggccnccttgttctttcgtcctcggaagggganacggaccgccctaccctcttccgnggaccggacgggaccgaggttaggaaaggtagttcgggttacggacgaacggaccgttaaaccgttaccggtccggttaacggaaccacggtaaccgaacggtaaacccgtcgggacccgaaccggtcccgtacccggtaccgggtcccttcccgtaccttaactcggtccgtacgtacgtttaccccgtcccgaaaccccggtccggggtccccgttacggtacccggtaccccgaacgggtcccgggtttaacggggtttccgggtttcgggggtacccggggttttcggggtaccgggttacgggtaaccgttacggttaccgtttaaccgttaccggtttacccctaccgtacccttaacggtcccggtaacccgggtcccggttacccccttaccgggtaacgtttaccggttaaacggtttaaaccgttttacgtttttaccgtaacccgttttttactttttacgttttaacccgttacccgttaaaccgttaaacccttaaggtttaccgggtttaccgaccggtttacccggttacccgttacccggtttacccggtttaaaccccggtttcgggttttaaaccccgggaccgggtaaaacccggggttaaacctaaacgggttaccgggaaacgtttaaaccgtaaccgggttaaaaaccgtcgggttacggtaccggttaacccgg

SEQ ID NO: 157777 - DNA, 704 bp, Homo sapiens
  misc_feature: GYAE6OF01A6E8E.24.78.H01.1.454.CMB.1.raw
  modified_base (106)..(106): a, c, t, g, unknown or other
  misc_feature (106)..(106): n is a, c, g, or t
  modified_base (143)..(143): a, c, t, g, unknown or other
  misc_feature (143)..(143): n is a, c, g, or t
  modified_base (159)..(159): a, c, t, g, unknown or other
  misc_feature (159)..(159): n is a, c, g, or t
  modified_base (214)..(214): a, c, t, g, unknown or other
  misc_feature (214)..(214): n is a, c, g, or t
  modified_base (510)..(510): a, c, t, g, unknown or other
  misc_feature (510)..(510): n is a, c, g, or t
  modified_base (694)..(694): a, c, t, g, unknown or other
  misc_feature (694)..(694): n is a, c, g, or t
tcagactactatgtcacgaccggtgctcgatttagtgtgagtagtttgggtttggcacgaccggtgctcgatttagtgtgagtagtttgggttgggagagctgctnagttacggacccagacggaaccatcggaacccagcgnagcttctcttcctccngctactcgtcggcctcccgagccactcgaccggtaggtaattggtgttcgacgcncgtctcgagcctacctgtcttgcctcgagggctagccgccctacctctcgcgacgacgggtcctacgtaccgtaggtacggttcgtacgacgtagacgtacgtacttaaccggttcggaccgttacggtaaccgacgaaaccgtaaccggtaacccgttcggtcccgtaccgggccctaccgtaccggtcctacctacgtactcgtaaggttccggtcgtacccgtacccgacggaccggtcctaccggtcgggaccgtccgggacgtacggtaccggtaggacggttcggaacgnggttcgttacggtacggacgtacggtaccttcgtaacctcggtactaagttaccgactacgacggtacgaacggtcgaccggttaccgagttttacgcgacgtttactgttacttcgattccgtattcggttacttccgtcctcttaactgttactgttacctggttccgtccgtaagggttcnggtgttaacg

SEQ ID NO: 157778 - DNA, 627 bp, Homo sapiens
  misc_feature: GYAE6OF01ATZ1M.24.78.H01.1.454.CMB.1.raw
  modified_base (243)..(243): a, c, t, g, unknown or other
  misc_feature (243)..(243): n is a, c, g, or t
  modified_base (285)..(285): a, c, t, g, unknown or other
  misc_feature (285)..(285): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggccaccctgtctttgtcctccgagggganagacgcccaccctctcctgcgagggccagtcagagtgtagcngcagctacttagcctggtaccagcagaaacctggcctggcctcccgaggcctcctacacttctagtggtcgccgtccaccgacggcccacgtcggcgtcggcggtactacggttcaggtcgggacgtaggtcggtcgtttcgggacgtacgtacttcacgttctcatcagtaccgacgacgtacgtacgaaccgtaccgtaagttagtttcgacgtaggttacgttacgttacgtgtactaggtcgtttcggtttaccgttacccgttccttacccttccgttacgttccgttaacctttacgtttccggtaccgttacgggttccgtcgggtcgttacggg

SEQ ID NO: 157779 - DNA, 893 bp, Homo sapiens
  misc_feature: GYAE6OF01EY7GF.24.78.H01.1.454.CMB.1.raw
  modified_base (279)..(279): a, c, t, g, unknown or other
  misc_feature (279)..(279): n is a, c, g, or t
tcagactactatgtcacgaccggtgctcgatttagtgtgagtagtttgggtttggggagaggagcccagcactagaagtcggcggtgtttccattcggtgatcagcactgaacacagacggactcaccagtggtaggtttgggctggaggtccgttgggtttttcctcggtcgtcttacgttttaaggacggttcgtacccgtaggttcgtacggagggggcagcgtagggtggacgtcggtgggggcgcgtcggtaccaaccggtggtacggtcccgngacgtctccgtcgtggtccgcccggtaccttcccggtaattccaccgtttacaattaccttagtcgactagttccgacgtacgtcgggcccgtacgaggtccctaccggaggggaccgtaaggggtacgtaggggacgggtttcggggtcggccccttagttaccgtttacgtttaggttaggacgtttaacggaaaacgtttaagtacgtttaaaaagtttatttaacggccgtaacggtaaccgtaccgttaacggggtacccgggtaaacggggttcccctacgaacccgttagttacccgtacgtaaacgtaaccggtaaaccgtaacttaaccccaaaagtttaacctttaccggttactttaccggtttaccggtaagtaaaccgttaaacgaaccggttaacgttaccggtaaccggttaccaacggttacttacggtaccgggtaaacgtaccccggtttacgaccgttacgtttacgttaacgtttacgtagggtaccgtaaacccggttaaacgtccccgtttaccccgacgtttaccttacgtttaacggtttaccgtaacccgggtttacgtaacccaccccggtttaaggcgggttaccgg

SEQ ID NO: 157780 - DNA, 951 bp, Homo sapiens
  misc_feature: GYAE6OF01CFYHI.24.78.H01.1.454.CMB.1.raw
tcagactactatgtcacgaccggtgctcgatttagtgtgagtagtttgggtttggcgacgaccggtgctcgatttagtgtgagtagttgggtttgggagagctgctcagttaggacccagagggaaccatcggaaaccccagctcagcttctcttcctcctgctactctcggctcccagacgacccaccggagtaaacttggtgttgactacgaggtcctaccgacggccaccctgttcctttcgtccgtccgaaggggtacgacgaacgcccgacccctcgtccctcggaccgacgggcctaaggttaccgaaggtaacgttaagtaaaacggaaaccggtacctaaaaccgttaccgttaacgtacccgttacggttaactaaccgaaaaccgtaaaccggtaaaacccgttcgggacccgtaacgggtaccccgttaccccggaaccgggtcccttaccccgttacttaaccgttaccgttaacgttacgggttaacttaacgtacccggtaacggacccggtaacggggtaccccttaaccggttcgggttacccgtaaccccgtacggtaccccgtaacgggtttaccgaacggttaccgggaccggttaagggtttcggggttaccgtacggggtaaccaacgggttaacgtttcctaaacccggtttccgtaacctaacccgtaacggttacgtacgggttacccgtacggtttcccttacgggaacccgttacggttaccgttacgggttaaacgtttacgttttacggaacgttttaggttttaaccttaaccggtccgtaaccgtacgtaccgtaacgtacccgtaaacggttaccggtaccggtaccgttacccggcccgttaccccgttacggttaccccggttttaccgggggacccgggtaaaccgggtaccgggtaaaggggtccggtaaaacccg

SEQ ID NO: 157781 - DNA, 769 bp, Homo sapiens
  misc_feature: GYAE6OF01BIISH.24.78.H01.1.454.CMB.1.raw
  modified_base (183)..(183): a, c, t, g, unknown or other
  misc_feature (183)..(183): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctcggcctccagtccntcgaccggaggtaattgtcgttgacgctacgttcctccacggcctacctgttctttacgtctccgagggacagacgcccacctcgtcctgcgaggccgaggccggagttgtaagttaacgtaacttcggcgtacgtaccaacgaacgaaaccgtcggcctaacggtcctacccgacggtccctacctactactacttagtcgtacgtcgttaccctaaccggaacgtaccggggtacctaccgtacgggtacccccgtacccccgtaccgtaacgggtttccgtaagggtcgacggttaggttcgggtccggtagggaaccgtcgtaaccttcctaccttaccgtacgaccgtcgtaacgccgtacgacccttacgggaccgtcccgtaggtaaccttggttttacgtaccgtttactacgtcgtaacgcgaccgtcgtcgtttccgcccggtacggtaccgttccggtaaccgggttccggggaacccgggggtacggtacggggtacgggaacgggtacggtaaccggggtaaccgttaacgggtcgggtaaccgggtacgaaccgtcccgtaacggttccccg

SEQ ID NO: 157782 - DNA, 669 bp, Homo sapiens
  misc_feature: GYAE6OF01B7U0N.24.78.H01.1.454.CMB.1.raw
  modified_base (289)..(289): a, c, t, g, unknown or other
  misc_feature (289)..(289): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagaggaaccatggaaaccccagcgcagcttctcttcctcctgctactctggctccagcatcaccggagattgtgttgacgcagtctccaggccaccctgttctttgtctccgaggggagagacgcccaccctctccgtgcgaggccagtacaggacgtagtagcagtacnctacgttacgccgtggtaccagacctaagaaccgtcggccgtcgggccttacccgagggtcccttaccctcgtacttccgtagttggtacgtccgtacccgaccgacggggcccacggtcgggccgtccgacggtacgtagggttccaggtcggtaccgaggtcggttcgtttgggacctacgtaccttcgacttcacgtactacagtaccgactacgtacgtacggacggtaccgaagttgtttacgagttaacgtgtttaaccgtttacgtacggtcgttacgtccgttggtttcccggtccttcccgttccgttacttagttaccgttacgtttcgtttcgggtaccttacgggtaccgttacggtcgttggtaacg

SEQ ID NO: 157783 - DNA, 888 bp, Homo sapiens
  misc_feature: GYAE6OF01C4F49.24.78.H01.1.454.CMB.1.raw
  modified_base (209)..(209): a, c, t, g, unknown or other
  misc_feature (209)..(209): n is a, c, g, or t
  modified_base (444)..(444): a, c, t, g, unknown or other
  misc_feature (444)..(444): n is a, c, g, or t
tcagactactatgtcacgaccggtgctcgatttagtgtgagtagtttgggtttggggagaggagcccagcactagaagtcggcggttgtttccattcggtgatcagcactgaacacagaggactcaccagtggtaggtttgggctgagtcgttcgggttttcctcgttcgtcttcttttaaagaggtcgtccaggtgtcggaggggtcnggtcgtgggtggaggtcggtgggggcgcggtcgacccgaaccggtgggacgtccctgacgtacttcctccgttggtccggccggtaccctcccgtacttcctaaccttactaaacgtttacgttacgtggacctatcggtcctaccgggtccgggtccgacccgtagggtccctaccggggacggacggacggggtcggtggggtagggttcggggtcgaccgttcttaacgttntttacggttaggaaggtacggttaaacgttaataacgttaaagttaattacgtaggtaacctaacgggttacccgtttaccggggacgggggttaaaccggttaccccggtttaacgaaacccttccgttacccggtaaccgtaaaggtaaacctaaactttaaccccgttaaacttaaaaaccccttacgtttaaccgtttaacgttttccgtttaaccgaacgttaacttaaaacggtccgttaaccgtccgtacccgggttacgtacgttacgttaccggtaagggaccgtaccgtacgtccgttttacgtacgtttagtaaccgtacgggtaaccggtaaacttacccggttccccgggttacccctttagttttacccgggttaggttaacgtttccggggtaccgttacccgtaccctaggtcggttacggtaccggg

SEQ ID NO: 157784 - DNA, 306 bp, Homo sapiens
  misc_feature: GYAE6OF01BYBMC.24.78.H01.1.454.CMB.1.raw
  modified_base (271)..(271): a, c, t, g, unknown or other
  misc_feature (271)..(271): n is a, c, g, or t
  modified_base (274)..(306): a, c, t, g, unknown or other
  misc_feature (274)..(306): n is a, c, g, or t
tcagactactatgtcacgaccggtgctcgatttagtgtgagtagttgggtttgggacagacttcactctcatcatcgacagactggagcccgaagattttgcagtgtattactgtcagctgttggtccctctcctcctatgtacacttttggccagggttccaggctggagatcaagcgaactgtggctgcaccatctgtcttcatccttcccgctatctagaactatagtagtcgtgacggcgggctgggacaaaggccgactaatagcngcnnnnnnnnnnnnnnnnnnnnnnnnnnnnnnnnn

SEQ ID NO: 157785 - DNA, 732 bp, Homo sapiens
  misc_feature: GYAE6OF01CY5HU.24.78.H01.1.454.CMB.1.raw
  modified_base (109)..(109): a, c, t, g, unknown or other
  misc_feature (109)..(109): n is a, c, g, or t
  modified_base (151)..(151): a, c, t, g, unknown or other
  misc_feature (151)..(151): n is a, c, g, or t
  modified_base (391)..(391): a, c, t, g, unknown or other
  misc_feature (391)..(391): n is a, c, g, or t
  modified_base (542)..(542): a, c, t, g, unknown or other
  misc_feature (542)..(542): n is a, c, g, or t
tcagactactatgtcacgaccggtgctcgatttagtgtgagtagtttgggttggcacgaccggtgctcgatttagtgtgagtaggtttggggttgggggagagctgctnaggttacggaccaggacgggaaccagtacggaaaccccagcncgagtcttctccttcctcctcgctactcgtcggcctccacgccactaccgacgggtagtagttcgtgtcgaccgctacgtcctccgacggcctaccgttgttcgtttcgcgtaccggaggggacgacgaccgccctacctcctccgacgcggtacggccacgtcgagtaggttgtacgcgacgactagtcctaacgtcgcgtacgtacgacaacgacgtacgtcgtccgtcgccgtaccncggtcctctcgtatcgtcgtcgtcgtaccgaccgtaccggacggtcgcgtccgggtccggtacggggtcgtacgttacggtcgtcgggtacgtcgggtacggttccgggttacgtacgggtacgttacgtacgtcctaacgtctaccgacncgtaccgcgtctaccgtcgtacgtagtacggtatttcgttaccggttactttacgttacctcttaaccgtactaacgttacgtaggtccgttaacggccgtacccgttcccgtagtttaacccggttaccggtccgggaaccgtaaacccgggttaaacgaccggttaggtaaacccggtcgtaaaccgg

SEQ ID NO: 157786 - DNA, 771 bp, Homo sapiens
  misc_feature: GYAE6OF01ERFCO.24.78.H01.1.454.CMB.1.raw
  modified_base (173)..(173): a, c, t, g, unknown or other
  misc_feature (173)..(173): n is a, c, g, or t
  modified_base (274)..(274): a, c, t, g, unknown or other
  misc_feature (274)..(274): n is a, c, g, or t
  modified_base (301)..(301): a, c, t, g, unknown or other
  misc_feature (301)..(301): n is a, c, g, or t
tcagactactatgtcacgaccggtgctcgatttagtgtgagtagtttgggtttgggagaggagcccagcactagaagtcggcggtgtttccattcggtgatcagcactgaacacagaggactcaccatggagtttgggctgagctgggttttcctcgtcgcttcttttaaagnggtgtccagtgtcaggggcagctggtggagtcgtggggcgcgtggtccaacgtgggacgtccctgacgactctcctgtcgcggcctccgtattccaccttnaatacttatggcatcgcacgtgggccncaggcctcgaggcgaacggggctgggacggtggtcgggcctacgtattcctttagttggagttacgggaaagttaaagtccgtaaaatttactttaagaggtacccgtaaggtccgttacccgggtaggtaaaaccgggggttccccggttaacaaccgttaaccgttcgtaacccgtaagaacgtaacctaaacgttaacccgtaaactaaacgttaccttacgttacgttttaccgtaagaaccgtaaagttacgtaaccgttacgtacccgttggaccgtaacgttactaacggtaacggtaaccgaccggttacttaccgttacgttaacgttacgttacggtacggtaaccgaaaccggttacccgttaccccggttacccgtttaaccgtttaaccgtaacgttttaacgggttccggggttacccggtacccccgttacggtaacggttcgggtaaacccggg

SEQ ID NO: 157787 - DNA, 1001 bp, Homo sapiens
  misc_feature: GYAE6OF01DL8ZP.24.78.H01.1.454.CMB.1.raw
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggctcccagatcgccaccggagactagttgtgttgacacagtctccacgccacccgttgttctttgtcctaccgaaagggggaaacacgccctaccctcctccgtagaccgacggggaccaggtcgaaactaaggttacggttaaggtaacgttttacgttaacggtccgttagggttaacttaaccaaaacctaaaccgaaaaccgtaacggttcgggaccccggtaaccgggtccccggttaccccccgggtcctttaccccgttacctaacgttaccgttaacgttacggaacgtttcggaacctaacgttaaaccccgtaaaacgggttaaccgggtaccccgtaaacggttacccgggaaactacccgttaaccccgaaacggtaaaccggtaacgggttttaccgaacgggtttacgggaaccgggttaagggggttacccggggtttaccgggtaaccggggtaaaccttaacggttaaacccgttttaccccgtaacccgtttaacccgttaaaccccaaacccgttaacgtaacccgaaacgggttaaccgaacgggtttaaccggtttaacgggaaccgtttaacccgggttaaggtttaaaacggttttaacgtttttaccgggttacccgggtttttaaaccacggttttacgtaccgtacgggtaccgttaccgtcccgggtttaccccggtccgttacccggggttacccggtttaaccccggtttaaacccggggtttccggggggaaaccccggggtactaaccggtaaccggttaaccgggaacccttaacgtaacccgggaaacggttaacggg

SEQ ID NO: 157788 - DNA, 785 bp, Homo sapiens
  misc_feature: GYAE6OF01DVQ1X.24.78.H01.1.454.CMB.1.raw
tcagactactatgtcacgaccggtgctcgatttagtgtgagtagtttgggttggggagaggagcccagcactagaagtcggcggtgttccattcggtgatcagcactgaacacagaggactcaccatggagtttgggctgagcttgggttttcctcgtcgtcttcgttttaaggaggtgtccaggtgtcgaggggcagcgtggtggagtcgtggggcgcgtggtccaacgtgggacgtccctgacgtactctccgtgtcgccggcctccgattccaccttacaattactagtggcagtcgcacgtcgggtccacgaggtcctaccggaggcggaacggggtctaggggtacggtgggtcggccgtattaagttcctttagtttacggagttacgggtaaattaactacgtaaagttattacgtcgacgtaacggacgttaccgggtagggtaacccgggtcccgtttaaccaacctacgttcccgtaaccgaacggtaacgtaaacctaaccgttaaaccctaaactaaacgttaaccgtttacgttacggttttaacctaacggtaacctaaacgtacgtaaccgttacggacccgttagtacggtaactaccggtaacggtaaccgggtaccgtaccgggttacttacgttacctttaacgttaccgtaggtaccgtaacggtaaaccggttcccggtttaccccggttaccgtttaacgttacggttaacgttccgggttaccgggtacccgttaccccttaaggcggttccgggtaacggg

SEQ ID NO: 157789 - DNA, 678 bp, Homo sapiens
  misc_feature: GYAE6OF01AURTU.24.78.H01.1.454.CMB.1.raw
  modified_base (143)..(143): a, c, t, g, unknown or other
  misc_feature (143)..(143): n is a, c, g, or t
  modified_base (246)..(246): a, c, t, g, unknown or other
  misc_feature (246)..(246): n is a, c, g, or t
  modified_base (669)..(669): a, c, t, g, unknown or other
  misc_feature (669)..(669): n is a, c, g, or t
tcagactactatgtcacgaccggtgctcgatttagtgtgagtagtttgggtttggcacgaccggtgctcgatttagtgtgagtagtttgggttgggagagctgctcagttaggacccagaggaaccagtggaaaccccagcgnagcttctcttcctcctgctactctgctccgagccatccgacggagtattgtagttgacgcagtcctccgaggtccaccgtgtctttcgcctaccgaagggganacgacgcccacctcgtaccgtgcctaagggcctaagtacgaagacggtagttagcctaaggtcacgcttaacgttacgccgtacggtaccaagaccaacggtaaacctcggaccgtcggtacctccgacggtcttccgtctaacgtacgttactcggtacggaccgttaccgacccggtaacggcccgtaacggttcggaccgttaccggaggtaaccgacggtttcgagtcggaacgtgtacgggtacgtttagggaactacggtacttaccacgttacgtactaacgttccgtaacgtcgaacgagtacgtacgggacgtaaccgaagttgtttcggacttagtacgttaacgttccaggtactagttccgttagttccgtcctctcgtaactcgtacgtattacgttacgctaggttccngtcgtaacg

SEQ ID NO: 157790 - DNA, 743 bp, Homo sapiens
  misc_feature: GYAE6OF01AQ7SN.24.78.H01.1.454.CMB.1.raw
  modified_base (238)..(238): a, c, t, g, unknown or other
  misc_feature (238)..(238): n is a, c, g, or t
tcagactactatgtcacgaccggtgctcgatttagtgtgagtagtttgggtttggggagaggagcccagcactagaagtcggcggtgtttccattcggtgatcagcactgaacacagaggactcaccatggagtttgggctgagctgggttttcctcgtcgctcttttaagaggtgtccagtgtcgaggggcagctggtggagtcgtgggggcggcgtggtccaacgtgggacgtccngagctctcctgtcgcgcctccgattcaccttcaactacttatggcatggcacgtcggggtccgccgaggcctaccgagggacgaaggggctgggaggtggggtcggccgtctatcgtttagtttggacgtaggtaaagttatactaaattattagtgctaaggtaccgttacccggagggtaacggggtccccgttacctaacccgacttaccctaccgaacggaacgtaaccgtaaactttaaccccaaacgttaaaccttaacccttaccgtttacgtttacctacggtaacctaaacgttcgtaacgtaaccgtccgtacgtcggtaacgttaccgtaggtaaccgaccggtaccggtacgttcgttaccttaacgttacgttaggtacgtaacggaaaccgttacccggttacccccggttacccgtttcccgttaccgttacggtttacggttaccggggttacccgtacccccgttacgtaccggtccggttacccggg

SEQ ID NO: 157791 - DNA, 806 bp, Homo sapiens
  misc_feature: GYAE6OF01B6H61.24.78.H01.1.454.CMB.1.raw
  modified_base (208)..(208): a, c, t, g, unknown or other
  misc_feature (208)..(208): n is a, c, g, or t
tcagactactatgtcacgaccggtgctcgatttagtgtgagtagtttgggtttggggagagctgctcagttaggacccagagggaaccatggaaaccccagcgcagcttctcttcctcctgctactctggctcccagacgaccaccggagtaaaattgtgttgactacgagtctccgaggccaccgttgtctttgcctccgagggganagacgtccctacctctcctgcgagggccaggtccggagttaggttagtaacgtacttaggctacgggtaaccaacgaacgaaaccgttggacccgaacggtccgtaccccaagggtcccttaccactattaccgtagtgtaactcggtcctaccgaaccggtaacggtccaccgttccggtaccggtacccccgtacgtacggttaccgtaggttcggaccggtaggttacgggtcccgttagggaacgtaccgtacgttaccgaccggtttaccgacccgaaccgttcgaacgtacgaccgtacgttaccgaggtaccgtaggtaaccgttagggtttacgtacgtttaacgtacgttacgtcgtaacgtccgtacggttccgtaccgtccgttaccggtccgtaacccgtttacgggttaccggggacccgggggacgtacggggtacggtaacgggagggtaaccgtaacggtacgggtacgggtcgtaaccgtcgtcctaaaccgtccgtacgtttccggtcttaccggtacccgttaccgtacccccggtactaacccgttacaacggtaaaccttacggtttcgttaaccgg

SEQ ID NO: 157792 - DNA, 806 bp, Homo sapiens
  misc_feature: GYAE6OF01C2GJV.24.78.H01.1.454.CMB.1.raw
  modified_base (100)..(100): a, c, t, g, unknown or other
  misc_feature (100)..(100): n is a, c, g, or t
  modified_base (115)..(115): a, c, t, g, unknown or other
  misc_feature (115)..(115): n is a, c, g, or t
  modified_base (185)..(185): a, c, t, g, unknown or other
  misc_feature (185)..(185): n is a, c, g, or t
  modified_base (189)..(189): a, c, t, g, unknown or other
  misc_feature (189)..(189): n is a, c, g, or t
  modified_base (213)..(213): a, c, t, g, unknown or other
  misc_feature (213)..(213): n is a, c, g, or t
  modified_base (307)..(307): a, c, t, g, unknown or other
  misc_feature (307)..(307): n is a, c, g, or t
  modified_base (312)..(312): a, c, t, g, unknown or other
  misc_feature (312)..(312): n is a, c, g, or t
  modified_base (438)..(438): a, c, t, g, unknown or other
  misc_feature (438)..(438): n is a, c, g, or t
tcagactactatgtcacgaccggtgctcgatttagtgtgagtagtttgggtttggggagaggagcccagcactagaagtcggcggtgtttccattcggtnatcagcactgaacanagaggactcaccatgggagtttgggctgagtcgttgggttttccctcggtcgtctttacgttttaaaggnggtntccagtgtcgaggggcagcgtggnggagtcggtgggggcgtcggtcgtccaaccgtgggacgtcctgagtactctcgtgtcggccgtcctacccattcccaccttacaagtacttagngactntcgactacggtcggtcccaccgtaggcctacgaaggaccggaagggtctgggaggttcgggtcgaccgtacttacgttccgtttaattagggataaggaagttaaactctaaaatttacggttaancgggtaacaaacggtaccgtaaccggggttaaggaacccggggtcccttaccaacccgtaacgttacccgtaacccgaagaactaaacgtaacctaaacctaaaactaaaccgttaacttaccgtttaggttacctacgtaaaacgtaacgttaacgaaccgtaacgtccgtaacgtaccgtaagtacctaacgggaacgtaccggtaacggttactcgttaaccgttagttaccgtagaaccgaacggttaaaaccgtcccggttaccccccgttactttaacccggtttaacggttaagtttaccgggggtttacccgggtaccccggttaccccctaacggttaccgggacgggttaaacccggg

SEQ ID NO: 157793 - DNA, 863 bp, Homo sapiens
  misc_feature: GYAE6OF01DXZZK.24.78.H01.1.454.CMB.1.raw
tcagactactatgtcacgaccggtgctcgatttagtgtgagtagtttgggtttggggagaggagcccagcactagaagtcggcggtgtttccattcggtgatcagcactgaacacagaggactcaccatggaggtttggctgagtcgttgggttttcctcgtcgtcttacttttaaggacggtgtccagtggtcgagggggcctagcgtgggtaggacggttcggtggggggccgtcggtcggtacccaacggtgggacgtcccgtgaacgtcctcgtcgtcggcggccggtccctacccgtattccacctttacaattacgttagtgactagttcgacgtacgttccgggaccgccgacggtccctaccggacgggtacggaacggggtcgttaggggtaccgggttgggggtcccggaccttcgtttacgtttacgtttttaacggttaggtaacgtaaggggttaaaacttattacttaaaattacgttagtcggaccaagggtttacctaccggggacgggtaaacgggttcccgtaactaccgtacgtacctaccgtaagtaaccgtaacctaaacgttacccaaaaacttacgttacgttcctttacgtttacgtaacgtaactaaacgtcgtaaccgtcgtaccggtacgtacgtaccgttacggtacggtaacccggtaacgtaccggttcgttacgttaacttaaccgtttacgggtacgtacggtaaaccggttaaccggtttcccccggtttaaccccccgttacggttttaacggttaaccggttaacgtttaccggggttacgggttacccccggtaacccgtttacgtaacgggttccggtaaccgggg

SEQ ID NO: 157794 - DNA, 1082 bp, Homo sapiens
  misc_feature: GYAE6OF01C750Q.24.78.H01.1.454.CMB.1.raw
tcagactactatgtcacgaccggtgctcgatttagtgtgagtagtttgggtttgggggaggagcccagcactagaagtcggcggtgtttccattcggtgatcagcactgaacacagagactcaccagtggtagtttgggctggagtcgttgggtttttcctcgtcgtacttacgttttaaggaggttcgtcctagtcggtcgaggggcaggtcgtgggtggagtcggtgggggcgtcggtcggtaccgaaccggtggggacgtcccgtggactaccgtcgtccgtggtcgccggaccctcccgtattcctaccttactaattacttgtggctagtcgccgtaccggttcgggaccccgacgaggtccgtaccggagggaccggaacgggggtctaggggtagggtccgggggtcggtcccgtaacgtttacttttaccggttttaagtttacgggaacggtttaagggtaaaaactttaacgtaaacgttaaacgtttaagttttacggaacgtaaccggtaaacgggtttaccccggttaccggggtttaaagggggaaccccgggggtttaccccgtttaaaccaacccgtttaacccgtttacccggtaaaccggaaaacggttaaacccggttaaaacccgttaaacccttttaaaaccccccggaaaagtttaaaaacccgttttaccccttttaaccggttttaccggttttttaaacccgacggtttaaaactaaaacgttcggttaaccccggttaacccggttccgttacgtaaccccgggttaatccggggttaaaaccgggtacccgggaaccggttacccgggttactttaaccggttttaaacttaccggtttaccgttacggggttaaacccgttaaacccgggtttaaaaccccggttcccccggtttttacccccccgggttttaaccctttaaacccgggttttaaacggttaccccggggttttttaaacccggggttccccgggggtttaacccccccgttaaaacccccgttagggttaacccgggggttttaaccggtccccgggggggtttaaacccggg

SEQ ID NO: 157795 - DNA, 871 bp, Homo sapiens
  misc_feature: GYAE6OF01ESTBJ.24.78.H01.1.454.CMB.1.raw
  modified_base (158)..(158): a, c, t, g, unknown or other
  misc_feature (158)..(158): n is a, c, g, or t
  modified_base (767)..(767): a, c, t, g, unknown or other
  misc_feature (767)..(767): n is a, c, g, or t
tcagactactatgtcacgaccggtgctcgatttagtgtgagtagtttgggtttggggagaggagcccagcactagaagtcggcggtgtttccattcggtgatcagcactgaacacagagactcaccatggaggtttggctgagtcttcgggttttccncgtcgcttcttttaaggaggttgtccagttgtcgaggggcaggcgtggtggaggtcgtgggggcgcgtggtcccaaccgtggacggtcctgagactcctcctggtcggccgtacccgttcccgtattccacctttcaacttaacttatcggctagttgcctaacggttccgggtcccgccgacgggtccctacccggagggaccgggtaaaggggggtccgttagggggtacggtcgggggttcccgggacccgttccgttaaagttttacctttttaaggttttttacggaaggttttacgggtaaaaagttttaaaacgttaacttaaaacgttttaaattaacgttcgaaccggtaacggttaccgtttacccggggtacgggtaaaccggggttcccccggttaacctaacccgtaccgttacccgttaccgtaaacggtaacgtaaaacccttaaacccgtttaacccaaaaaccttaaacctttaccgttacccgttttaacgtttttaccgacggttaaactaaacgttaccgtacttaccgtaccgtgtacgagttaccgtagaccggtacgtacggtccttaggtaccttagttccggtntaaccggtaagtaaaccgttcccggttacccccgttacgtttacttaacggttacggttttggtccccgggttacccgtacccgagtttagtcggggtacccgg

SEQ ID NO: 157796 - DNA, 314 bp, Homo sapiens
  misc_feature: GYAE6OF01BZD48.24.78.H01.1.454.CMB.1.raw
  modified_base (275)..(275): a, c, t, g, unknown or other
  misc_feature (275)..(275): n is a, c, g, or t
  modified_base (280)..(280): a, c, t, g, unknown or other
  misc_feature (280)..(280): n is a, c, g, or t
  modified_base (283)..(314): a, c, t, g, unknown or other
  misc_feature (283)..(314): n is a, c, g, or t
tcagactactatgtcacgaccggtgctcgatttagtgtgagtagttgggtttgggacagacttcactctcatcatcgacagactggagcccgaagattttgcagtgtattactgtcagctgtttggtccctctcctcctatgtactacttttggcctagggttccaggctggagatccaaagcgaaactggtggctgcaacctatccgtgttccttacatccttcccgcctatcctagaacatagtagtctggagcgggctggccaaaggccganatagnctnnnnnnnnnnnnnnnnnnnnnnnnnnnnnnnn

SEQ ID NO: 157797 - DNA, 832 bp, Homo sapiens
  misc_feature: GYAE6OF01BVJPI.24.78.H01.1.454.CMB.1.raw
  modified_base (285)..(285): a, c, t, g, unknown or other
  misc_feature (285)..(285): n is a, c, g, or t
  modified_base (306)..(306): a, c, t, g, unknown or other
  misc_feature (306)..(306): n is a, c, g, or t
  modified_base (422)..(422): a, c, t, g, unknown or other
  misc_feature (422)..(422): n is a, c, g, or t
tcagactactatgtcacgaccggtgctcgatttagtgtgagtagtttgggtttggcacgaccggtgctcgatttagtgtgagtagtttgggtttgggagagctgctcagttacggacccagacgggaacctatacggaaaccccagcgcacgtcttctcttcctctgctacgtctcggcctacccagcctacgtccgaaccgggtagtagttggtagtcgaccgctacgtcctaccggacgacctacccgttagtttccgtttcgtccgtaccgggaaggggtanacggtaccgaccctacccctntaccgcgaccggacggccgagttaccgaggtaacgttcgttaacggcaacgtcgtacggtccttaacgtacggccgttacgggaacctcggaacctaacgaccccggttggtcccncggtacccgacccggtcgtacccttcttacccgatttaacccggttacggtccgggtactccccgtaacccggacggtaaccccggacgtttacggtcggtaccgtacggacgggtactacggtttacggaacggtcgtacgtacggttaccggtcggttaacgacccgtagtaccttaccaacgggtctctaacgtcgtaacgtaccggtacgcgtaccgttaagggaccctttaaccggtagtttcgtaacgggtaccttaggtttacgtttaacgacgtttcggacgttaacgttccggttccgttaaccggttccccttaccgttacggtttaaccttacggtaaccgtttcccgggtttaacgttaccggttaccggttaccggagttccgggtaccgttaacgg

SEQ ID NO: 157798 - DNA, 866 bp, Homo sapiens
  misc_feature: GYAE6OF01DWV5V.24.78.H01.1.454.CMB.1.raw
tcagactactatgtcacgaccggtgctcgatttagtgtgagtagtttgggtttggggagaggagcccagcactagaagtcggcggtgtttccattcggtgatcagcactgaacacagagactcaccatggagtttgggctgagtcttcgggttttcctcgtcgtcttacttttaaggaggtgtccagtgtcgaggggcagtcgtgggtggagtcggtgggggcggcgtcggtccaacgtggggacgtccctggacgtactctccgtggtcggccgcctccgacttccacctttacgaattaccgttagtgactagtggaccacggttcgggtcccgacgcggtcctaccggaacgggacgaacggggggtctgggggacgggttcggggtcgggacccttagttaagttttccgtttaagttagggtaattaagggtaaacttaactagttaaaatttagttacgtaggtacctaacgggtaccgttaccggggacgggttaaccgggtccccggttttaaaccaccgttaaacttcccgtaaccgtaaacgtaccgtaaactaaccttaaacccgtaaactaaacctttaacgttacgtttaccgtttacgacgttaaaccgtaacgttactaccgttaacgtccgttaaggtccgtaacgttacgtacgggtaaccggaacggttccgttacgttaacggtttacttagtttaaccgtaggttaccggaaaccgggttaaacccgtaccccgggtttaccccccgtttaacggtttacccgtttaaagggtttacccggtttaacgggttcccgggggttaaccccggtaccccttaaggttaacccggtttgggtaccccggg

SEQ ID NO: 157799 - DNA, 907 bp, Homo sapiens
  misc_feature: GYAE6OF01DWLHW.24.78.H01.1.454.CMB.1.raw
tcagactactatgtcacgaccggtgctcgatttagtgtgagtagtttgggtttggggagagctgctcagttacggacccaggacgggaaccagtacggaaaccccagctcagtctttcctcctttcctctcgtcttacctcgtcggcctacccaagatcgaccgaaaccggagtactagtttcggttagttacgaacctacgtacgtccctaccgaccggaccccttacccttgttttaccgtttcggtcccgtaaccggggaaaggggaaacctcccgaccccttacccgttccgttccgacggaccggtacggtaccgtaagtaccggtaaacttaaggtttagggttttaaaaggtcggttttacggttaaccggtccgtttaaggtaacctaaccgaaaaccaaacgtaaaccgtaggttccggaacccgtacccggtccccgttcccgtccttacctacgtctaacgttacgtacgttacgtaccgaccttaaccgtaccggtaaacggtcccggtacctagggtccgaaccttacccgtaacggtacggtacggttacgtacggtacggtacggtacggttacgggtccgggtacggtacgaacctttaccgtacttcccgtacgtacctaccgactacgtacgtacgtacgtaggtacgtacgtacgtacgttaaagttgttacgttacgttaacgtttacttaacgttgaccgttcgtaaccgtaccgtacgtaccgtaacggttccctacccggtttaccgttaccgggttacccggaaccgttacgaaccgtacggtaacgtaaccgaccgtaaccgttaaccgtacgtttccggacgttacggctaacccgtcttaccgttactccgtttaaccgtccttaccgtcccgttacccg

SEQ ID NO: 157800 - DNA, 727 bp, Homo sapiens
  misc_feature: GYAE6OF01B0MAB.24.78.H01.1.454.CMB.1.raw
  modified_base (196)..(196): a, c, t, g, unknown or other
  misc_feature (196)..(196): n is a, c, g, or t
tcagactactatgtcacgaccggtgctcgatttagtgtgagtagtttgggtttggggagagctgctcagttaggacccagagggaaccatggaaaccccagcgcagcttctcttcctctgctactctggctccagccatcacggagattgtgttgacgcagtctcgaggccaccctgtctttgtctccgagggganagacgccaccctctcctgcagggccagtcagtagtgtagcagcagtctacttagcctaggtaccagccgaagaaaccgtcggcctacggcctacccgaggtcctccctacgaacttcctagtcggtcgaccgtacccgaccgacgggccacggttcgggcgtcggacggtacgtaggttccaaggtcggaccgtagggtcggtacggtttcgggaacctaggtaaccgtttacgaccgtttacgtaccaacgtttacgaacgttaccggaaccgtaacggtaccggtaacggggtaaccgtaccccggttaaagtttaacgttttcggacccgttaagttacggtttaattaacccgttgtacgtaacggttcgtttcggtttaccggtcccctcgttcctaccgttagttaccgtactttacggtttccggaccgttaagggttccgaacgggtcttaacggggacttacgtaccgtagggtaccttaaacgttcggtaagtcccgtacggacctacccgttgttacccg

SEQ ID NO: 157801 - DNA, 861 bp, Homo sapiens
  misc_feature: GYAE6OF01CGIUS.24.78.H01.1.454.CMB.1.raw
  modified_base (214)..(214): a, c, t, g, unknown or other
  misc_feature (214)..(214): n is a, c, g, or t
  modified_base (417)..(417): a, c, t, g, unknown or other
  misc_feature (417)..(417): n is a, c, g, or t
  modified_base (449)..(449): a, c, t, g, unknown or other
  misc_feature (449)..(449): n is a, c, g, or t
tcagactactatgtcacgaccggtgctcgatttagtgtgagtagtttgggtttggggagaggagcccagcactagaagtcggcggtgtttccattcggtgatcagcactgaacacagagactcaccagtggaggtttgggctgacgtcgttgggttttcctcgtcgtccttagtttaaggaggttcgtccagtgtcgagggctagcgtggtggngtcgggtggggcgtcgtcggtaccgaaccggtgggacgtcctagacgtacttctccgtggtcgcccggtcctacccgtatttcccgaccttacgtaaaccttcgttaacgtggtactaagtcgtaccgtaccggttcgggtccccgacggcggtaccgtaccggacggtacggaagggcgttagggagggtcggacgtccgtnttattctttagtagacgtaggtaactaagtanaattaatcgtacgacgtaacggtacgtcccggtaggaccgggttcctaccgtaaactacgttccacgaagtacgtaaacctaaccgtaacctaaacttaacgttaaccgtttcgttacggttacctaacgttaacgtaaaccgtcggtaaaccgttccgtaaccgttaaggtacccgtttagtaaaccgggttaccggtaaacgggaccccgttagggtttacgtttaaaccgttacgtttaaacggttaacgttaccggggttacctaaaacccgggtacccggttttaaaccccggttacccccgtttaaccggttttaacttaaaccggggttccgtttttaaccgggtaaccccgggggtttcccccaaacccggtttaacggtaggttccccggggttaaaccgggg

SEQ ID NO: 157802 - DNA, 628 bp, Homo sapiens
  misc_feature: GYAE6OF01C3X6L.24.78.H01.1.454.CMB.1.raw
  modified_base (230)..(230): a, c, t, g, unknown or other
  misc_feature (230)..(230): n is a, c, g, or t
  modified_base (365)..(365): a, c, t, g, unknown or other
  misc_feature (365)..(365): n is a, c, g, or t
  modified_base (578)..(578): a, c, t, g, unknown or other
  misc_feature (578)..(578): n is a, c, g, or t
tcagactactatgtcacgaccggtgctcgatttagtgtgagtagtttgggtttggcacgaccggtgctcgatttagtgtgagtagtttgggttggggagagctgctcagttaggacccagagggaaccatcggaaaccccagcgcagtcttctcttcctcctgctactctgcctcccagccatcgaccggaggtattgtgtgacgcagtcctccaggctaccctgtcttncgtacgagggagagactcccacctctcctgcgaagggccagtacaggagtgtagcagcagctacgtcgcctggtaccagacacgaaaccgtgccgtggccctacccgacgcctccctactatccgtagtcggtcnccgtccgaccgaggcccagtcggcgtcgacggactggtaccaggtcggctagggtcggtcggtttacggggactacggtacttctaactccgtacaacttcgaactaccggaacacggtaacggtcgggaaccgtaccgaaagtttacttcggacttaggtattaagttcctagtcctagtccgttgttccgtcccgttctcccttaccgttnttaccgttacgttacgttttcggaccggttagggtcctgggtcttaaggg

SEQ ID NO: 157803 - DNA, 765 bp, Homo sapiens
  misc_feature: GYAE6OF01AOQA3.24.78.H01.1.454.CMB.1.raw
  modified_base (256)..(256): a, c, t, g, unknown or other
  misc_feature (256)..(256): n is a, c, g, or t
  modified_base (369)..(369): a, c, t, g, unknown or other
  misc_feature (369)..(369): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctccttcctcctgcttactcgtggcctcccagccatcgaccggagtattggtgttgacgcagtcctccgaggcctacccgtgttctttgtcctaccggaggggtanagacgccctacccgtcgtccgtgaccgacgggcctagtacgagtagtgtacgcagacagtaccttacttgcctacggtacctagaccaacgtaaccgtcggccgtacggtccncccgtacgtcctccgtactacgttctagtcggtcgccgtacccgacgacggtaccgacgtcgggtacgtccggacggtaaccgtcgggtcgacggtcggtaccgtacgggttcggttacggttacgggacttaccgtacccgttccgtaccgttcgtaacgtaccgttacgtaccgtaccgtaccgtaacggtacggttacgggaacccgttaacccggttaagtttaaccgttttcggaccgttaaggttttacgttaacgtttacggtccgttacctacgggtttcgttttaacccggtttccgttacccccttccgttaccctacgtttaccgttacgttacccgtttacggtttcccgtaccggttccggtaccgtacgggtcgttaaccgg

SEQ ID NO: 157804 - DNA, 917 bp, Homo sapiens
  misc_feature: GYAE6OF01DGIQX.24.78.H01.1.454.CMB.1.raw
tcagactactatgtcacgaccggtgctcgatttagtgtgagtagtttgggtttggcacgaccggtgctcgatttagtgtgagtaggtttgggtttggggagagctgctcagttaggacccaggacgggaaccagtacggaaaccccagcgcagcttcctcttcctctgctactctggctcccagccatccgaccgggtagtaattgtgttacgacgtcacgtcctccgaggcctaccgttgttctttcggtccgtccggaaggggagacggaccgtaccctaccccgttcgtacccgtggaccgacgggtaccgacgtcgaggtaggttacgttacgacgtacgacgacgtacttaccgtacgtcgtaccggtacacggacgtacgtaaccgtcgtccgtcggtcccgtaccgcggtaccttcctaccgtaagttaccgttagttcgggtaccggtacccgacccgtaacccggtccggtacccgtaccggcgggtaccggttacccgggaccgggttacggttaacggttacggtacgggttaccggttacggtaccgggttccggggttaaccgttttacggggaacgttaccggtttaccttacccgggtaccctttcgtacccgttaacgtacccgtaaacgtacccgggttaacgaaccgggtttacgtaacccgggggtaaaccttacccgggttaaagttttaccgttacggtaccgtttaacggtttaaacttaccgttttaacggtacccgttaacggttccggtttaccgttttaccgggtttaccccggttccccttttaaccgggtttccctaacccggtttttacttccccgggtttaaaccgtttttcccgggtttaggacccccggtttaacgggtttcggaccggttaccggtttaacggg

SEQ ID NO: 157805 - DNA, 861 bp, Homo sapiens
  misc_feature: GYAE6OF01AP08O.24.78.H01.1.454.CMB.1.raw
tcagactactatgtcacgaccggtgctcgatttagtgtgagtagtttgggtttggggagaggagcccagcactagaagtcggcggttgtttccattcggtgatcagcactgaacacagaggactcaccatgggaggtttggctgagtcgtttcgggttttcctcgtcgtcgttacttttaaggaggttcgtaccgtaggtcggtaccggagggggtacaggtcgttgggttcgggtaggtccgggtggggggccggtccggttcgggtacccaaccggtggggacggttcccgtagacgtcctcgtacgtgtcggccgtcccgtccgtaacttccgtaccttacaacttactttacgcggactagtcgacgtcggtcggtccgcgacggtcctaccggaaggcggtaacggggtcgtagggtacgggttcggggtaccgtccgtacgtttacttaggttttagttacgtaaggttaggtaaattaacgtaacgttaatttacgttacgtcgtaacggtaacgtaccggttccgggtaggtaccgggttaccctacgtaaccgttcgtacctaccgaagtaacgttaacctaacgttaaccctaaacttaaaccggtttcttacccgtttcggttaacctaagtaacccgttaaagtaccgtacccgttgtaccgtacggtacgtaactcggtaaacggccggtaccgtcgttaccgttagttaacctacggtttacgtacgtaacggaccgtaaacccggttccccgttacccggttaccccgtttaaggttacccgttaaggtttacccgggtcgggttaccccgtaccccgttagggtccgggttaacgtaacccgggg

SEQ ID NO: 157806 - DNA, 840 bp, Homo sapiens
  misc_feature: GYAE6OF01CD6YM.24.78.H01.1.454.CMB.1.raw
  modified_base (283)..(283): a, c, t, g, unknown or other
  misc_feature (283)..(283): n is a, c, g, or t
tcagactactatgtcacgaccggtgctcgatttagtgtgagtagtttgggtttggggagaggagcccagcactagaagtcggcggtgtttccattcggtgatcagcactgaacacagaggactcaccatggagtttgggctgagtcgttgggttttcctcgtcgtcttcttttaaaggaggtctccagtgtcgaggggcagtcgtgggtggacgtcgtgggggcggcgtcggtacccaacgtgggacgtccctgacgactctctggtcgccggtccctccgtnttaccaccttacaagttacttagtcggtacagttggcctacggtcgggtcccaccgaggccctaccggagggaccggtaacgggggccgtaggggtacggttgggggtccggacccgttactttacgtttacgtttaagttttaggaacggttaagggtaaaaactttaataacttaaaagtttaaggttaactcgggaacctacggtaacccgttcggggttaaggggaaacccgggttccgtttaccaaacccttacgtccgtacgaagaaccgtaactaactaaccgtaaactaaacgttacttacgttagtttacgtacgtaaacgtaaattacgtaaccgttacgtaccgtacgtaacgtacgttacggtacggaaacgggtccgtaaccgggttctttaacgttacgttaacgttacggtagggttaaccgtaaaccgtaaaccggttccccgtttacccccggtaacccgttttacgttaaccgttaggtttaaccggggttccggggtaaccccttacccccgtaaggtaccggtcgggttaacccggg

SEQ ID NO: 157807 - DNA, 756 bp, Homo sapiens
  misc_feature: GYAE6OF01BGL96.24.78.H01.1.454.CMB.1.raw
  modified_base (331)..(331): a, c, t, g, unknown or other
  misc_feature (331)..(331): n is a, c, g, or t
  modified_base (548)..(548): a, c, t, g, unknown or other
  misc_feature (548)..(548): n is a, c, g, or t
  modified_base (571)..(571): a, c, t, g, unknown or other
  misc_feature (571)..(571): n is a, c, g, or t
tcagactactatgtcacgaccggtgctcgatttagtgtgagtagtttgggtttggcacgaccggtgctcgatttagtgtgagttagtttggggtttgggggagagctgctcagttaggacccagaggaaccatcggaaaccccagcgcagtccttcttccttcctcctgtcctactcgtgcctcccacgccatccgaccggaggtattgtgtgacgctacgtctccgaggacctcccgttgttctttgtaccgtaccgggaaggggacaacggaccgcccctaccctcgtaccgtcggacgacgggaccagtacgaaggtagtcggttaancgaagacaacgtaccgttaacgtaccgtaccgtacggtaaccagaaccgaaacggtacccgtaccggccgttaccggacccgttacccggaacgtcccttacctacctagttaccgttacggtcggtaccgtaccctaaccgaccggtaaccggaccgtacggtcggtcggaccgtacggacgttacggtgacggtgacgtggtcgtccgtaggacncgtacttaccgcttaccaagttnaccgaagtacgaacggtacacggtacgacccgtaagttaacgttcgttacggacttaggtactttagaccgttgtccggtacttcggtttcccgttccgtacccgtttctaaccctttcggtaacgttcttaaacccggttcgtttaccgggccggtttaacgggtccggaggtttcgtaaacgg

SEQ ID NO: 157808 - DNA, 1148 bp, Homo sapiens
  misc_feature: GYAE6OF01ASK1F.24.78.H01.1.454.CMB.1.raw
tcagactactatgtcacgaccggtgctcgatttagtgtgagtagtttgggtttggcacgaccggtgctcgatttagtgtgagttaggtttggggtttgggggagagtctgctcgtagttacggaccccaaggaacgggaacctagtaaccgggaaacccccaggccgtacacgtctttcctcctttaccctctcgtccttactcgtcggaccctccccgacgacctaacgtaccggaaccgggtaggtaaagtttggtcggttacgaacgtcgtacgttcccaccgtaccgtaccccaccgttcgtacctggtcgtaccgtaaccgggaaagggggaaactacccgtacccccgtaaccccttcgtaccgtacgggaaccgtacggggtaaccaacgggttaggaaacggttaaacggttttcgggtaaccggaaaccgtaaccggttaaaacccgttaaaccggtttccggacccggtttaaaccggggaactacgggttaaaacccgaaagggttaaacccccgtacgggggtaccccggtaaaccggtcccccgtaccccgggtaacggttcccccctttacccccgggttaccgtttaaacgtaccggtttccgggtaaaccctttcccgggtacccccttaaacccccggacccggggttacccccggtacccggtttaccggttaaccccggtaacccccggttaccggggttaacccgggtttttaccgggggtttacccgggggttcggggtttaccccgggggtttaaggaccccggggtttaaagttaacccgggttaacgtttaacccgtttaaccggttaacccttcccggtaaaccgttaccgttaaccgacggttaacccgggtcgtacccgttaacgtaccgtttacggtaacgttacggtttacttacgttaaccttttaccgtttacgtttactaaccgttaaccgtaagttaccgttacggttacggtaccggttaaccgtttacccggtccgtttaaacccgggttcctttaaccggggtaacccgaaccggggttaacccggtaaaccggttaaacgtaacccgttaaaaccggaaccggtttaaacgtaaaaccgggtcccggttaaacgggttcgttaaaccccgg

SEQ ID NO: 157809 - DNA, 705 bp, Homo sapiens
  misc_feature: GYAE6OF01DXKE3.24.78.H01.1.454.CMB.1.raw
  modified_base (141)..(141): a, c, t, g, unknown or other
  misc_feature (141)..(141): n is a, c, g, or t
  modified_base (256)..(256): a, c, t, g, unknown or other
  misc_feature (256)..(256): n is a, c, g, or t
  modified_base (311)..(311): a, c, t, g, unknown or other
  misc_feature (311)..(311): n is a, c, g, or t
  modified_base (557)..(557): a, c, t, g, unknown or other
  misc_feature (557)..(557): n is a, c, g, or t
  modified_base (599)..(599): a, c, t, g, unknown or other
  misc_feature (599)..(599): n is a, c, g, or t
  modified_base (694)..(694): a, c, t, g, unknown or other
  misc_feature (694)..(694): n is a, c, g, or t
tcagactactatgtcacgaccggtgctcgatttagtgtgagtagtttgggtttggcacgaccggtgctcgatttagtgtgagtagtttgggtttgggagagctgctcagttacggaccagaggaaccatacggaaaccccngcgcacgtcttcctcgttccctctgcctactcgtcggcctccagccatcgaccggagtattgtgttacgacgctacgtcaccgagcctaccgtgttcctttgcgtccgagggtancgaccgccctacctctcgtacggcacggtactacgtcgtacgtagttacggtacncgacgacgacgttactaacgtcgaccgtaggtaaccgacgtaaccgtaacgtaaccgtccggtaccgtcggaccctaccggacgtcctccgtaacgtacgttcgtaggttccgacgttcccgaccggacgtacggtaccgacgttcggacggtccgggtacgtacggttaggtacgaaggtccggtagtaacggttcgttccggttaggacccttagtcccttaacgctacgtacagtaacgtacncgtaacgtccgtagaaccggtccgtaacgtattacgtacgtnttaacggtcttacttcggtctaagtgtttcccgttcgttaccttaccgtctttactacttccggttacgtacgttcgttccgacgttcggtaccnggttacgtacg

SEQ ID NO: 157810 - DNA, 887 bp, Homo sapiens
  misc_feature: GYAE6OF01AP0ZD.24.78.H01.1.454.CMB.1.raw
tcagactactatgtcacgaccggtgctcgatttagtgtgagtagtttgggtttggggagaggagcccagcactagaagttcggcggtgtttccagttcggtgatcagcactgaacacgagagactcaccatggagtttgggctgagtcgttgggttttcctcgtcgtctttcgttttaaagaggttcgtccgaggttgtcgaggggctagtcgtggtggagtcggtgggggcgtcggttcggtaccgaaccggtggggacggttccctggacgtaccttcgtcgtgtcggccgtccctccgtattcctaccttagaattacgttagtcggctagtcgaccgtacgttccgggccaccgtcggtcccgtacggacggacggtaacggggtctggggtacgtggggccgaccggtatttagttaccgttttagtacggaagttaacggtaaaagttactaacgtaaatttaaactcgtacggtactaaccgggttaccgtaccgggtaacgggaacccgggtttccgttacccaaccgttagtttaccccgagtaaccggtaacgtaacccgttaacgttaacccgaaacgttaccgttactttacgtttacgtttacgtacgttaacgtaaccgtaggtaacccttacggtacctacggaacgttacgttacggtaacggacgttaacccgtaccgttacgttaccgttaacgtttccggttaacgtacggtttaacccggtaaaccggttaacccgttaacccccggtttccccgtttaacccgtttaaacggtttaaccccggttaacgggttttacccgggttacgggttaacccccggttaacccccgttaagggttccggttaacccgggggtttaaacccgg

SEQ ID NO: 157811 - DNA, 846 bp, Homo sapiens
  misc_feature: GYAE6OF01AZWD6.24.78.H01.1.454.CMB.1.raw
tcagactactatgtcacgaccggtgctcgatttagtgtgagtagtttgggtttgggggaggagcccagcactagaagtcggcggtgtttccagttcggtgatcagcactgaacacagaggactcaccatggagtttggctgagtctgggttttcctcgtcgcttcgttttaaagaggtgtccagtgtcgaggggcagcgtggtggagtcgtgggggcgcgtcggtccaaccgtgggacgtcctgacgactctcctgtcgccggcctcccgattcaccttacaattacttagtcggctatgacgacgtcgggtacccgccgaggtcctacccgaggaccgtaaagggggctagggacggttggggtcggacccggtattaagtttaccgtttatttaggaacgttagggtaaaacgttaactacgtaaaatttaagttaacgtagtaccgtaaacggtacccgttaacccgggtaggggtaaaacccggggtccccgtttaccctaaaacccgtagtttaccccgaccgtaacggaacgtaaaccctaacgttaaaccccgaaactaaaccttaaccttacgtttacgtttaacctagtaaaccttaaagttaaccgtaacgttaaccgaccgttacggaccggttaacttacgtaacggtacggtaacccgtacggttaccgttacgtttaacgttaacgttaccgttaggttacggaaacggtaaaaccgttcccggtttccccccggttaacttttacccgttaaaggttccgtttaaacggtttcgggggttaccccgtaccccggtaaagtcccggttaaggggtacccgtttaaccggggg

SEQ ID NO: 157812 - DNA, 697 bp, Homo sapiens
  misc_feature: GYAE6OF01BPX9K.24.78.H01.1.454.CMB.1.raw
  modified_base (205)..(205): a, c, t, g, unknown or other
  misc_feature (205)..(205): n is a, c, g, or t
  modified_base (325)..(325): a, c, t, g, unknown or other
  misc_feature (325)..(325): n is a, c, g, or t
  modified_base (560)..(560): a, c, t, g, unknown or other
  misc_feature (560)..(560): n is a, c, g, or t
  modified_base (570)..(570): a, c, t, g, unknown or other
  misc_feature (570)..(570): n is a, c, g, or t
  modified_base (605)..(605): a, c, t, g, unknown or other
  misc_feature (605)..(605): n is a, c, g, or t
  modified_base (620)..(620): a, c, t, g, unknown or other
  misc_feature (620)..(620): n is a, c, g, or t
  modified_base (660)..(660): a, c, t, g, unknown or other
  misc_feature (660)..(660): n is a, c, g, or t
  modified_base (684)..(684): a, c, t, g, unknown or other
  misc_feature (684)..(684): n is a, c, g, or t
tcagactactatgtcacgaccggtgctcgatttagtgtgagtagtttgggtttggcacgaccggtgctcgatttagtgtgagtagtttgggtttgggagagctgctcaggttacggacccgaggaggaaccagtacggaaaccccagcgtcagtcttctcttcctctgactctgtgcctccgagcactccgacggtagtatttgngttcgacgcgagtccgtccgacggccgtacccttgttccgttttgccgtacggaggggacgtacgacgtcccctacctcgtcgtcggaccgacggtcctagtacgagttaggttagtacngaacggtacaacgttcctaaacgttcgaccggttacgaccggaacgtaactacggtaacccgtcggaccgtcgcccgtacgacgttccacttacgtacttacgtaaggttccggtcaaccggttacccgaacggacggtaccgtacggtcggaccggttacacggtaccgtaggtccgaggtacgggtacgttaaggcggttacgacggacgtacttccgacgtactcgttaacntacgaaccgntacgacgtacgtccgaacgttaagttctaacggtnacgtagttactcgtnttacgcgtgttccgtgttccctacggtcctactaccggtnttaccgtcttggtcccgagttacncgggtctagaccg

SEQ ID NO: 157813 - DNA, 730 bp, Homo sapiens
  misc_feature: GYAE6OF01D21RA.24.78.H01.1.454.CMB.1.raw
  modified_base (141)..(141): a, c, t, g, unknown or other
  misc_feature (141)..(141): n is a, c, g, or t
  modified_base (215)..(215): a, c, t, g, unknown or other
  misc_feature (215)..(215): n is a, c, g, or t
  modified_base (253)..(253): a, c, t, g, unknown or other
  misc_feature (253)..(253): n is a, c, g, or t
  modified_base (529)..(529): a, c, t, g, unknown or other
  misc_feature (529)..(529): n is a, c, g, or t
tcagactactatgtcacgaccggtgctcgatttagtgtgagtagtttgggtttggcacgaccggtgctcgatttagtgtgagtagtttgggtttggggagagctgctcagttacggaccagaggaaccagtcggaaacccngcgcagtcttctcttcctctgctactcgtcggcctccagccatcgaacggagtaattgtgttcgcgatacgtcncacggcctacccgttggttctttcgcctacggaggganacgaccgcctacctcgtctcggacgtacgggactagtcgaaggtacggttcgtagcgtagctacgtacctagttaccgtcgttaccggaacaagtaacgaaaccgtacggtcggtaccgtcggacctccgaggtcctactacgtactcgtagttcggctcgtaccacggggtactaccggacgttcggacgtacccggtaggtacggtaacggtcgttaacgggtcgtacgggtacgggttaccgttggttaaccggggactacggttaaccgttntaaccgtacgtacctacgtacgtaacgtacgtaacgcggtaacggttacgaccgtaaccgttaatttggttactacgtacggtatttacgtcttacggacgttctttaacggttccgtttaggtaccccttgttaaccttagttcgttaactaccttttacgggtcttaacggggttaccgtacggtaggtccgtaaacgg

SEQ ID NO: 157814 - DNA, 823 bp, Homo sapiens
  misc_feature: GYAE6OF01E2LNU.24.78.H01.1.454.CMB.1.raw
  modified_base (450)..(450): a, c, t, g, unknown or other
  misc_feature (450)..(450): n is a, c, g, or t
tcagactactatgtcacgaccggtgctcgatttagtgtgagtagtttgggtttggggagaggagcccagcactagaaggtcggcggtgtttccattcggtcgatcagcactgaacacagaggactcaccatggagtttgggctgagcttgggttttcctcgtcgtcttcgttttaaaggaggtgtccagtgtcgaggggcagctgggtggagtcgtgggggcggcgtggtcccaaccgtggggacgtccctgacgctctccgtgtcgccggtccctcccgtattcctaccttcaaattaccttagtcggctagtcgtcgtaccgtcgggtacccgccaggcctaccgagggacgaagggggtcttagggagggttcggggtcggtcccgtcttaacttcgtttaatttggaagttagggtaaagttaaacttctaaaatttagtttaacncggaccgtaagtacccgtttaacccggggtagggtaaacccggggttccccggttaccaaacccgtacttacccgtacccgaacggaaccgtaaaccttaaacccgtttaaccccaaaacgttaaaccttacccgttacgttttaccgtttactaccggtaaactaaacttacggaacctttaaccggtcccgtacgtacgtaacttaccggtacggtaacggtaccggacggtacttacgttacttaagttccgtaggttacgaaaccggtaaaccggttccccgttacccccggtaccctttaccgttacgttagtttaccgggttccgggtaccccggtacccccgttaacgtaccggtcggttacccgg

SEQ ID NO: 157815 - DNA, 823 bp, Homo sapiens
  misc_feature: GYAE6OF01DRMEH.24.78.H01.1.454.CMB.1.raw
  modified_base (141)..(141): a, c, t, g, unknown or other
  misc_feature (141)..(141): n is a, c, g, or t
  modified_base (162)..(162): a, c, t, g, unknown or other
  misc_feature (162)..(162): n is a, c, g, or t
  modified_base (179)..(179): a, c, t, g, unknown or other
  misc_feature (179)..(179): n is a, c, g, or t
  modified_base (266)..(266): a, c, t, g, unknown or other
  misc_feature (266)..(266): n is a, c, g, or t
tcagactactatgtcacgaccggtgctcgatttagtgtgagtagtttgggtttgggcacgaccggtgctcgatttagtgtgagtagtttgggttgggagagctgctcagttacggaccagacggaaccactggaaaccccngcgcagtcttctctcctcgtnctactcgcgcctccacncactacgacggagtattgtgttagacgcgtacgtcctaccgagcctacccttgttcgtttcgtccgtacggaaggggactaggaccncccctaccctcgtcgagccgacggctaacgtcgaaggtacgttaagacgacctagactaacgtacccttaacgttacgtaccgttacggaactacgaacgaaacgtaacccgcggtacccgtccggcctcccgggaaccgttccctaccgtcttaacgtacgtcgttaggtccgtaaccccgtaccggtaacccgtaccgggtacctaacccgggttcgggacccggttaacgggaaccggtccgttcgggttacgacgggttacggacgttacgggttacgttccggttaagggactaacgtacgttaccacgttaaccgtacttaccttacgtaacggtacgtaaccgtacgggtacgttaacgggaccgttaacgttaaacgttttccgtaacggttaacgttagtttccgttaaacggttcttacgttacgtaccggttaacgtttcccggttacccttaccccgttctttaccctaaacccgtttcgttaaccgtttaccgttacccgtttaccggaacggttcggtaaacccggttggtcccggtaaaacg

SEQ ID NO: 157816 - DNA, 506 bp, Homo sapiens
  misc_feature: GYAE6OF02IWQQM.24.78.H01.1.454.CMB.1.raw
tcagactactatgtcacgaccggtgctcgatttagtgtgagtagtttgggtttgggagagctgctcagttaggacccagagggaaccatggaaaccccagcgcagcttctcttcctcctgctactctggctcccagccatcaccggaggaattgtgttgacgcagtctccaggcaccctgtctttgtctccaggggagagagccaccctctcctgcagggccagtcagagtgttagcagcagctacttagcctggtaccagcagaaacctggcctggctcccaggctcctcatctatggtgcgtccaccagggccactggcgtcgcggacaggttcagtggcagtggctttgggacagacttcactctcaccgtcagcagcctagagcctgaagatttgcggtttactacttgtcagcagcgttccgcctggccgctaactttcggcggggaccagggtggagaggagacgaactggtggctgcaccatctgtcttcatctcccgc

SEQ ID NO: 157817 - DNA, 280 bp, Homo sapiens
  misc_feature: GYAE6OF02H5VXZ.24.78.H01.1.454.CMB.1.raw
  modified_base (257)..(280): a, c, t, g, unknown or other
  misc_feature (257)..(280): n is a, c, g, or t
tcagactactatgtcacgaccggtgctcgatttagtgtgagtagttgggtttgggacagacttcactctcatcatcgacagactggagcccgaagattttgcacgtgtattactgtcagctgtttggtccctctcctcctatgtacacttttggccagggttccaggctggagatcaagcgaactgtggctgcaccatctgtcttcatcttccgcatctgaacatagtagtctgagcgggctggcaaggcgcatagnnnnnnnnnnnnnnnnnnnnnnnn

SEQ ID NO: 157818 - DNA, 266 bp, Homo sapiens
  misc_feature: GYAE6OF02GVVFY.24.78.H01.1.454.CMB.1.raw
  modified_base (258)..(266): a, c, t, g, unknown or other
  misc_feature (258)..(266): n is a, c, g, or t
tcagactactatgtcacgaccggtgctcgatttagtgtgagtagttgggtttgggacagacttcactctcatcatcgacagactggagcccgaagattttgcagtgtattactgtcagctgtttggtccctctcctcctatgtacacttttggccagggttccaggctggagatcaagcgaactgtggctgcaccatctgtcttcatcttcccgccatctgaacatagtagtctgagcgggctggcaaggcgcatagnnnnnnnnn

SEQ ID NO: 157819 - DNA, 520 bp, Homo sapiens
  misc_feature: GYAE6OF02IEW2J.24.78.H01.1.454.CMB.1.raw
  modified_base (199)..(199): a, c, t, g, unknown or other
  misc_feature (199)..(199): n is a, c, g, or t
tcagactactatgtcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgtctccagggganagagccaccctctcctgcagggccagtcagagtgttagcagcagctacttagcctggtaccagcagaacctggcctggctccaggctcctcatctatggtatatccagcagggccactggtgtcccagccaggttcagtggcagtggtctgggacagagttcactctcaccatcagcacgtctgcagtctagaagtattttgctagtttattactgccagcagtcacagtgactgccgctctacgtttcgggcggagggaccgaagggtcggagtacgttacgaaaacggtacgtaggttacggacgttggaccacctacg

SEQ ID NO: 157820 - DNA, 535 bp, Homo sapiens
  misc_feature: GYAE6OF02GHQNH.24.78.H01.1.454.CMB.1.raw
  modified_base (241)..(241): a, c, t, g, unknown or other
  misc_feature (241)..(241): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgtctccaggggganagagccaccctctcctgcagggccagtcagagtgttagcagcagctacttagcctggtaccagcagaaacctggcctggctcccaggctcctcctctatgctgtctccaccagggcccctggtcgtcccagccaggttcgttgggcggtgggtcgtgggacagatttcactctcaccatcagcggcctccagtctgaagtatttgctactttatttctgtctaactactatgtgactggcctccgtactacttttcggccgtagggaccaacgtcggagatacaacgactacgg

SEQ ID NO: 157821 - DNA, 513 bp, Homo sapiens
  misc_feature: GYAE6OF02G5X2N.24.78.H01.1.454.CMB.1.raw
  modified_base (201)..(201): a, c, t, g, unknown or other
  misc_feature (201)..(201): n is a, c, g, or t
  modified_base (305)..(305): a, c, t, g, unknown or other
  misc_feature (305)..(305): n is a, c, g, or t
  modified_base (359)..(359): a, c, t, g, unknown or other
  misc_feature (359)..(359): n is a, c, g, or t
  modified_base (365)..(365): a, c, t, g, unknown or other
  misc_feature (365)..(365): n is a, c, g, or t
  modified_base (380)..(380): a, c, t, g, unknown or other
  misc_feature (380)..(380): n is a, c, g, or t
  modified_base (476)..(476): a, c, t, g, unknown or other
  misc_feature (476)..(476): n is a, c, g, or t
  modified_base (508)..(508): a, c, t, g, unknown or other
  misc_feature (508)..(508): n is a, c, g, or t
tcagactactatgtcacgaccggtgctcgatttagtgtgagtagtttgggtttggggtaggtagcgtgctcagttaggacccagagggaaccatggaaacccagcgcagcttctcttcctcctgctactctggctcccagccatcaccggagaattgtgttgacgcagtctccaggcaccctgtctttgtctccagggganagagccaccctctcctgcagggcccagtcagagtgttagcagcagtctattagcctggtaccagcagaaacctggcctggctcccaggctcctcatctatggtncgtccaccagggccatggctcgcggacaggttcagtggcagtggctttgggacngacttnactctcatcatcganagactgagcccgaagactttgctagtgtattactgttcagtctgtttgtccctcgttcctcctattgtactacttttgcctagggtcagctggtanatcgaagtcgaactgtacggtctgtcgacctntaccg

SEQ ID NO: 157822 - DNA, 258 bp, Homo sapiens; identical to SEQ ID NO: 157590
  misc_feature: GYAE6OF02I2HTZ.24.78.H01.1.454.CMB.1.raw
  modified_base (257)..(258): a, c, t, g, unknown or other
  misc_feature (257)..(258): n is a, c, g, or t

SEQ ID NO: 157823 - DNA, 527 bp, Homo sapiens
  misc_feature: GYAE6OF02IQF52.24.78.H01.1.454.CMB.1.raw
  modified_base (241)..(241): a, c, t, g, unknown or other
  misc_feature (241)..(241): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaacccatggaaaccccagcgcagcttctcttcctcctgctactctggctcccagccatcaccggaggaattgtgttgacgcagtctccaggcaccctgtctttgtctccagggganagagccaccctctcctgcagggccagtcagagtgttagcagcagctacttagcctggtaccagcagaacctggcctggctccaggctcctcatctatggtgcgtccacagggccactggcgtcgcgacaggttcagtggcagtggcttgggacagacttcactctcatcatcgacagactggagcccgaagattttgctagtgtattactgtcagtctgtttcgtcccttcttcccttccttatcgttactacttttcggtcctaggggtttcctaggtctacggg

SEQ ID NO: 157824 - DNA, 549 bp, Homo sapiens
  misc_feature: GYAE6OF02J3AU8.24.78.H01.1.454.CMB.1.raw
  modified_base (200)..(200): a, c, t, g, unknown or other
  misc_feature (200)..(200): n is a, c, g, or t
tcagactactatgtcacgaccggtgctcgatttagtgtgagtagtttgggtttggggaggagctgctcagttacggacccagagggaaccatggaaaccccagcgcagcttctcttcctcctgctactctggctcccagccatcaccggaggattgtgttgacgcagtctccaggcaccctgtctttgtctccagggganagagccaccctctcctgcagggccagtcagagtgttagcagcagctacttagcctggtaccagcagaacctggcctggctcccaggctcctcatctatggtgcgtccaccagggccactggcgtcgcggacaggttcagtggcagtggctttgggacagcttcactctcaccatcagcagtgtagagcctagagtattttgactagttttactacttgtcagtcctacgtgaccaacgttccggacctacgttttccggcccgtcggtaccagtactacggacacgtcccgaaacggtacctggttacggccttggaccctaccgtacttcctcggttccttccgtacc

SEQ ID NO: 157825 - DNA, 542 bp, Homo sapiens
  misc_feature: GYAE6OF02H4QL1.24.78.H01.1.454.CMB.1.raw
  modified_base (530)..(530): a, c, t, g, unknown or other
  misc_feature (530)..(530): n is a, c, g, or t
tcagactactatgtcacgaccggtgctcgatttagtgtgagtagtttgggtttggggagaggagcccagcactagaagtcggcggtgtttccattcggtgatcagcactgaacacagaggactcaccatggagtttgggctgagctgggttttcctcgtcgctcttttaagaggtgtccagtgtcaggggcagctggtggagtctgggggcggcgtggtccaacctgggaggtccctgagactctcctgtgcggcctcccgattcaccttcaatacttatggcatgcactgggtccgccaggctcccaggcaagggggctggagtgggtggccgctatcttatttgatggaagtaatcaatattatgcagactccgtgaagggccggttcaccatctccagagacaattccaaacaatactctgtttctgcaaatgactagcctgcgatctagagacacggctgtctattactgtgacgaaagtcttccccggcccttcttaacgatttagttcggggtccgtcccctanacgtggtaccgg

SEQ ID NO: 157826 - DNA, 506 bp, Homo sapiens
  misc_feature: GYAE6OF02ISYMH.24.78.H01.1.454.CMB.1.raw
  modified_base (199)..(199): a, c, t, g, unknown or other
  misc_feature (199)..(199): n is a, c, g, or t
  modified_base (358)..(358): a, c, t, g, unknown or other
  misc_feature (358)..(358): n is a, c, g, or t
tcagactactatgtcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgtctccagggganagagccaccctctcctgcagggccagtcagagtgttagcagcagctacttagcctggtaccagcagaaacctggcctggctcccaggctcctcatctatggtgcgtccaccagggccactggcgtcgcggacaggttcagtggcagtggctttgggacnggacttcactctcatcatcgacagactggagcccgaagatttgctagtgtattactgtcagtctgtttgtcccttctcctcctatgttactactttggcctagggttccaggtctggagtatcaagcgaactgtcggctgcaccatcg

SEQ ID NO: 157827 - DNA, 559 bp, Homo sapiens
  misc_feature: GYAE6OF02IYWJL.24.78.H01.1.454.CMB.1.raw
  modified_base (310)..(310): a, c, t, g, unknown or other
  misc_feature (310)..(310): n is a, c, g, or t
  modified_base (348)..(348): a, c, t, g, unknown or other
  misc_feature (348)..(348): n is a, c, g, or t
  modified_base (431)..(431): a, c, t, g, unknown or other
  misc_feature (431)..(431): n is a, c, g, or t
  modified_base (451)..(451): a, c, t, g, unknown or other
  misc_feature (451)..(451): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggctcccagatgccaccggagacatttgtgttgacacagtctccagccaccctgtctttgtctccaggggaaagagcccaccctctcctgcagggccagtgacaatgttaggaagttgttagcctggtatcaacacaaacntgccaggctccaggctcctcatctatgatgtctcaacngggtcactggcgtcccgcaggttcagtggcagtggtctgggacagacttcactctcacgtcagcagctagacgcctgaacgtntttgcgttttactactgtcngctacgccgttccgtcctacggtcccgacgttaaccggtttccggggccggggggaccgaggggtgggaaggacgggtacggaaccggtaactgggttacggctacgg

SEQ ID NO: 157828 - DNA, 507 bp, Homo sapiens
  misc_feature: GYAE6OF02HKSKE.24.78.H01.1.454.CMB.1.raw
  modified_base (241)..(241): a, c, t, g, unknown or other
  misc_feature (241)..(241): n is a, c, g, or t
  modified_base (342)..(342): a, c, t, g, unknown or other
  misc_feature (342)..(342): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaacccccagcgcagcttctcttcctcctgctactctggctcccagccatcaccggaggaattgtgttgacgcagtctccaggcaccctgtctttgtctccagggganagagccacctctcctgcagggccagtcagagtgttagcagcagctattagcctggtaccagcagaaacctggcctggctcccaggctcctcatctatggtncgtccacagggccactggcgtcgcgacaggttcagtggcagtggctttgggacagacttcactctcatcatcgacagactgagccgaagatttgctagtgtattactgtcagctgttgtcctctcctcctatcgtactcgtttcgcctagggttccaggtctcgg

SEQ ID NO: 157829 - DNA, 260 bp, Homo sapiens
  misc_feature: GYAE6OF02GXLFE.24.78.H01.1.454.CMB.1.raw
  modified_base (258)..(260): a, c, t, g, unknown or other
  misc_feature (258)..(260): n is a, c, g, or t
tcagactactatgtcacgaccggtgctcgatttagtgtgagtagttgggtttgggacagacttcactctcatcatcgacagactggagcccgaagattttgcagtgtattactgtcagctgtttggtccctctcctcctatgtacacttttggccagggttccaggctggagatcaagcgaactgtggctgcaccatctgtcttcatcttcccgccatctgaacatagtagtctgagcgggctggcaaggcgcatagnnn

SEQ ID NO: 157830 - DNA, 260 bp, Homo sapiens
  misc_feature: GYAE6OF02GKT68.24.78.H01.1.454.CMB.1.raw
  modified_base (259)..(260): a, c, t, g, unknown or other
  misc_feature (259)..(260): n is a, c, g, or t
tcagactactatgtcacgaccggtgctcgatttagtgtgagtagtttgggtttgggacagacttcactctcatcatcgacagactggagcccgaagattttgcagtgtattactgtcagctgtttggtccctctcctcctatgtacacttttggccagggttccaggctggagatcaagcgaactgtggctgcaccatctgtcttcatcttcccgccatctgaacatagtagtctgagcgggctggcaaggcgcatagnn

SEQ ID NO: 157831 - DNA, 533 bp, Homo sapiens
  misc_feature: GYAE6OF02HYHPC.24.78.H01.1.454.CMB.1.raw
  modified_base (238)..(238): a, c, t, g, unknown or other
  misc_feature (238)..(238): n is a, c, g, or t
  modified_base (526)..(526): a, c, t, g, unknown or other
  misc_feature (526)..(526): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcacctgtctttgctccagggganagagccacctctcctgcagggccagtcagagtgttagcagcagctacttagcctggtaccagcagaacctggcctggctcccaggcctcctcatctatggtcgccgtccaccgagggcccacgtcggcgtcgcggacaggttcaggtggcgagtggtcgtttgggacagtacttcactctcatcactcgacagacgtcggacgccgaagtattttcgctagtgttacttacgtgtctagtcttgtttcgtcctctcctctattcgtactcgtttcggcctacggttcnggtctgg

SEQ ID NO: 157832 - DNA, 616 bp, Homo sapiens
  misc_feature: GYAE6OF02HQSVN.24.78.H01.1.454.CMB.1.raw
tcagactactatgtcacgaccggtgctcgatttagtgtgagtagttgggtttggggtaggagactgctcagttaggacccagagggaaccatggaaacccacgcgcagcttctcttcctcctgctactctggctcccacgccactcaccggacggaattgtgttgtacgcagtctccaggcaccctcgtctttgttctccagggagagagccaccctctcctcgcaggccgagtcgacgagtgttagactagcgagtctaactagacctaggtaccagcacgaaaccgtggcctcggctcccaggctcctcgatcctaagtgggtcgcctccgaccgaccggggcccacgtgggccgtcggccggaactagggttccaggtcggaccaggttcggtctttacgggacacggtaccttcactctacatcgacgtcgacgagtacgtggacgtaccgtaagtatttcgactagtagttacttacgtcgtcgacgtcgttcgttcggtcccgtccgtccgtcgtacgtacgtacgtacgtttcggcgtacgggtccgacgtcgtacggacgtacgtacgacgtacgtacgttcgtacggtcctacgccgtactacgtcg

SEQ ID NO: 157833 - DNA, 653 bp, Homo sapiens
  misc_feature: GYAE6OF02IY28P.24.78.H01.1.454.CMB.1.raw
  modified_base (301)..(301): a, c, t, g, unknown or other
  misc_feature (301)..(301): n is a, c, g, or t
tcagactactatgtcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgtctccaggggagagagccaccctctcctgcagggccagtcagagtgtagcagcagctacttagcctggtaccagcagaaacctggcctggctcccaggctcctcatctatggtncgtccaccacgggcacgtggcgtcgcggacaggttcagtggcagtggctttgggacagacttcgactcgtacatacatcgactacgacgtacgggacgacccggtaaagtaagttttcgacgtaagttacggttaacttttaccgtacggttaccgaagtccgttaggtttttcgggttcccctttaccgttccctttaccgttaacgtttccgttaaccttaccgtttttacgggacccgttaacggggttcccgtacgggttccgttacgggtaacggtacgttaccggtaaacggtaccggtaaaccgttcggtacgggtaccgtacggtacctacccgtagtttaccg

SEQ ID NO: 157834 - DNA, 584 bp, Homo sapiens
  misc_feature: GYAE6OF02JKE72.24.78.H01.1.454.CMB.1.raw
  modified_base (238)..(238): a, c, t, g, unknown or other
  misc_feature (238)..(238): n is a, c, g, or t
  modified_base (340)..(340): a, c, t, g, unknown or other
  misc_feature (340)..(340): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcacctgtctttgctccagggganagacgccaccctctcctgcaggaccagtcagagtgtagcagctagctactagcctggtaccagcagaacctggcctggctccgagctcctcatctatggtcncgtccacgaggccacgtggcgtcgacggacacgggttcagtggcgtaggtggcgtttgggactaggtacttcgacgtctcactcactcgactacgactacggacgacccgagtaagttttcgaccgtagtagttacgttaacgtcgtacgtagtcgttggtttcggttcccttcgttaccttcgttaacttcgttaacttacgttttcggtacccgtacgggtttccgtacggttcgttacggg

SEQ ID NO: 157835 - DNA, 528 bp, Homo sapiens
  misc_feature: GYAE6OF02I0Z47.24.78.H01.1.454.CMB.1.raw
  modified_base (477)..(477): a, c, t, g, unknown or other
  misc_feature (477)..(477): n is a, c, g, or t
tcagactactatgtcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgtcctccgaggggagagagccaccctctcctgcagggccagtcagagtgttagcagcagctacttagcctggtaccagcagaacctggcctggcctccaggctcctcatctatggtgcgtccaccgagggccactcggcgtcgcggacaggttcagtggcagtggctttgggacaggacttcactctcatcatcgacagacgtggacgacccgaagtatttgctagttgttacttactgtcagtctgtttcgtcctctcctctatcgtactacgtttcgcgtacggttccnggtcgtagggtgtactcgaacgcgtaacgtggtcggtcgtgcctactatcg

SEQ ID NO: 157836 - DNA, 260 bp, Homo sapiens
  misc_feature: GYAE6OF02H1CZJ.24.78.H01.1.454.CMB.1.raw
  modified_base (258)..(260): a, c, t, g, unknown or other
  misc_feature (258)..(260): n is a, c, g, or t
tcagactactatgtcacgaccggtgctcgatttagtgtgagtagtttgggtttgggacagacttcactctcatcatcgacagactggagcccgaagattttgcagtgtattactgtcagctgtttggtccctctcctcctatgtacacttttggccagggttccaggctggagatcaagcgaactgtggctgcaccatctgtcttcatcttccgccatctgaacatagtagtctgagcgggctggcaaggcgcatagnnn

SEQ ID NO: 157837 - DNA, 717 bp, Homo sapiens
  misc_feature: GYAE6OF02IXG7P.24.78.H01.1.454.CMB.1.raw
tcagactactatgtcacgaccggtgctcgatttagtgtgagtagtttgggtttgggggaggggagcccagcactagaagtcggcggtgtttccattcggtgatcagcactgaacacagaggacgtcaccatggaggtttgggtcgtgagcgtgggttttccgttcgtcgctctttaagtaggtgtccagtgtcaggggcgagcgtggtggagtcgtgggggcgggcgtggtccaaccgtgggaggtcctgagactctcctgtgcggccctccgacttcaccttcaattacttatggcatgcactcgggtccgccaggctccagggcgaagggggcgtgggaggtggggtgggccgcttattctttatttggagtaggtaaaggtaattacaaattaattttagtggcaacgtacgttcccggtagggaaacggggtcccggtttccaaccacgtttcctccgaacggaagtaacctaaactttaccccaaaacctaaattaacccttctttcgtttttacctaggtaacctaaaagttcgtaacccttaaggcccctttggcgtaacttcgtaggtaagggacccgacggtcttgtttaacttactttaacgtgtacggacgtaaaaggtcccgtttcccccggttaccctttacttaacggtgttttacggttcgggggttcccggacccccctagaaggttccgggacgttccgg

SEQ ID NO: 157838 - DNA, 705 bp, Homo sapiens
  misc_feature: GYAE6OF02JQN94.24.78.H01.1.454.CMB.1.raw
  modified_base (239)..(239): a, c, t, g, unknown or other
  misc_feature (239)..(239): n is a, c, g, or t
  modified_base (305)..(305): a, c, t, g, unknown or other
  misc_feature (305)..(305): n is a, c, g, or t
tcagactactatgtcacgaccggtgctcgatttagtgtgagtagtttgggtttggtcacgaccggtgctcgatttagtgtgagtagtttgggtttgggagagctgctcagttaggacccagagggaaccatggaaaccccagcgcagcttctcttcctcctgctactctggctcccagccatcaccggaggaattgtgttgacgcagtctccaggcaccctgtctttgctccagggganagacgccaccctctcctgccaggggccagtccagagtgttagcagcagctacttagcctggtaccngcagaacctggacctggactcccaggtcctcctcatcctatggctcgtaccacgagggcccacgtcggcgtcgcggactaggttccgaggttcggcgtaacgggtcggtcgttttacggggaacctacggtaccttaccgacgttccgttacgacgttacgtaacgttaccgaaccgtaacggtaccgttaggaaccggtaccccgggtaaagtaccgtttttacggaccgttaaggttccgttaacgtttaacccggttgttaccgtaaggttcccgttacggtttttccggtacccccgttccgtttacccgttaccgtttaacgttccgtttaaaccgttccgtttttacgggtccccgttaacggggtttccccttacgggtcccgtttaacgggg

SEQ ID NO: 157839 - DNA, 566 bp, Homo sapiens
  misc_feature: GYAE6OF02HKKDN.24.78.H01.1.454.CMB.1.raw
  modified_base (242)..(242): a, c, t, g, unknown or other
  misc_feature (242)..(242): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaagccccagctcagcttctcttcctcctgctactctggctcccagatgccaccggagacattgtgttgacacagtctccagccaccctgtctttgtctccaggggaaangccaccctctcctgcagggccagtgacaatgttaggaagttgtagcctggtatcaacacaaacatggccaggcctccccggctcctcatctatgatgcatccaatagggccactggcatcccagacaggttcagtgcaggtggtcgtgggacagtacttcactctacaccatcagcagtgtagagtccgtagaagtattttgacttacttttatttcgttagtacctaactacttagtggttcgtaacgttcggtcccttaccgttaacgttaccgttttcgggacccggtaacggggtaaccctaaacggttcggaagtaacg

SEQ ID NO: 157840 - DNA, 597 bp, Homo sapiens
  misc_feature: GYAE6OF02JI605.24.78.H01.1.454.CMB.1.raw
  modified_base (241)..(241): a, c, t, g, unknown or other
  misc_feature (241)..(241): n is a, c, g, or t
  modified_base (340)..(340): a, c, t, g, unknown or other
  misc_feature (340)..(340): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaagccccagctcagcttctcttcctcctgctactctggctcccagataccactggagaagtagtcatgacgcagtctccagccacctgtctgtgtctccaggggaaangccaccctctcctgccagggccagtgagaatgttggcagcaacttgcctggtaccagcagaacctggccaggctccagctcctctctatcgctcgtccnccaccgacgggcccctggtcgtcccagcccgtaggtttccggtcggcgggtggttcgtcgggacagtacttcgactctcgactatcgacgccggcctaccgacgtccgtagaacgtagttttcgacttacttttactttcgtgtacctaactaccgtattacggtgtacgtcggtcctccggttacttacgttttcggacccgtacggggtaaccctaacggttcgggaacgtacgtaaccgaacggtaacgttcgg

SEQ ID NO: 157841 - DNA, 518 bp, Homo sapiens
  misc_feature: GYAE6OF02GS01A.24.78.H01.1.454.CMB.1.raw
  modified_base (239)..(239): a, c, t, g, unknown or other
  misc_feature (239)..(239): n is a, c, g, or t
  modified_base (400)..(400): a, c, t, g, unknown or other
  misc_feature (400)..(400): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgctccagggganagagccaccctctcctgcagggccagtcagagtgttagcagcagctacttagcctggtaccagcagaaacctggcctggctcccaggctcctcatctatggtgcgtccaccagggccacgtggcgtcgcggacacggttcagtggcagtggctttgggacngacttcactctcatcatcgacagactggacgccgaagtactttgctagtgttattactgtcagtcttgttcggtccctctcctctatcgtactactttcggcctaggttcaggtctgg

SEQ ID NO: 157842 - DNA, 261 bp, Homo sapiens
  misc_feature: GYAE6OF02GX8DU.24.78.H01.1.454.CMB.1.raw
  modified_base (256)..(261): a, c, t, g, unknown or other
  misc_feature (256)..(261): n is a, c, g, or t
tcagactactatgtcacgaccggtgctcgatttagtgtgagtagttgggtttgggacagacttcactctcatcatcgacagactggagcccgaagatttgcagtgtattactgtcagctgtttggtccctctcctcctatgtacacttttggccagggttccaggctggagatcaagcgaactgtggctgcaccatctgtcttcatcttcccgccatctgacatagtagtctgagcgggctggcaaggcgcatagnnnnnn

SEQ ID NO: 157843 - DNA, 500 bp, Homo sapiens
  misc_feature: GYAE6OF02GPAGT.24.78.H01.1.454.CMB.1.raw
  modified_base (199)..(199): a, c, t, g, unknown or other
  misc_feature (199)..(199): n is a, c, g, or t
  modified_base (469)..(469): a, c, t, g, unknown or other
  misc_feature (469)..(469): n is a, c, g, or t
tcagactactatgtcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgtctccagggganagagccaccctctcctgcagggccagtcagagtgttagcagcagctacttagcctggtaccagcagaaacctggcctggctcccaggctcctcatctatggtgcgtccaccagggccactggcgtcgcggacaggttcagtggcagtggctttgggacagacttcactctcatcatcgacagactggagcccgaagatttgctagtgtattactgtcagtctgtttgtccctctcctctatgtactctttgcctaggttccaggtctggngtatcaagcgaacgtgtggctgcaccatccg

SEQ ID NO: 157844 - DNA, 519 bp, Homo sapiens
  misc_feature: GYAE6OF02FS0UK.24.78.H01.1.454.CMB.1.raw
  modified_base (241)..(241): a, c, t, g, unknown or other
  misc_feature (241)..(241): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaacccccagcgcagcttctcttcctcctgctactctggctcccagccatcaccggaggaattgtgttgacgcagtctccaggcaccctgtctttgtctccagggganagagccaccctctcctgcagggccagtcagagtgttagcagcagctacttagcctggtaccagcagaacctggcctggctcccaggctcctcatctatggtgcgtccaccagggccacgtggcgtcgcggacaggttcagtggcagtggctttgggacagacttcactctcatcatcgacagactggacgccgaagatttgctagtgttattactgtcagtcttgttcgtccctctcctcctatcgtactctttcggcctagggttccaggtctacgg

SEQ ID NO: 157845 - DNA, 536 bp, Homo sapiens
  misc_feature: GYAE6OF02GBBRU.24.78.H01.1.454.CMB.1.raw
  modified_base (335)..(335): a, c, t, g, unknown or other
  misc_feature (335)..(335): n is a, c, g, or t
  modified_base (531)..(531): a, c, t, g, unknown or other
  misc_feature (531)..(531): n is a, c, g, or t
tcagactactatgtcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgtctccaggggagagagccaccctctcctgcagggccagtcagagtgttagcagcagctacttagcctggtaccagcagaaacctggcctggctcccaggcctcctcatctatggtgcgtccaccgagggccacgtggcgtcgcggacnggttcagtggcagtggctttgggacaggtacttcacttctcatcatcgacagactggacgcccgaagtatttgctagttgttattactgtcagtctgtttcgtcctctcctccttatcgttactcgtttcgccgtacggttcctaggtcgtggtagtactacgaagcgtaacgtcggtcggctcggacctaccgtnttccg

SEQ ID NO: 157846 - DNA, 682 bp, Homo sapiens
  misc_feature: GYAE6OF02H7AZS.24.78.H01.1.454.CMB.1.raw
  modified_base (176)..(176): a, c, t, g, unknown or other
  misc_feature (176)..(176): n is a, c, g, or t
  modified_base (270)..(270): a, c, t, g, unknown or other
  misc_feature (270)..(270): n is a, c, g, or t
  modified_base (283)..(283): a, c, t, g, unknown or other
  misc_feature (283)..(283): n is a, c, g, or t
  modified_base (361)..(361): a, c, t, g, unknown or other
  misc_feature (361)..(361): n is a, c, g, or t
tcagactactatgtcacgaccggtgctcgattttagtgtgagtagttttggggtttggtcgacgaccggtgcgtccgagtttagtgtcgaggttagtttaggggtttggggagtacgcgttggcttcagtttagggacccagggacgggtaaccgatagggaaacccccagacganagcttctcttcctcctgctactctggctcccagccatcaccggaggaattgtgtgacgcagtctccaggcaccctgtctttgtctccgaggggnagacgccaccctntcctgccagggccagtcagagtgttagcagcagctacttagcctggtaccagcagaacctggctggctccagctcctnctctatggtgccgtccaccagggccactcgggccgtcggaccggactagggtttccaggttcggctaggtcggtcgttttgggactaggtaccttcactctctagttcacgttcgacacggactacgggacgtacccggtaagttaacgttttttcggccgtaaggttaggtttaactttacgtttacggttacgtaacgttcgtttcgggtttttccggttccccgtttcgttacccctttacctttaacgtttacgtttaccgttaccgttttttcgggacccgtttacggggtttaccctacgggtccgttaacgggg

SEQ ID NO: 157847 - DNA, 561 bp, Homo sapiens
  misc_feature: GYAE6OF02GMRGG.24.78.H01.1.454.CMB.1.raw
  modified_base (268)..(268): a, c, t, g, unknown or other
  misc_feature (268)..(268): n is a, c, g, or t
  modified_base (330)..(330): a, c, t, g, unknown or other
  misc_feature (330)..(330): n is a, c, g, or t
  modified_base (358)..(358): a, c, t, g, unknown or other
  misc_feature (358)..(358): n is a, c, g, or t
  modified_base (458)..(458): a, c, t, g, unknown or other
  misc_feature (458)..(458): n is a, c, g, or t
  modified_base (474)..(474): a, c, t, g, unknown or other
  misc_feature (474)..(474): n is a, c, g, or t
tcagactactatgtcacgaccggtgctcgatttagtgtgagtagtttgggtttgggggaggagcccagcactagaagtcggcggtgtttccattcggtgatcagcactgaacacagaggactcaccatggagtttgggctgagctgggttttcctcgtcgctcttttaagaggtgtccagtgtcaggggcagctggtggagtctgggggcgcgtggtccaaccgtgggagtccctgagactctcctgtgcggcctccgattcaccttnaatacttatggcatgcatgggtccgccaggctccaggcgaaggggctggaggtgggtgccgntatcttattgatggaatatcaatattangcagactcgtagaacgggtccgttcacatcaccagacgacaattccaaactaatactctagtttcagtacaaatgactacgcctgctatcgtagacgacncggtctgtctattacngtagacgaagacgttcccggtacctttacgttaacgtagtttaggttcggggtaccgtacccccgttagtacgtacggtacgtccgg

SEQ ID NO: 157848 - DNA, 524 bp, Homo sapiens
  misc_feature: GYAE6OF02FGV2Y.24.78.H01.1.454.CMB.1.raw
  modified_base (201)..(201): a, c, t, g, unknown or other
  misc_feature (201)..(201): n is a, c, g, or t
  modified_base (388)..(388): a, c, t, g, unknown or other
  misc_feature (388)..(388): n is a, c, g, or t
tcagactactatgtcacgaccggtgctcgatttagtgtgagtagtttgggtttggggagagctgctcagttaggacccagagggaaccatggaaaccccagcgcagcttctcttcctcctgctactctggctcccagataccactggagaagtagtcatgacgcagtctccagccaccctgtctgtgtctccaggggaaanagccaccctctcctgcagggccagtgagaatgtggcagcaacttagcctggtaccagcagaaacctggccaggctcccaggctcctcctctatgctgtctccaccagggcccctggtgtcccagccaggtttcgttgggcggtgggtctggggacagatttcactctcaccatcagcgcctcagtcngagatttgctactttatttctgtctaactactatggtgactggtcctccgtactacttttggccgtaggggacctaaacgtggagatacaaacgactgtggctgccacctatctgttcttctatccttcccgctac

SEQ ID NO: 157849 - DNA, 514 bp, Homo sapiens
  misc_feature: GYAE6OF02GNWKN.24.78.H01.1.454.CMB.1.raw
  modified_base (240)..(240): a, c, t, g, unknown or other
  misc_feature (240)..(240): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgtctccagggganagagccaccctctcctgcagggccagtcagagtgttagcagcagctacttagcctggtaccagcagaaacctggcctggctcccaggctcctcatctatggtgcgtccaccaggccactggcgtcgcggacaggttcagtggcagtggctttgggacagacttcactctcatcatcgacagactggagcccgaagatttgctagtgtattactgtcagctgttgtccctctcctcctattcgtactactttcggcctacgggttccaggtctgg

SEQ ID NO: 157850 - DNA, 523 bp, Homo sapiens
  misc_feature: GYAE6OF02GWG72.24.78.H01.1.454.CMB.1.raw
  modified_base (240)..(240): a, c, t, g, unknown or other
  misc_feature (240)..(240): n is a, c, g, or t
  modified_base (370)..(370): a, c, t, g, unknown or other
  misc_feature (370)..(370): n is a, c, g, or t
  modified_base (485)..(485): a, c, t, g, unknown or other
  misc_feature (485)..(485): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgtctccagggganagagccaccctctcctgcagggccagtcagagtgttagcagcagctacttagcctggtaccagcagaaacctggcctggctccagctcctcatctatggtgcgtccacagggccactggcgtcgcggacnggttcagtggcagtggcgtttgggacaggtacttcactctcatcatcgacagactggacgccgaagtactttgactagtgtattactgtcagtctgtttcgtccctctcctcctntcgtactacgtttcggcctacgggttcctaggctacgg

SEQ ID NO: 157851 - DNA, 526 bp, Homo sapiens
  misc_feature: GYAE6OF02IRIOP.24.78.H01.1.454.CMB.1.raw
tcagactactatgtcacgaccggtgctcgatttagtgtgagtagtttgggtttggggagagctgctcagttaggacccagagggaaccatggaaaccccagcgcagcttctcttcctcctgctactctggctcccagccatcaccggaggattgtgttgacgcagtctccaggcaccctgtctttgtctccaggggagagagccaccctctcctgcaggccagtcagagtgttagcagcagctactagcctggtaccagcagaaacctggcctggctccaggctcctcatctatggtgcgtccaccagggccacgtggcgtcgcggacaggttcagtggcagtggctttgggacagacttcactctcatcatcgacagactggacgcccgaagtatttgacctagtgttaattacgtgtcagtctgtttcgtccctcttctctatcgtactactttcggcctagggttccaggtcttagggatactcaacgcgtaacttggtcggtcgtcgaccgtacctagttcg

SEQ ID NO: 157852 - DNA, 501 bp, Homo sapiens
  misc_feature: GYAE6OF02JDONB.24.78.H01.1.454.CMB.1.raw
  modified_base (199)..(199): a, c, t, g, unknown or other
  misc_feature (199)..(199): n is a, c, g, or t
  modified_base (400)..(400): a, c, t, g, unknown or other
  misc_feature (400)..(400): n is a, c, g, or t
  modified_base (463)..(463): a, c, t, g, unknown or other
  misc_feature (463)..(463): n is a, c, g, or t
  modified_base (470)..(470): a, c, t, g, unknown or other
  misc_feature (470)..(470): n is a, c, g, or t
tcagactactatgtcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgtctccagggganagagccacctctcctgcagggccagtcagagtgttagcagcagctacttagcctggtaccagcagaaacctggcctggctcccaggctcctcatctatggtcgcgtccaccgagggccacgtggcgtcgcggacaggttcagtggcagtggctttgggacagacttcactctcatcatcgacagactggacgcccgaagtntttgctagtgtatttactgtcagtctgttgtcctctcctctatgtctcgtttcgctggttccngtctggngatcgaagtcgacgtgtcggctgctacatcg

SEQ ID NO: 157853 - DNA, 561 bp, Homo sapiens
  misc_feature: GYAE6OF02FKWC6.24.78.H01.1.454.CMB.1.raw
  modified_base (299)..(299): a, c, t, g, unknown or other
  misc_feature (299)..(299): n is a, c, g, or t
tcagactactatgtcacgaccggtgctcgatttagtgtgagtagtttgggtttggggagaggagcccagcactagaagtcggcggtgtttccattcggtgatcagcactgaacacagaggactcaccatggagtttgggctgagctgggttttcctcgtcgctcttttaagaggtgtccagtgtcaggggcagctggtggagtctgggggcggcgtggtccaacctgggaggtccctgagactctcctgtgcggcctcccgattccacctttcaatacttatggcatgcactgggtccnccaggctccaggcaaggggctggagtgggtgccgctatcttatttgatggaagtatcaatattatgacagactcgtagaacgggtcccgttacacctatcctccagacgacaacttcccaaactaatactctgtttactgtactaaattgactagcctgcgatctagacgacgacggtctgtctattacgtgtcgacgaagtcgttccccggtccttacgttacgtattacgttcgggtccgtcccctatacgtcggtaccg

SEQ ID NO: 157854 - DNA, 502 bp, Homo sapiens
  misc_feature: GYAE6OF02IB8D0.24.78.H01.1.454.CMB.1.raw
  modified_base (211)..(211): a, c, t, g, unknown or other
  misc_feature (211)..(211): n is a, c, g, or t
tcagactactatgtcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgtctccaggggagagagccaccctntcctgcagggccagtcagagtgttagcagcagctacttagcctggtaccagcagaaacctggcctggctcccaggctcctcatctatggtgcgtccaccagggccactggcgtcgcggacaggttcagtggcagtggctttgggacagacttcactctcatcatcgacagactggagcccgaagatttgctagtgtattactgtcagctgttggtccctctcctcctatgtactactttggcctagggttccaggtctggagatcaagtcgaactgtggctggcaccatcg

SEQ ID NO: 157855 - DNA, 512 bp, Homo sapiens
  misc_feature: GYAE6OF02F9MWG.24.78.H01.1.454.CMB.1.raw
  modified_base (241)..(241): a, c, t, g, unknown or other
  misc_feature (241)..(241): n is a, c, g, or t
  modified_base (253)..(253): a, c, t, g, unknown or other
  misc_feature (253)..(253): n is a, c, g, or t
  modified_base (339)..(339): a, c, t, g, unknown or other
  misc_feature (339)..(339): n is a, c, g, or t
  modified_base (372)..(372): a, c, t, g, unknown or other
  misc_feature (372)..(372): n is a, c, g, or t
  modified_base (408)..(408): a, c, t, g, unknown or other
  misc_feature (408)..(408): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgtctccaggggganagagccaccctntcctgcagggccagtcagagtgttagcagcagctacttagcctggtaccagcagaaacctggcctggctccaggctcctcatctanggtgcgtccacagggccactggcgtcgcggacnggttcagtggcagtggcttgggacagacttcactcncatcatcgacagactggagcccgaagattttgctagtgttattactgtcagcttgttgtcctctcctctatcgtactctttcggccgtagggttccaggtctgg

SEQ ID NO: 157856 - DNA, 530 bp, Homo sapiens
  misc_feature: GYAE6OF02FF59M.24.78.H01.1.454.CMB.1.raw
tcagactactatgtcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgtctccaggggagagagccaccctctcctgcagggccagtcagagtgttagcagcagctacttagcctggtaccagcagaaacctggcctggctcccaggctcctcatctatggtgcgtccacagggccacgtggcgtcgcggacaggttcagtggcagtggctttgggacagacttcactctcatcatcgacagactggacgcccgaagtatttgctagtgttattactgtcagtctgtttcgtccctctccttcttactcgttactacttttcggccgtacgggttccaggtcgtggtagtactcgaacgtcgaacgtggtcggtcgtgcctacctattccg

SEQ ID NO: 157857 - DNA, 545 bp, Homo sapiens
  misc_feature: GYAE6OF02F9HA7.24.78.H01.1.454.CMB.1.raw
  modified_base (332)..(332): a, c, t, g, unknown or other
  misc_feature (332)..(332): n is a, c, g, or t
tcagactactatgtcacgaccggtgctcgatttagtgtgagtagtttgggtttggggagaggagcccagcactagaagtcggcggtgtttccattcggtgatcagcactgaacacagaggactcaccatggagtttgggctgagctgggttttcctcgtcgctcttttaagaggtgtccagtgtcaggggcagctggtggagtctgggggcggcgtggtccaacctgggaggtccctgagactctcctgtgcggcctcccgattcaccttcaatacttatggcatgcactgggtccgccaggctccaggcaaggggctggagtgggtgccgntatcttattgatggaagtatcaatattatgcagactccgtgaagggtccgttcaccatctccagagacaattccaacaactactctgttctgacaatgactacgcctgcgtatcgtgagacacggcttgtacttattactgtgacgaagtcttccccggtaccttcgttacgtagttacgttcggggtccgtcccctagtacgtcggtaccgg

SEQ ID NO: 157858 - DNA, 531 bp, Homo sapiens
  misc_feature: GYAE6OF02GMP46.24.78.H01.1.454.CMB.1.raw
  modified_base (155)..(155): a, c, t, g, unknown or other
  misc_feature (155)..(155): n is a, c, g, or t
  modified_base (296)..(296): a, c, t, g, unknown or other
  misc_feature (296)..(296): n is a, c, g, or t
  modified_base (351)..(351): a, c, t, g, unknown or other
  misc_feature (351)..(351): n is a, c, g, or t
  modified_base (360)..(360): a, c, t, g, unknown or other
  misc_feature (360)..(360): n is a, c, g, or t
  modified_base (464)..(464): a, c, t, g, unknown or other
  misc_feature (464)..(464): n is a, c, g, or t
  modified_base (516)..(516): a, c, t, g, unknown or other
  misc_feature (516)..(516): n is a, c, g, or t
tcagactactatgtcacgaccggtgctcgatttagtgtgagtagtttgggtttgggggaggagcccagcactagaagtcggcggtgtttccattcggtgatcagcactgaacacagaggactcaccatggagtttgggctgagctgggttttccncgtcgctcttttaagaggtgtccagtgtcaggggcagctggtggagtctgggggcggcgtggtccaacctgggaggtccctgagactctcctgtgcggcctcccgattcaccttcaatacttatggcatgcactgggtccnccaggctccaggcaaggggctggagtgggtgccgctatcttattgatggaagtancaatattangcagactcgtgaagggccgttcacatctccagagacaattccaacaatactctgtttcagacaaatgactagcctgcgatctgagacacggctgtctattctgngacgaagtacgttccccggccttcgtacgtattagttcgggtcgacccctanacgtcggtacgtcgg

SEQ ID NO: 157859 - DNA, 544 bp, Homo sapiens
  misc_feature: GYAE6OF02FRHT2.24.78.H01.1.454.CMB.1.raw
  modified_base (240)..(240): a, c, t, g, unknown or other
  misc_feature (240)..(240): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgtctccagggganagagccaccctctcctgcagggccagtcagagtgttagcagcagctacttagcctggtaccagcagaaacctggcctggctcccaggcctcctcatctatggtgcgtccacgagggccactggcgtcgcgacaggttcaggtgcagtggctttgggacagacttcactctcatcatcgacagactggacgcccgtaagtacgttttgctagtgttattactgtcagtcttgtttcggtcccttctcccttcctagttcgtacttacgttttcggtcccgtacgggttcctacgggtcttacggg

SEQ ID NO: 157860 - DNA, 500 bp, Homo sapiens
  misc_feature: GYAE6OF02HOX5M.24.78.H01.1.454.CMB.1.raw
  modified_base (474)..(474): a, c, t, g, unknown or other
  misc_feature (474)..(474): n is a, c, g, or t
tcagactactatgtcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgtctccaggggagagagccaccctctcctgcagggccagtcagagtgttagcagcagctacttagcctggtaccagcagaaacctggcctggctcccaggctcctcatctatggtgcgtccaccagggccactggcgtcgcggacaggttcagtggcagtggctttgggacaggacttcactctcatcatcgacagactggagcccgaagatttgcagtgttattactgttcagtctgtttggtccctctcctctatgttactctttgcctaggttccaggctggagntcaagcgaacgtgtcggctgcacatc

SEQ ID NO: 157861 - DNA, 561 bp, Homo sapiens
  misc_feature: GYAE6OF02GP5T9.24.78.H01.1.454.CMB.1.raw
  modified_base (240)..(240): a, c, t, g, unknown or other
  misc_feature (240)..(240): n is a, c, g, or t
  modified_base (352)..(352): a, c, t, g, unknown or other
  misc_feature (352)..(352): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgtctccagggganagagccaccctctcctgcagggccagtcagagtgttagcagcagctacttagcctggtaccagcagaaacctggccaggctcccaggctcctctctatgctgtcctccaccncgggcccctggtcgtcccagccctaggttccgtggcgggttgggtcgtgggacgtagtagtttcactctcaccatcacgcggcctccacgtctagagtatttcgactacttttatttcttgtctaactactagtcgtgactgtccttaccgtactacctttcggccgtacgggtacctaacgtcggaagacgtacgaacgtacgtacgg

SEQ ID NO: 157862 - DNA, 495 bp, Homo sapiens
  misc_feature: GYAE6OF02GJ1BO.24.78.H01.1.454.CMB.1.raw
  modified_base (418)..(418): a, c, t, g, unknown or other
  misc_feature (418)..(418): n is a, c, g, or t
  modified_base (440)..(440): a, c, t, g, unknown or other
  misc_feature (440)..(440): n is a, c, g, or t
  modified_base (442)..(442): a, c, t, g, unknown or other
  misc_feature (442)..(442): n is a, c, g, or t
  modified_base (492)..(492): a, c, t, g, unknown or other
  misc_feature (492)..(492): n is a, c, g, or t
tcagactactatgtcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgtctccaggggagagagccaccctctcctgcagggccagtcagagtgttagcagcagctactagcctggtaccagcagaaacctggcctggctcccaggctcctcatctatggtgcgtccaccagggccactggcgtcgcggacaggttcagtggcagtggctttgggacagacttcactctcatcatcgacagactggacgcccgaagtatttgcagtgttattactgtcngtctgtttcgtcctctcctctntntactctttgctaggttcaggtctggagatcgagcgactgtggctcgcacntcg

SEQ ID NO: 157863 - DNA, 711 bp, Homo sapiens
  misc_feature: GYAE6OF02F9CWW.24.78.H01.1.454.CMB.1.raw
  modified_base (158)..(158): a, c, t, g, unknown or other
  misc_feature (158)..(158): n is a, c, g, or t
  modified_base (169)..(169): a, c, t, g, unknown or other
  misc_feature (169)..(169): n is a, c, g, or t
  modified_base (174)..(174): a, c, t, g, unknown or other
  misc_feature (174)..(174): n is a, c, g, or t
  modified_base (261)..(261): a, c, t, g, unknown or other
  misc_feature (261)..(261): n is a, c, g, or t
  modified_base (281)..(281): a, c, t, g, unknown or other
  misc_feature (281)..(281): n is a, c, g, or t
tcagactactatgtcacgaccggtgctcgatttagtgtgagtagtttgggtttgggggaggagcccagcactagaagtcggcggtgtttccattcggtgatcagcactgaacacagaggactcaccatggagtttgggctgagcggcgttcgcaggcncttaagtaggncagtntcaggcagctgtgagtctgggcgcgtggtcactgggagtccctgagactctcctgtcgcggcctccgattcacttcaatactttagngcagtcgacacgtcggtccnccgtaggcctaccgacggacggaacgggtacggtacggtacgggtcggggtcgggtccggtacgtacgttacgtttagtttacggtaacgttaaggtaaaggttaacgttaacgtaacgttaacgtttaagtacgtacgtacgtacgttaccggtacgggtaacgggtaccggttaccgtaccgtacgtaccgtaccgacgaacgtaacgtaacgttaacctaaactaaacttaccttacgttacgtttacgtacgtactaacgtacgtacgtacgtacgtacgtacgtacgtacgtacgtacgacgtacggtacgttacgttacttacttacgttacgtacgacgtaacgtaccgttcccgttacccgttaccgttacgttacgttacggttacggtaccggtacccgtacgtacgtacggtacgtcgg

SEQ ID NO: 157864 - DNA, 616 bp, Homo sapiens
  misc_feature: GYAE6OF02IC5AG.24.78.H01.1.454.CMB.1.raw
  modified_base (364)..(364): a, c, t, g, unknown or other
  misc_feature (364)..(364): n is a, c, g, or t
  modified_base (419)..(419): a, c, t, g, unknown or other
  misc_feature (419)..(419): n is a, c, g, or t
tcagactactatgtcacgaccggtgctcgatttagtgtgagtagtttgggtttggggagaggagcccagcactagaagtcggcggtgtttccattcggtgatcagcactgaacacagaggactcaccatggagtttgggctgagctgggttttcctcgtcgctcttttaagaggtgtccagtgtcaggggcagctggtggagtcgtgggggcggcgtggtccaaccgtgggaggtccctggagactctctgtcgcggcctccgattcaccttcaatacttatggcatgcactgggtccgcaggctccgaggcaaggggctggagtgggtggccgctatcttattgatggaataatcaatattangcagctcgtagaacgggtccgttacacctatcctccagacgactaactaccaaanaactactactgtttactagactaaatcgtactagacctgtactactcgtgacggaccacggtcttcgtacttacgttacgtaggtacgtaacggtaaacgtccgtttacccccgggtacctttaccgttaacgtacgttttaacgggttcgggggttacccggtacccccgttaacgtacggttcgggtaacccggg

SEQ ID NO: 157865 - DNA, 493 bp, Homo sapiens
  misc_feature: GYAE6OF02FQAU1.24.78.H01.1.454.CMB.1.raw
  modified_base (442)..(442): a, c, t, g, unknown or other
  misc_feature (442)..(442): n is a, c, g, or t
  modified_base (491)..(491): a, c, t, g, unknown or other
  misc_feature (491)..(491): n is a, c, g, or t
tcagactactatgtcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgtctccaggggagagagccaccctctcctgcagggccagtcagagtgttagcagcagctacttagcctggtaccagcagaaacctggcctggctcccaggctcctcatctatggtgcgtccaccagggccactggcgtcgcggacaggttcagtggcagtggctttgggacagacttcactctcatcatcgacagactggagcccgaagtatttgctagtgttattactgtcagctgttcgtccctctcctctatntactctttgctaggttccagtctggagatcaagcgagtgtggctgcacntc

SEQ ID NO: 157866 - DNA, 607 bp, Homo sapiens
  misc_feature: GYAE6OF02JOG4F.24.78.H01.1.454.CMB.1.raw
  modified_base (239)..(239): a, c, t, g, unknown or other
  misc_feature (239)..(239): n is a, c, g, or t
  modified_base (347)..(347): a, c, t, g, unknown or other
  misc_feature (347)..(347): n is a, c, g, or t
  modified_base (362)..(362): a, c, t, g, unknown or other
  misc_feature (362)..(362): n is a, c, g, or t
tcagactactatgtcacgaccggtgctcgatttagtgtgagtagtttgggtttggtcacgaccggtgctcgatttagtgtgagtagtttgggtttgggagagctgctcagttaggacccagagggaaccatggaaacccccagcgcagcttctcttcctcctgctactctggctcccagccatcaccggaggaattgtgttgacgcagtctccaggcacctgtcttgactccagggganagagcccaccctctcctagcagggccagtcagagtgttagcagcagctacttagcctggtaccaggcacgaaacctggcctaggcctcccaggctcgatccatctagnggtcgcgtccaccgngggccacgtggcgtcgcgacgaggttccaggtcggacgtaggtcggtcgtttgggacgtaggtaccgttcgacttctacgtacttacgtactacgacctagactacgggacgacccgaacggttaacttttgaccttagttacgttaacttacgtagttactacgtcttggtttccgtacccttcttccgtcttacgttagttaccttacggtttcgtaccgtacgggttaccgtcggttaccgg

SEQ ID NO: 157867 - DNA, 267 bp, Homo sapiens
  misc_feature: GYAE6OF02GP0U0.24.78.H01.1.454.CMB.1.raw
  modified_base (259)..(267): a, c, t, g, unknown or other
  misc_feature (259)..(267): n is a, c, g, or t
tcagactactatgtcacgaccggtgctcgatttagtgtgagtagttgggtttgggacagacttcactctcatcatcgacagactggagcccgaagattttgcagtgtattactgtcagctgtttggtccctcgtcctcctatgtacacttttggccagggttccaggctggagatcaagcgaactgtggctgcaccatctgtcttcatcttcccgccatctgaacatagtagtctgagcgggctggcaaggcgcatagnnnnnnnnn

SEQ ID NO: 157868 - DNA, 684 bp, Homo sapiens
  misc_feature: GYAE6OF02GKZIE.24.78.H01.1.454.CMB.1.raw
tcagactactatgtcacgaccggtgctcgatttagtgtgagtagtttgggtttggggagaggagcccagcactagaagtcggcggtgtttccattcggtgatcagcactgaacacagaggactcaccatggagtttgggctgagctgggttttcctcgtcgctcttttaagaggtgtccagtgtcaggggcagctggtggagtctggggggcggcgtggtccaacctgggaggtccctgagactctcctgtgcggcctcccgattcaccttcaatacttatggcatgcactgggtccgccaggctccaggcaaggggctggagtgggtggccgctatcttattgatggaagtaatcaatattatgcagactccggtgaacggggtcccggttacaccctattcctccaaggacgaacaacgtttacccaaacgtaaacttaccttccgttcgttttacctacggtactaaacgttcgaactacgccctagcgtaattccgtaggaacggaccgaaccgggtccttaggttaccttaacgttttaaccgtggttacgtaaccggtaaaacggttacccgtttacccccccgggttccccttttaccgtttaaccgtttacgtttaacggtttcggggggttacccggtaccccccctttaacggtaccgttacggggtacccggg

SEQ ID NO: 157869 - DNA, 575 bp, Homo sapiens
  misc_feature: GYAE6OF02ID7EW.24.78.H01.1.454.CMB.1.raw
  modified_base (241)..(241): a, c, t, g, unknown or other
  misc_feature (241)..(241): n is a, c, g, or t
  modified_base (302)..(302): a, c, t, g, unknown or other
  misc_feature (302)..(302): n is a, c, g, or t
  modified_base (396)..(396): a, c, t, g, unknown or other
  misc_feature (396)..(396): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggctcccagatgccaccggagaccatttgtgttgacacagtctccagccacctgtctttgctcaggggaaangccacctctcctgcagggccagtgacaatgttaggaagttgtagctggtatcaacacaaanatcggaccaggcctccccggctcctcatctatgatgcataccaagtacggccatcggacacgtcccagaactaggttcaggtgcaggtggtcgngggacacgtacttcgactctacaccgatccgtagctagttagtacgactaccgtagaagttagtttgaccttagtttacttactcgtacacgtacacgttacgacctacgtccggccttaccgttccggtacccgtacggtaccgacgtaccgttacggaccttaccgaccctaaacgg

SEQ ID NO: 157870 - DNA, 562 bp, Homo sapiens
  misc_feature: GYAE6OF02IFPHE.24.78.H01.1.454.CMB.1.raw
  modified_base (236)..(236): a, c, t, g, unknown or other
  misc_feature (236)..(236): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggctcccagccatcaccggaggattgtgttgacgcagtctccaggcacctgtctttgctccaggggnagagccaccctctcctgcagggccagtcagagtgttagcagcagctacttagcctggtaccagcagaaacctggcctggcctcccaggcctcctcatctagtggtgccgtccaccgagggcccacgtcgggcgtcgacggactagggttcaggtggcaggtggtcgtttgggactagacttcactctcatcatcgacacgacgtggacgccgtaagtacgttttcgcgtagttgttacttacgtgtctagtcgttgtttcggttccctcttcccttcttattcgtacttcgttttcggccgtacgggttccgtacggtcgtacggg

SEQ ID NO: 157871 - DNA, 549 bp, Homo sapiens
  misc_feature: GYAE6OF02GSTKW.24.78.H01.1.454.CMB.1.raw
  modified_base (240)..(240): a, c, t, g, unknown or other
  misc_feature (240)..(240): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgtctccagggganagagccaccctctcctgcagggccagtcagagtgttagcagcagctacttagcctggtaccagcagaaacctggcctggctcccaggcctcctcatctatggtgccgtccaccgaggccacgtggcgtcgcggacaggttcagtggcagtggtcgtttgggacagacttcactctcatcactcgacagacgtggacgaccgaagtacgtttgctagttgttacttacgtgtctagtcgttcgtttcggtcccttcttccttcctattcgttacgttacgtttcggccgtacgggttcctaggtctacgg

SEQ ID NO: 157872 - DNA, 650 bp, Homo sapiens
  misc_feature: GYAE6OF02JMY9M.24.78.H01.1.454.CMB.1.raw
  modified_base (383)..(383): a, c, t, g, unknown or other
  misc_feature (383)..(383): n is a, c, g, or t
  modified_base (515)..(515): a, c, t, g, unknown or other
  misc_feature (515)..(515): n is a, c, g, or t
tcagactactatgtcacgaccggtgctcgatttagtgtgagtagtttgggtttggggagaggagcccagcactagaagtcggcggtgtttccattcggtgatcagcactgaacacagaggactcaccatggagtttgggccgagctgggtttcctcgtcgctcttttaagaggtgtccagtgtcaggggcagctggtggagtcgtgggggcggcgtggtccaaccgtgggaggtcctgagactctcctgtgcggcctcccgattcaccttcaatacttatggcatgcactcgggtccgccaggctccaggcgaacggggctggaggtggggtggcccggctagttctttaagtttggatagggaaagtaatctaattattagngcagtacctcggtaggaacggtccggtcacctacgtcaccagacgaactaacttaccaaactaatactcgttacgtttacacgtacaaacttgaactacgccgttagcgtaactcgtagacggacaccggtnttagtccttaagttctggtacgtaccgaaacggttccgtttaccccccgggtacctttacggttaccgttaaggtttacgtttcggggggtccgtaccccccgttaagacggttaccggggtaccgttaccgggg

SEQ ID NO: 157873 - DNA, 644 bp, Homo sapiens
  misc_feature: GYAE6OF02J2LQB.24.78.H01.1.454.CMB.1.raw
  modified_base (245)..(245): a, c, t, g, unknown or other
  misc_feature (245)..(245): n is a, c, g, or t
  modified_base (309)..(309): a, c, t, g, unknown or other
  misc_feature (309)..(309): n is a, c, g, or t
  modified_base (367)..(367): a, c, t, g, unknown or other
  misc_feature (367)..(367): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgcttactctggcctcccagccatcaccggaggaattgtgttgacgcagtctccaggccacccgtgtctttgtctccgagggganagacgcccacccttctcctgcgacgggccagtcagagtgttagcagcagctactagctggaccngcaagaacctggcctggctcccgaggtcctcctcatctagttggcgccgtcccgacgngggccctacggtcggccgtcggccgggtaacctagggtttccgaagggttcgggaccggtacggttcgggttccggttttaggggaccgtacggtaccttaccgtacgttccgtactacgtctacgtcgacgacgacgtaggaccgtaccggtagtacgtttcgacgtagttcgttacttacgttgtactgtcgttgtttccgtcccgttccttccgtacttacgttcgttaccttacgtttcggaccgttaccgggttccgtacggtccgtacggg

SEQ ID NO: 157874 - DNA, 829 bp, Homo sapiens
  misc_feature: GYAE6OF02F3IXE.24.78.H01.1.454.CMB.1.raw
  modified_base (269)..(269): a, c, t, g, unknown or other
  misc_feature (269)..(269): n is a, c, g, or t
  modified_base (375)..(375): a, c, t, g, unknown or other
  misc_feature (375)..(375): n is a, c, g, or t
tcagactactatgtcacgaccggtgctcgatttagtgtgagtagtttgggtttggggaggggagcccagcactagaagtcggcggtgtttccattcggtgatcagcactgaacacagaggactcaccatggagtttgggtctgagcgtggtttcgtcgtacggctctttaagtaggtgtccagtgtcaggggcagctggtggagtcgtgggggcggcgtggtccaaccgtgggaggtccctgagactcctcctgtgcggcctccgactntacctcaactacttatggctatgcacgtgggtccgccaggcgtcccagggccgtaagggggcgttacgggaggtgggggtcgggcccgtccgttatttaccgtttnttttaggaaggttacgggaaaaggtttaaaattcctaaaattattttaatcggtaccaacggtaaccgttcccggttaggggtaacgggggtacccccgggtttacctaaaccccgacgtttacccgttcccgaaacggaacggtaaccctaaactttaacccgtaaaacctaaacttaacctttccgtttacgttttcgttacggtaacctaaaagttcggtaaccttaacggccccttacggtaccgtacgttccgtaacgggagggtaacccgtaaccggtccgtttagttaacccttaagttttacgtcggttagaacccgggttaaagtaccccggtttacccccggtacccccgtttttattacccggttaaacgtttcggggttttaccggggtaccccggtttacccccgtaccggtacggtttaccgggtaccggttaaccgggg

SEQ ID NO: 157875 - DNA, 519 bp, Homo sapiens
  misc_feature: GYAE6OF02GVJHI.24.78.H01.1.454.CMB.1.raw
tcagactactatgtcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgtctccaggggagagagccaccctctcctgcagggccagtcagagtgttagcagcagctacttagcctggtaccagcagaaacctggcctggctccaggctcctcatctatggtgcgtccacagggccactggcgtcgcggacaggttcagtggcagtggctttgggacagacttcactctcatcatcgacagactggagcccgaagtactttgctagtgtattactgtcagtctgtttcggtccctctcctcctatcgtactacgtttgcctaggttccaggtctgggatagtacgaacgtcgtaacgtcggtggcgtcgactaccgtatcg

SEQ ID NO: 157876 - DNA, 568 bp, Homo sapiens
  misc_feature: GYAE6OF02HAOIZ.24.78.H01.1.454.CMB.1.raw
tcagactactatgtcacgaccggtgctcgatttagtgtgagtagtttgggtttggggagaggagcccagcactagaagtcggcggtgtttccattcggtgatcagcactgaacacagaggactcaccatggagtttgggctgagctgggttttcctcgtcgctcttttaagaggtgtccagtgtcaggggcagctggtggagtctgggggcggcgtggtccaacctgggaggtccctgagactctcctgtgcggcctcccgattcaccttcaatacttatggcatgcactgggtccgccaggcctccgaggcaagggggctgggagtggggtggccgctatcttattgatggaagtaatcaatattatgcagtacgtccgtagaaggggtcccggttacaccgatcctccagacgacaattccaaacaactactcttgtttctgactaaatgactagcctgcgatctgaggacgacggctgtactattactgtgacgaacgtcttccccggtccttaccttacgtatttacgttcggggttccggccccctacgtacgtgggtaccgg

SEQ ID NO: 157877 - DNA, 575 bp, Homo sapiens
  misc_feature: GYAE6OF02GK6B2.24.78.H01.1.454.CMB.1.raw
  modified_base (240)..(240): a, c, t, g, unknown or other
  misc_feature (240)..(240): n is a, c, g, or t
  modified_base (344)..(344): a, c, t, g, unknown or other
  misc_feature (344)..(344): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgtctccagggganagacgccaccctctcctgcaggaccagtcagagtgtagcagcagctacttagcctggtaccagcaagaacctggcctggctccaggcctcctcatctagtggtncgtccacgacgggccacgtggcgtcgcggactgggttcaggtgcgaggtggtcgtttgggactagacttcactctcatcactacgacagacgtcggacgacccgaagtacgttttcgacgtagttcgttattacgtgtacgtagtcgttcgttcgtcccgttcttcccttccttacgttacgttacgttacgttttcggaccgttacgggttcccgtacggtcgttacggg

SEQ ID NO: 157878 - DNA, 702 bp, Homo sapiens
  misc_feature: GYAE6OF02IUVGZ.24.78.H01.1.454.CMB.1.raw
  modified_base (480)..(480): a, c, t, g, unknown or other
  misc_feature (480)..(480): n is a, c, g, or t
tcagactactatgtcacgaccggtgctcgatttagtgtgagtagtttgggttttgggggagaggctggctccagttaggacccagagggaaccgagtggtaaaccccagtcggcagcttctcttcctcctagctacgtcgtggctacccagccgagttcgaccggaggaattggttcgttgacggctagtttacgtcgaggtccacccgttgtcctttagtcctccaaggggagaggacgtccctacccgggtcgtccgtggccgagggccctagggtccgagagtgttaagcctagtcgagctacttagcccgttggtaccgagaccgtaagaaaaccgttggacccgtggactccccgaggccttccgtccaattcacgtcggtagcccgtaccgacgtacgggcctacggtcggccgttcgggtacgtacaaggtttcaggtcgggctaggtcggtctttagggacagtactctacnccttcgagtccacgtacgacgacgtactcggtacgaccgtaagtactttacgacgtagtactaacgttacgttgtcgtagtcgtggtttcgtaccttactccctacgttacgttacgtacgttaccgttcggtaccgtacgttaccgtacgtcgtaacgggacggtaacggagaacggtacggtaacgtcggtacggtacttaccggactaccgtagtccgg

SEQ ID NO: 157879 - DNA, 587 bp, Homo sapiens
  misc_feature: GYAE6OF02HNSJM.24.78.H01.1.454.CMB.1.raw
  modified_base (203)..(203): a, c, t, g, unknown or other
  misc_feature (203)..(203): n is a, c, g, or t
tcagactactatgtcacgaccggtgctcgatttagtgtgagtagtttggggtttgggggagagctgctcagttaggacccagagggaaccatggaaaccccagcgcagcttctcttcctcctgctactctggctcccagataccactggagaagtagtcatgacgcagtctccagccaccctgtctgtgtctccaggggaaangccaccctctcctgcagggccagtgagaatgttggcagcaacttagcctggtaccagcaagaaacctggccaggcctcccgaggcctcctcctctatcgctcgtcctcccaccgacgggccccttgggtcgtcccagccgtaggtttcggtcgggcgggttgggtcgtggggactaggtactttcacttctcacctatcgagccggcctccgagtctagtaagttatttcgtacttacttttactttctacgtactaactacttagtggtgtacgtcggtccttcgtacttacgtttcggaccgtacgggtaacctaacgtggacgaacgtacgaacgacgtgtacggctcgactactattctcgtctctacttcctccgctac

SEQ ID NO: 157880 - DNA, 257 bp, Homo sapiens
  misc_feature: GYAE6OF02FX0SV.24.78.H01.1.454.CMB.1.raw
  modified_base (257)..(257): a, c, t, g, unknown or other
  misc_feature (257)..(257): n is a, c, g, or t
tcagactactatgtcacgaccggtgctcgatttagtgtgagtagttgggtttgggacagacttcactctcatcatcgacagactggagcccgaagattttgcagtgtattactgtcagctgtttggtccctctcctcctatgtacacttttggccagggttccaggctggagatcaagcgaactgtggctgcaccatctgtcttcatcttcccgcatctgaacatagtagtctgagcgggctggcaaggcgcatagn

SEQ ID NO: 157881 - DNA, 566 bp, Homo sapiens
  misc_feature: GYAE6OF02HOAU5.24.78.H01.1.454.CMB.1.raw
  modified_base (315)..(315): a, c, t, g, unknown or other
  misc_feature (315)..(315): n is a, c, g, or t
tcagactactatgtcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgtctccaggggagagacgccacctctcctgcagggccagtcagagtgttagcagcagctactagcctggtaccagcagaaacctggcctggctcccgaggctcctacatctatcggtcgccgtccaccngggccctacgtggccgttcggcggaacgtacggttcaggtgggacctaggtgggtctttggggacagggtacttgactcgtcatcatcgacagaactggaacgccggaagtactttgactagtcttattcaggtccagtctggtttcgtcccgtctccgtctatcgttactacgtttggaccctagggttcaggtcctagggacgttatcggaacgttcgaacttggcggtacctggtacaccgtagtccg

SEQ ID NO: 157882 - DNA, 588 bp, Homo sapiens
  misc_feature: GYAE6OF02IBH1P.24.78.H01.1.454.CMB.1.raw
  modified_base (200)..(200): a, c, t, g, unknown or other
  misc_feature (200)..(200): n is a, c, g, or t
  modified_base (261)..(261): a, c, t, g, unknown or other
  misc_feature (261)..(261): n is a, c, g, or t
tcagactactatgtcacgaccggtgctcgatttagtgtgagtagtttgggtttggggaggaactgctcagttaggacccagagggaaccatggaagccccagctcagcttctcttcctcctgctactctggctcccagagaccaccggagaaattgtgttgacacagtctccaggcaccctgtctttgtctccagggganagagccaccctctcctgcagggccagccggagtgttagtaagtacttaggctggtaccaanagaaacctggccaggctcccaggctctcatctatgatgtctccaacagggtccacgtggccgtcccccgcgtaggttcaggtggcaggtgggtctggggactaggactttcgacttctacgaccgtcagccagccctagagccctgaaacgtagtttttcggacggttttactacgttgtcagctagtcgttccgccgtggccgtacttaacgtttcgggcgggggtactagggtgggagagggagacgaacgtggtggctagcaccgtatcgtgttcttcgactttcccgttcccgacctagttccgtaggaactacgttagtacg

SEQ ID NO: 157883 - DNA, 557 bp, Homo sapiens
  misc_feature: GYAE6OF02HQ2J0.24.78.H01.1.454.CMB.1.raw
  modified_base (241)..(241): a, c, t, g, unknown or other
  misc_feature (241)..(241): n is a, c, g, or t
tcagactactatgtcacgaccggtgctcgatttagtgtgagtagtttgggtttggtacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgtctccaggggganagagccaccctctcctgcagggccagtcagagtgttagcagcagctacttagcctggtaccagcagaaacctggcctggcctcccgaggcctcctcatctatggtgccgtcccaccgacgggcctacgtcggcgtcggcggacgtaggttcaggtcgggcgtaggtggtcgtttgggactagacttcactctcatcatcgacagactgggacgacccgaagtactttgcgtagtgtattacgtgtcagtcttgtttcgtcctcgtccttcttagtcgttacttcgtttcggccgtaggttccgtggtcgtggtacg

SEQ ID NO: 157884 - DNA, 738 bp, Homo sapiens
  misc_feature: GYAE6OF02JFKI7.24.78.H01.1.454.CMB.1.raw
  modified_base (300)..(300): a, c, t, g, unknown or other
  misc_feature (300)..(300): n is a, c, g, or t
tcagactactatgtcacgaccggtgctcgatttagtgtgagtagtttgggtttggggagaggagcccagcactagaagtcggcggtgtttccattcggtgatcagcactgaacacagaggactcaccatggagtttgggctgagctgggttttcctcgtcgctcttttaagaggtgtccagtgtcaggggcagctggtggagtcgtgggggcggcgtggtccaaccgtgggaggtccctgagactctcctgtgccggcctccgattcaccttcaatacttatggcatgcacgtgggtccnccaggcctccgagggcgaagggggtctgggaggtggggtcggcccgcttaattctttagtttggagttacgggaaagttaatactaaagttattaagtcgacaagtacctaccggtaggaaacggggtcccggttaccaaccctattcccgtacccgaacggtacgtaaacctaacttacccaaactaaacttaccttacgtttacgttttctacggtaactaaacgttcgtaaccgtacgtacccgtacggtaccgtagttccgttacggaacggtaaccgttacgggtaccgtttcgttaactttacgttacgttacgttacgaaccggtaaacggttcccgttacccccggttaccctttaccgtttaacgttaacgttttacgggttccggggttacccggtacccccttacggtaccggttacggtacccggg

SEQ ID NO: 157885 - DNA, 548 bp, Homo sapiens
  misc_feature: GYAE6OF02I3TC9.24.78.H01.1.454.CMB.1.raw
  modified_base (240)..(240): a, c, t, g, unknown or other
  misc_feature (240)..(240): n is a, c, g, or t
  modified_base (341)..(341): a, c, t, g, unknown or other
  misc_feature (341)..(341): n is a, c, g, or t
  modified_base (372)..(372): a, c, t, g, unknown or other
  misc_feature (372)..(372): n is a, c, g, or t
  modified_base (477)..(477): a, c, t, g, unknown or other
  misc_feature (477)..(477): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgtctccagggganagagccacctctcctgcagggccagtcagagtgttagcagcagctactagcctggtaccagcagaacctggcctggctccaggcctcctcatctatggtcncgtccaccaggggccactggcgtcgcggacnggttcagtgcagtggctttgggacagacttcactctcatcatcgacagactgggacacccggaagtgttttacgactacggtagttagtttactggttaccagtnttgtttggtcccttctcccttcctattcgttactaccttttcgggacctgggtttcccacgggtctacggg

SEQ ID NO: 157886 - DNA, 583 bp, Homo sapiens
  misc_feature: GYAE6OF02GLED4.24.78.H01.1.454.CMB.1.raw
  modified_base (175)..(175): a, c, t, g, unknown or other
  misc_feature (175)..(175): n is a, c, g, or t
  modified_base (244)..(244): a, c, t, g, unknown or other
  misc_feature (244)..(244): n is a, c, g, or t
  modified_base (293)..(293): a, c, t, g, unknown or other
  misc_feature (293)..(293): n is a, c, g, or t
  modified_base (329)..(329): a, c, t, g, unknown or other
  misc_feature (329)..(329): n is a, c, g, or t
  modified_base (348)..(348): a, c, t, g, unknown or other
  misc_feature (348)..(348): n is a, c, g, or t
  modified_base (357)..(357): a, c, t, g, unknown or other
  misc_feature (357)..(357): n is a, c, g, or t
tcagactactatgtcacgaccggtgctcgatttagtgtgagtagtttgggtttggggagaggagcccagcactagaagtcggcggtgtttccattcggtgatcagcactgaacacagaggactcaccatggagtttgggctgagcggtggtttcgcgtaggctctttaagaggtntcagtgtcaggggcagctggtggagtctgggggcgcgtggtccaacctgggaggtccctgagactctcngtgcggcctccgattcaccttcaatacttatggcatcgcacgtgggccnccaggcctccaggcaaggggctggagtgggtgccgntatcttattgatggaatancaatattangcagtacgtcgtagacgggtccgtacacctactcctacgagacgactaactaccaaactactacttcttacgttctagtactaagtcgaacgtacgtcctgacgtatcgtagacgacgtcgtcttgttacttattacgtgtacgtaacgaacgttacccgtccccgtaccttaccgttaacgtacgtttacgggttcgggtacccgtaccctagtacgtcggtacg

SEQ ID NO: 157887 - DNA, 537 bp, Homo sapiens
  misc_feature: GYAE6OF02G2HFD.24.78.H01.1.454.CMB.1.raw
  modified_base (199)..(199): a, c, t, g, unknown or other
  misc_feature (199)..(199): n is a, c, g, or t
tcagactactatgtcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgtctccagggganagagccaccctctcctgcagggccagtcagagtgttagcagcagctacttagcctggtaccagcagaaacctggcctggctcccaggctcctcatctatggtgcgtccaccagggccactggcgtcgcggacaggttcagtggcagtggctttgggacaggacttcactctcatcatcgacagactggagcccgaagtactttgctagtgttattacgtgtcagtctgtttcggtcccttcgtcctccttattcgttactacttttcggcctagggttccagggtcgtggtacgtagtacgaaggtccgtaacgtgtcggcgtcgacgtacctattcg

SEQ ID NO: 157888 - DNA, 647 bp, Homo sapiens
  misc_feature: GYAE6OF02HAYPC.24.78.H01.1.454.CMB.1.raw
  modified_base (343)..(343): a, c, t, g, unknown or other
  misc_feature (343)..(343): n is a, c, g, or t
tcagactactatgtcacgaccggtgctcgatttagtgtgagtagtttgggtttggggagaggagcccagcactagaagtcggcggtgtttccattcggtgatcagcactgaacacagaggactcaccatggagtttgggctgagctgggttttcctcgtcgctcttttaagaggtgtccagtgtcaggggcagctgggtggagtcgtgggggcggcgtgggtcccaaccgtggggaggtccctgagactctcctgtgcggccctcccgattcaccttcaatacttatggcatgcactcgggtccgccaggctccgaggcaaggggctggagtgggtcggccgnttatcttatttgagtggaaatatctaaatattatgcaagcgtccgtggaaacggtccggtttacacctatcctaccagaacgaactaacttccaaactaatacttcgttatttcagacctaaattcgaacttcgccttgacgtatcgtaggacggtaccgacgggtcttcggttacttacgtttaactgggttgaaccggtaaaacggttcccgtttacccccccgggtaccttttacgtttaaccggaatttttaccgggcgggggttaccccctacccccgtaacggtagtccggggtaccg

SEQ ID NO: 157889 - DNA, 553 bp, Homo sapiens
  misc_feature: GYAE6OF02GICKK.24.78.H01.1.454.CMB.1.raw
  modified_base (240)..(240): a, c, t, g, unknown or other
  misc_feature (240)..(240): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgtctccagggganagacgccaccctctcctgcagggccagtcagagtgtagcagcagctacttagcctggtaccagcagaaacctggcctggcctcccaggcctcctcatctatggtcgccgtccaccgacgggccacgtcggccgtcgcggacaggttcaggtggcgagtcggtcgtttgggactagtacttcactctcatcactcgacacgacgtcggacgaccgtaagtacgtttgactagtagttattactgtacagtcgttcgttcgtccttctccttctattcgtactacgtttcggaccgtacggttccaggtctacgg

SEQ ID NO: 157890 - DNA, 555 bp, Homo sapiens
  misc_feature: GYAE6OF02HC6MO.24.78.H01.1.454.CMB.1.raw
  modified_base (239)..(239): a, c, t, g, unknown or other
  misc_feature (239)..(239): n is a, c, g, or t
  modified_base (398)..(398): a, c, t, g, unknown or other
  misc_feature (398)..(398): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgctccagggganagagccaccctctcctgcagggccagtcagagtgttagcagcagctactagcctggtaccagcagaacctgcctggctcccaggctcctcatctatggtcgcgtccaccagggccacgtggccgtcgcggacaggttcagtggcagtggctttgggacngacttcactctcatcatcgacagactggagcccgagtatttcgactagttgtatttacgtcgtcgtacgtcgttcgtttcggttcccttcgttccttccttacttcgtaccttaccgttttcggacccgtagggtttcccgtagggtccgttacggg

SEQ ID NO: 157891 - DNA, 582 bp, Homo sapiens
  misc_feature: GYAE6OF02HYRO4.24.78.H01.1.454.CMB.1.raw
  modified_base (449)..(449): a, c, t, g, unknown or other
  misc_feature (449)..(449): n is a, c, g, or t
tcagactactatgtcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgtctccgaggggagagagcccaccctctcctgcagggccagtcagagtgttagcagcagctacttagcctggtaccagcaagaaacctggcctggctccgaggctcctcatctagtggtgccgtccaccgacggccacgtggcgtcggcggacgtaggttcaggtggcgtaggtggtcgtttgggactaggtacttcactctcactcatcgacagcgtaggacgaccgtaagtatttcgacgtagttattatttacgtgttanagttcgtagtttcggtcccttcttccgtcttattcgttacttacgtttcggccgttacgggttcctaggtcgtggacgtactacgaacgtacgtaacgttcggtacggtccgtcgacctaccgtacgtttacg

SEQ ID NO: 157892 - DNA, 732 bp, Homo sapiens
  misc_feature: GYAE6OF02I1JM3.24.78.H01.1.454.CMB.1.raw
  modified_base (200)..(200): a, c, t, g, unknown or other
  misc_feature (200)..(200): n is a, c, g, or t
  modified_base (262)..(262): a, c, t, g, unknown or other
  misc_feature (262)..(262): n is a, c, g, or t
tcagactactatgtcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgtctccaggggaanagccacctctcctgcagggccatgcaatagttaggtaagtagttgtactcgtagtacaaccnaacaacaactacgacgacgtaccgcccgtccgtcctcctactactactagtagtacgtacgtactacgtaacgtaacggtaccgtaccgtacgtacgactaccgtaccgtaacgtacgtacgtacgtacggtacgtacggtacgggttcggtacggtacggtacgtacgtacgtacctactacctacctactacgtacgtacgtacgtagtacgtacgtacgtacgtaagttagtttagtttagtttagtttacgttacgttacgtacgtacacggtcgtaaccgtactgggaccctaaccgttttacgggtaccccgttacgggttaaccctagggtacccgttacggggtaacccgtaacgtaccctaacggtaaaccgtacggttaccgggtaaccgttaacggtaccgtacccggtacgttaccgttaccgttacccgtttaccgttaccgttaccgtttaccccg

SEQ ID NO: 157893 - DNA, 525 bp, Homo sapiens
  misc_feature: GYAE6OF02GFYCF.24.78.H01.1.454.CMB.1.raw
  modified_base (240)..(240): a, c, t, g, unknown or other
  misc_feature (240)..(240): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaacccccagcgcagcttctcttcctcctgctactctggctcccagccatcaccggaggaattgtgttgacgcagtctccaggcacctgtctttgtctccagggganagagccaccctctcctgcagggccagtcagagtgttagcagcagctacttagcctggtaccagcagaaacctggcctggctcccaggctcctcatctatggtgccgtccacgagggccacgtggcgtcgcggacagggttcagtggcagtggcgtttgggacagacttcacctctcatcatcgacagactggacgccgaagtactttgctagtgtacttactgtcagtcttgttcgtcctctcctctattcgtacttactttcggccgtaggtcctaggtctagg

SEQ ID NO: 157894 - DNA, 586 bp, Homo sapiens
  misc_feature: GYAE6OF02IQDH0.24.78.H01.1.454.CMB.1.raw
  modified_base (198)..(198): a, c, t, g, unknown or other
  misc_feature (198)..(198): n is a, c, g, or t
  modified_base (245)..(245): a, c, t, g, unknown or other
  misc_feature (245)..(245): n is a, c, g, or t
tcagactactatgtcacgaccggtgctcgatttagtgtgagtagtttgggtttggggagagctgctcagttaggacccagagggaaccatggaaaccccagcgcagcttctcttcctcctgctactctggctcccagatgccaccggagacattgtgttgacacagtctccagccacctgtctttgctcgagggaaangccaccctctccgtagcagggcagtgacatgtagattgtagctgtancaacacaacatgccaggcctcccggctcctcatctatgatcgcatccgaagtcgggccagtggcacgtccagactacggttcaggtgacaggtggtcgagggacagtacttcactcacaccatcgacgcgtagtagtacgacgtccgtagtaacgtatttacgacgttagtttagttacgtacgtacgtacgtccgtaccgtcgaactaccgtacgtaccccttacgttcccggtaccgtacgggtaccacggtacgtacggacctacgtacccgaacggtacgttacggtcgtcgtcgtacctaccgtacttccgttcgttaccttaccgtacgttcccg

SEQ ID NO: 157895 - DNA, 566 bp, Homo sapiens
  misc_feature: GYAE6OF02ITSJA.24.78.H01.1.454.CMB.1.raw
  modified_base (199)..(199): a, c, t, g, unknown or other
  misc_feature (199)..(199): n is a, c, g, or t
  modified_base (498)..(498): a, c, t, g, unknown or other
  misc_feature (498)..(498): n is a, c, g, or t
tcagactactatgtcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgtctccagggganagagccaccctctctgcagggccagtcagagtgttagcagcagctactagcctggtacagcagaacctgcctggctccaggctcctcatctagtggtgccgtccaccgagggccacgtggcgtcgcggacaggttcagtggcaggtcggtcgtttgggactaggtaccttcgacttctacatcatcgacagtactaggacgacccgtaagtactttgactagttagttacttacgtgtcagtcttaggttcgtccttactccttctattcgtacttacgtttcgtccgtacgggttacnggtcgtacggtagtactacgtaacgtaccgtaacgttcggtacggtcgtacgtaccgtactacgttcg

SEQ ID NO: 157896 - DNA, 551 bp, Homo sapiens
  misc_feature: GYAE6OF02HCL00.24.78.H01.1.454.CMB.1.raw
  modified_base (354)..(354): a, c, t, g, unknown or other
  misc_feature (354)..(354): n is a, c, g, or t
  modified_base (377)..(377): a, c, t, g, unknown or other
  misc_feature (377)..(377): n is a, c, g, or t
tcagactactatgtcacgaccggtgctcgatttagtgtgagtagtttgggtttggcacgacaggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgtctccaggggagagagccaccctctcctgcagggccagtcagagtgttagcagcagctacttagcctggtaccagcagaacctggcctgctcccaggctcctcatctatggtcgccgtccacccgngggcccactggcgtccgcggacnggttcaggtggcgagtggtcgtttgggacaggtacttcactcctctatactacgtcgacgagtactggacgaccgtaagtacgtttgctagtgttattactgtcagtcgttgttcggttcccttccttcctccttatcgttacttcttttacggccgtacgggttccgaggtcg

SEQ ID NO: 157897 - DNA, 542 bp, Homo sapiens
  misc_feature: GYAE6OF02FFPSG.24.78.H01.1.454.CMB.1.raw
tcagactactatgtcacgaccggtgctcgatttagtgtgagtagtttgggtttggggagaggagcccagcactagaagtcggcggtgtttccattcggtgatcagcactgaacacagaggactcaccatggagtttgggctgagctgggttttcctcgtcgctcttttaagaggtgtccagtgtcaggggcagctggtggagtctgggggcggcgtggtccaacctgggaggtccctgagactctcctgtgcggcctcccgattcaccttcaatacttatggcatgcactgggtccgccaggctccaggcaaggggctggagtgggtggccgctatcttatttgatggaagtatcaatattatgcagactccgtgaagggccggttcaccatctccagagacaattccaacaatactctgttctgacaaatgactagcctgcgatctgagacacggctgtctattactgtgacgaaagtcgttccccggcccttaccttacgatttacgttcggggtccggtccccctacacgtggtaccgg

SEQ ID NO: 157898 - DNA, 584 bp, Homo sapiens
  misc_feature: GYAE6OF02HH1AL.24.78.H01.1.454.CMB.1.raw
  modified_base (238)..(238): a, c, t, g, unknown or other
  misc_feature (238)..(238): n is a, c, g, or t
  modified_base (296)..(296): a, c, t, g, unknown or other
  misc_feature (296)..(296): n is a, c, g, or t
  modified_base (324)..(324): a, c, t, g, unknown or other
  misc_feature (324)..(324): n is a, c, g, or t
  modified_base (340)..(340): a, c, t, g, unknown or other
  misc_feature (340)..(340): n is a, c, g, or t
  modified_base (377)..(377): a, c, t, g, unknown or other
  misc_feature (377)..(377): n is a, c, g, or t
  modified_base (383)..(383): a, c, t, g, unknown or other
  misc_feature (383)..(383): n is a, c, g, or t
tcagactactatgtcacgaccggtgctcgatttagtgtgagtagtttgggtttggcacgaccggtgctcgatttagtgtgagtagtttgggtttgggagagctgctcagttaggacccagagggaaccatggaaaccccagcgcagcttctcttcctcctgctactctggctcccagagaccaccggagaaattgtgttgacacagtctccaggcaccctgtctttgctccagggganagagccaccctctcctgcagggccagccggagtgttagaagtctaggctggtaccaanagaacctggccaggctcccaggctcctnatcatgatgtctcaanggtcactggcctcccgcaggttcagtcgcagtggtcngggacngactcactctcaccgtcagcagcctagacgcctagaacgtacgtttgacgtttactacgtgtcagcgagtccgttccgaccgtcggcccgtcgttaaccgtttccgggaccgggggtaccgtagggggtcggaacggtacgggaacggtaaccggtaacgttcgggtacggaccgtaccggacccgtaaccgtagttcccg

SEQ ID NO: 157899 - DNA, 521 bp, Homo sapiens
  misc_feature: GYAE6OF02H1LYG.24.78.H01.1.454.CMB.1.raw
  modified_base (240)..(240): a, c, t, g, unknown or other
  misc_feature (240)..(240): n is a, c, g, or t
  modified_base (472)..(472): a, c, t, g, unknown or other
  misc_feature (472)..(472): n is a, c, g, or t
  modified_base (493)..(493): a, c, t, g, unknown or other
  misc_feature (493)..(493): n is a, c, g, or t
  modified_base (518)..(518): a, c, t, g, unknown or other
  misc_feature (518)..(518): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgtctccagggganagagcccaccctctcctgcagggccagtcagagtgttagcagcagctacttgcctggtaccagcagaaacctggcctggcctccagcctcctcatctatggtgcgtccacagggccacgtcggcgtcgcggacaggttcaggtcggcgagtggtcgttgggacagacgttcactctcatcactcgacagtacgtggacgaccgaagtactttgctagtagttattactgtcngtctgttcgtcctctcctctntctactcgtttcgcgtaggtcagtntcg

SEQ ID NO: 157900 - DNA, 563 bp, Homo sapiens
  misc_feature: GYAE6OF02H0WAI.24.78.H01.1.454.CMB.1.raw
  modified_base (199)..(199): a, c, t, g, unknown or other
  misc_feature (199)..(199): n is a, c, g, or t
  modified_base (559)..(559): a, c, t, g, unknown or other
  misc_feature (559)..(559): n is a, c, g, or t
tcagactactatgtcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgtctccagggganagagccaccctctcctgcagggccagtcagagtgttagcagcagctacttagcctggtaccagcagaaacctggcctggctccaggcctcctcattctagtcggtgccgtccaccgacgggccacgtcggccgtcggcggacgtaggttcaggtggctaggttcggtctttgggactaggtacttcacttctacatcatcgacagactggacgaccgtaagtatttgactagtattaattctgtcacgtctgttcgtcctctcctctatcgtacttcgtttcggccgtacggttccgtaggtcgtaggacgtacgtacgaacgtaccgtaacgttggtacggtccttacgacctaccgtnttcg

SEQ ID NO: 157901 - DNA, 776 bp, Homo sapiens
  misc_feature: GYAE6OF02HXG3F.24.78.H01.1.454.CMB.1.raw
  modified_base (247)..(247): a, c, t, g, unknown or other
  misc_feature (247)..(247): n is a, c, g, or t
tcagactactatgtcacgaccggtgctcgatttagtgtgagtagtttgggtttggcacgaccggtgctcgatttagcacacgatagttgggtttgggggaggaactgctcagttaggacccagagggaaccatggaagccccagctcagcttctcttcctcctgctactctggctcccagactaccactggagaagtagtcatgacgcagtcctccacgcctacctgtctgtgtctccgagggaacncgccaccctctcctgcgagggccagtgacgaatgtggcagctaacgttagcctggtaccagcaacgaaccgtggccacggcctccgacggcctccgtcctctactcgctcgtcctccaccgtacgggccccgttgggtccgtaccccgaggtacccgttaggggttttccggttcggggtccgggggtttcggggttccggttacggggtaccgtaacggttacgtttttacccgtaccgttccgttaccctaacccgtaacgttcccgaaccgggtcccgggtaccccttacccggtaacggtttccgttaacgggtaaaccgtttacgttttttcggacccgttttaaccgttttttactttttccgtttacgttacccgttaaacttaaccgtttacgttcggggttacgtaccgttcgggttaccctttacccggttaaccttttaccggtttttacgggacccggtaacggggtaaccctaacggtacgggtaagtaaccgtaaccgtaaacggtacgtacggg

SEQ ID NO: 157902 - DNA, 532 bp, Homo sapiens
  misc_feature: GYAE6OF02GOM1A.24.78.H01.1.454.CMB.1.raw
  modified_base (199)..(199): a, c, t, g, unknown or other
  misc_feature (199)..(199): n is a, c, g, or t
  modified_base (422)..(422): a, c, t, g, unknown or other
  misc_feature (422)..(422): n is a, c, g, or t
tcagactactatgtcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgtctccagggganagagcccaccctctcctgcagggccagtcagagtgtagcagcagctacttagcctggtaccagcagaaacctggcctggcctcccaggctcctcatctatggtgccgtccaccgagggccactggcgtcgcggacaggttcagtggcagtggctttgggacagacttcactctcatcatcgacagactggacgcccgaagtatttgcagtgttattactgtcngtctgtttcggtcccttctcctccttatcgttactacgttttcggccgtacgggttccaggtcgtggacgtatacgaagcgtaacgtggtggtcgtcgctacctattccg

SEQ ID NO: 157903 - DNA, 261 bp, Homo sapiens
  misc_feature: GYAE6OF02G0D4P.24.78.H01.1.454.CMB.1.raw
  modified_base (259)..(261): a, c, t, g, unknown or other
  misc_feature (259)..(261): n is a, c, g, or t
tcagactactatgtcacgaccggtgctcgatttagtgtgagtagtttgggtttgggacagacttcactctcatcatcgacagactggagcccgaagattttgcagtgtattactgtcagctgtttggtccctctcctcctatgtacacttttggccagggttccaggctggagatcaagcgaactgtggctgcaccatctgtcttcatcttcccgccatctgaacatagtagtctgagcgggctggcaaggcgcatagnnn

SEQ ID NO: 157904 - DNA, 526 bp, Homo sapiens
  misc_feature: GYAE6OF02GWFVG.24.78.H01.1.454.CMB.1.raw
tcagactactatgtcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgtctccaggggagagagccaccctctcctgcagggccagtcagagtgtagcagcagctactagcctggtaccagcagaaacctggcctggctcccaggcctcctcatctatggtgcgtccacagggccactggcgtcgcggacaggtcagtggcagtggctttgggacaggacttcactctcatcagtcgacagactggacgccgaagtatttgcagtgttattactgtcagtctgtttcggtcctcttcctcctatcgttactcgtttcgccgtaggttccaggtcgtgggatacgtcaaaggtccgtaacgtggtacgggcttcggcctacgacttcg

SEQ ID NO: 157905 - DNA, 541 bp, Homo sapiens
  misc_feature: GYAE6OF02IXHDB.24.78.H01.1.454.CMB.1.raw
  modified_base (239)..(239): a, c, t, g, unknown or other
  misc_feature (239)..(239): n is a, c, g, or t
  modified_base (505)..(505): a, c, t, g, unknown or other
  misc_feature (505)..(505): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtcttgtctccagggganagagccacctctcctgcagggccagtcagagtgttagcagcagctacttagcctggtacccagcaaggaacctggcctggcctcccgaggcctcctcatctagtcggtcgccgtaccacgacggccacgtcggcgtcgcggactaggttcaggtcggacaggtcggtcgtttgggacagtacttcactctcatcatcgacagacgtcggacgccgaagtactttgctagtgtacttactgtcagtcgtgttcgtcctcttcctctntacgtactcgtttcggccgtcggtcgtagtcgtcgg

SEQ ID NO: 157906 - DNA, 606 bp, Homo sapiens
  misc_feature: GYAE6OF02GKM11.24.78.H01.1.454.CMB.1.raw
  modified_base (155)..(155): a, c, t, g, unknown or other
  misc_feature (155)..(155): n is a, c, g, or t
  modified_base (296)..(296): a, c, t, g, unknown or other
  misc_feature (296)..(296): n is a, c, g, or t
  modified_base (336)..(336): a, c, t, g, unknown or other
  misc_feature (336)..(336): n is a, c, g, or t
  modified_base (356)..(356): a, c, t, g, unknown or other
  misc_feature (356)..(356): n is a, c, g, or t
  modified_base (396)..(396): a, c, t, g, unknown or other
  misc_feature (396)..(396): n is a, c, g, or t
  modified_base (433)..(433): a, c, t, g, unknown or other
  misc_feature (433)..(433): n is a, c, g, or t
tcagactactatgtcacgaccggtgctcgatttagtgtgagtagtttgggtttggggagaggagcccagcactagaagtcggcggtgtttccattcggtgatcagcactgaacacagaggactcaccatggagtttgggctgagcgtggtttccncgtacgctctttaagaggtgtccagtgtcgaggggcaggctggtggagtcgtgggggcgcgtggtccaacctgggagtccctgagactctcctgtgcggcctccgattcaccttcaatactatggcatgcagtcgggtccnccaggctccgaggccgaaggggctaggagtgggtcgccgntatcttattgattggaatancaaatgtatgacagtactcgtagaacggtccgttacaccngtctaccgagagacaacgttccaaactaattaccttnttacgttctagtactaagtcgtaactcgcgtagacgtatacgtaggacgaccgtacggttcttgtaccgttaattagtgttacgaacggtaaccgttcccgttaccccggtacctttacgtaaccgttagtttacgggtccgggtacccgtacccgtagtacgtaccggtacg

SEQ ID NO: 157907 - DNA, 640 bp, Homo sapiens
  misc_feature: GYAE6OF02JD25I.24.78.H01.1.454.CMB.1.raw
  modified_base (252)..(252): a, c, t, g, unknown or other
  misc_feature (252)..(252): n is a, c, g, or t
  modified_base (301)..(301): a, c, t, g, unknown or other
  misc_feature (301)..(301): n is a, c, g, or t
tcagactactatgtcacgaccggtgctcgatttagtgtgagtagtttgggtttggcacgaccggtgctcgatttagtgtgagtagtttgggtttgggtagagctgctcagttaggacccagagggaaccatggaaacccccagcgcagcttctcttcctcctgctactctggctcccagccatcaccggaggaattgtgttgacgcagtctccaggcaccctgtcttgctccaggggacagagccaccctcncctgacagggccagtcagagtgttagcagcagctactagcctggtaccngcagaacctgcctggctccgagcctctcatcctagtcggtgcgtcccacgtacgggccacgtcggccgtcgccggacgtaggttccaggtcgcgtagtcggtcgtttacggggacgtacgtaccgttactacgttccgtaccacccgtactccgtaacgtcccgggtaccctccgacggttaccgtcgtaaacgttacgtttttcggaccttaccgttttacttttaccgttacgttacctaacctacgttacgttcggtacgacgttccggtaccttcccggtacttacgttttacggccgtacggggtaaccctaacggtcggtagtacgtaacccg

SEQ ID NO: 157908 - DNA, 720 bp, Homo sapiens
  misc_feature: GYAE6OF02H0LRM.24.78.H01.1.454.CMB.1.raw
  modified_base (177)..(177): a, c, t, g, unknown or other
  misc_feature (177)..(177): n is a, c, g, or t
  modified_base (320)..(320): a, c, t, g, unknown or other
  misc_feature (320)..(320): n is a, c, g, or t
  modified_base (470)..(470): a, c, t, g, unknown or other
  misc_feature (470)..(470): n is a, c, g, or t
tcagactactatgtcacgaccggtgctcgatttagtgtgagtagtttgggtttggggagaggagcccagcactagaagtcggcggtgtttccattcggtgatcagcactgaacacagaggactcaccatggagtttgggctgagctgggttttcctcgtcgcttcttttaagaggtntccagtgtcaggggcagctgggtggagtcgtggggggcggcggttggtccaaccgtgggacggtccctggacgactctccgtgtcggccgccctccgatttccacctttcaaattcttatcggcatcgctacgtcgggtcccncgacggtctcccgaggcgaagggggctgggaggtcgggtcggcccgtataacgttcgttttagtttagagtagggtaaacgttaatcgtaaatttacttagtcgacaagtacccgtcggtaagggtaacggggtcccgtttacaaccgtnttacccgtaccgacgaacgtaactaacttaccaaactaactaccttacttcgtttactagaactaaagtacgtactacgccgtacgacgtactacgtacggtaacggaccgtacggtactcgttacttaagtttacgtgtacggtacgtaaaccggttacccgttacccccggttccctttaccgttaacgttacgtttacggttccggggtacccgtacccccgttacgtaccggttacggtaaccggg

SEQ ID NO: 157909 - DNA, 585 bp, Homo sapiens
  misc_feature: GYAE6OF02IDJS9.24.78.H01.1.454.CMB.1.raw
  modified_base (235)..(235): a, c, t, g, unknown or other
  misc_feature (235)..(235): n is a, c, g, or t
  modified_base (247)..(247): a, c, t, g, unknown or other
  misc_feature (247)..(247): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggctcccagccatcaccggagattgtgttgacgcagtctccaggcacctgtctttgctccaggggnagagccaccctntcctgcagggccagtcagagtgttagcagcagctacttagcctgtacccagcagaaacctggcctggcctcccgaggcctcctcatctagtggtcgccgtccaccgagggccacgtggcgtcgcgacaggttcaggtggcgtagtcggtcgtttgggacagtacttcactctcactctactcgacgagacgtcggacgacccgtaagtacgttttcgacgtagtacgttaattacgttgtacgtagtcgttagtttcggttcccttcttcccttccgttacgttacgttaccgttacgttttcggaccgttacgggttaccgtacgggtccgtacggg

SEQ ID NO: 157910 - DNA, 543 bp, Homo sapiens
  misc_feature: GYAE6OF02INSTP.24.78.H01.1.454.CMB.1.raw
  modified_base (142)..(142): a, c, t, g, unknown or other
  misc_feature (142)..(142): n is a, c, g, or t
  modified_base (241)..(241): a, c, t, g, unknown or other
  misc_feature (241)..(241): n is a, c, g, or t
tcagactactatgtcacgaccggtgctcgatttagtgtgagtagtttgggtttggcacgaccggtgctcgatttagtgtgagtagtttgggtttgggggagagctgctcagttaggacccagagggaaccatggaaaccccngcgcagcttctcttcctcctgctactctggctcccagccatcaccggaggaattgtgttgacgcagtctccaggcaccctgtctttgctccgagggganagagcccaccctctcctgcagggccagtcagagtgttagcagcagctacttagcctggtaccagcagaaacctggcctggcctcccaggctcctcatctatggtgcgtccaccgaggccacgtggcgtcgcggacagggttcaggtggcgagtggtcgtttgggacagacttcactctcatcactcgacacgactcggagccgaagtattttcgctagtgttattacgtgtacagtcttgtttcggtccctcttccctcttatcgttactcgttttcggcctagggttcctaggtctacggg

SEQ ID NO: 157911 - DNA, 754 bp, Homo sapiens
  misc_feature: GYAE6OF02JCL80.24.78.H01.1.454.CMB.1.raw
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtcctccaggccaccctgtctttgtctccgaggggagagacgcccacccgtctccgtgacacgggcccaggtcaagagttgttaagcagcagctacgttagccctaggtacccaggccaacgtaaccctgggccctacgggcctaccccgagggtcccttccctacgtacgttccgttaaggttcggtaccggacccgttcccgaaccggtaccggggtcccctaaaggtcggggtccgttaccgggccgggtaaactacggggtttaccaggggtcggaccgtacggttcgggtaccgtttgggaaccgacggttaccgttccgtaacttccgtaacgtacgtacctacgttaccgaccgtacggtaccgttaggaaccggtaacccgttaagtttacgttttacgacgttaggttacgttactttaacgtcgttaagtacgttcgttacggttttacggtccccgtttcgttcccgttacgtttacgttacgttacgtttaccggttttggttaccgttacgggtttccgtacggtcgttaacggg

SEQ ID NO: 157912 - DNA, 638 bp, Homo sapiens
  misc_feature: GYAE6OF02HGY2Z.24.78.H01.1.454.CMB.1.raw
  modified_base (199)..(199): a, c, t, g, unknown or other
  misc_feature (199)..(199): n is a, c, g, or t
  modified_base (211)..(211): a, c, t, g, unknown or other
  misc_feature (211)..(211): n is a, c, g, or t
  modified_base (632)..(632): a, c, t, g, unknown or other
  misc_feature (632)..(632): n is a, c, g, or t
tcagactactatgtcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgtctccagggganagagccaccctntcctgcaggccagtcagagtgtagcagcagctactagcctggtaccagcaagaaacctggcctggctcccaggcctcctcatctatggtgccgtccaccgacgggccactcgggcgtcggcggactggttcacggtggacagggttcgtcgttttgggactaggtacctttacaacgttctcgactactacgtcgaacgacggtacgttacgggacgacccggtaaagttactttacgacgtagttagtttaactttacgttgtactagtctttacggtttccggttcccttccgttaccctttccgttacgttcgttaacctttaccggttttacggacccgttacgggtttccacgggtcggttcggaacgtacgttacgaacggtacgaacgttcggtcggcgttacgaccgtacctnttaccg

SEQ ID NO: 157913 - DNA, 627 bp, Homo sapiens
  misc_feature: GYAE6OF02GVZ28.24.78.H01.1.454.CMB.1.raw
  modified_base (305)..(305): a, c, t, g, unknown or other
  misc_feature (305)..(305): n is a, c, g, or t
  modified_base (353)..(353): a, c, t, g, unknown or other
  misc_feature (353)..(353): n is a, c, g, or t
tcagactactatgtcacgaccggtgctcgatttagtgtgagtagtttgggtttggggagaggagcccagcactagaagtcggcggtgtttccattcggtgatcagcactgaacacagaggactcaccatggagtttgggctgagcgtgggtttcgcgtacggctctttaagaggtgtccagtgtcaggggcagctggtggagtcgtgggggcggcgtgggtccaaccgtgggaggtccctgagactctcctgtgccggcctcccgattccaccttcaattacttatggcatgccacgtgggtccnccaggcctccgagggccaagggggtctgggacggtggggtggacccgnttagtctttagtttgattgggaattaatcaaattatttactgacaaggtacttccggtagaacgggcccggtttacaccctatcctaccagaacgaactaacttaccaaactaactaccttcttcgtttcctagactaaagtcgtactagcctgcgtatctgagacgcgtactcgttactattcgtgtacgtacgtaacggtcttccccggtaccttacgttaccgttagtttacggttcggggtccgtacccccgttagtacggtggtaccgg

SEQ ID NO: 157914 - DNA, 683 bp, Homo sapiens
  misc_feature: GYAE6OF02JFFHK.24.78.H01.1.454.CMB.1.raw
  modified_base (239)..(239): a, c, t, g, unknown or other
  misc_feature (239)..(239): n is a, c, g, or t
  modified_base (303)..(303): a, c, t, g, unknown or other
  misc_feature (303)..(303): n is a, c, g, or t
  modified_base (337)..(337): a, c, t, g, unknown or other
  misc_feature (337)..(337): n is a, c, g, or t
tcagactactatgtcacgaccggtgctcgatttagtgtgagtagtttgggtttggcacgaccgggtgctcgatttagtgtgagtagtttgggtttggggagagctgctcagttaggacccagaggaaccatggaaaccccagcgcagcttctcttcctcctgctactctggctcccagcctatcaccggaggaattgtgttgacgcagtctccaggcaccctgtcttgctccaggggangaggcccaccctctcctgcagggccagtcagagtgttagcagtcagctacttagcctggtaccngcacgaacctggcctggcctcccaggctcccgtnatctaagtcggtagccgttccaccgagggtcccaagtcggacgttccgacggactagggttccagttacgggcgtaggtggtaccgtttgggaccgtagtacccgttacaccgttccgttaccaacgttccgaacgttacggaacctagtacgttacgggtacgtccccgtaaagtacgtttttaacgcccgttaaggttacgttaacgtttaaccggtacgttaccgaaggtacccgtttaggttttcggtaccccgtttccgttcccgttaccgtacgttacgttaccgtaccgtttttacgggacccgttaacgggtttacccgtagggttcccgttaagggg

SEQ ID NO: 157915 - DNA, 586 bp, Homo sapiens
  misc_feature: GYAE6OF02F51V6.24.78.H01.1.454.CMB.1.raw
  modified_base (580)..(580): a, c, t, g, unknown or other
  misc_feature (580)..(580): n is a, c, g, or t
tcagactactatgtcacgaccggtgctcgatttagtgtgagtagtttgggtttgggggagagctgctcagttaggacccagagggaaccatggaaaccccagcgcagcttctcttcctcctgctactctggctcccagccatcaccggaggattgtgttgacgcagtctccaggcaccctgtctttgtctccgaggggagagagccaccctctcctgcagggccagtcagagtgttagcagcagctacttagcctggtaccagcagaacctggcctggctcccaggcctcctcatctagtggtgccgtccaccgagggccacgtggcgtcggcggacaggttcagtcggcaggtcggctttgggactagacttgactctcatcactacgacagacgtcggacgaccggtaagtagtttcgcgtagttagttacttacgttgtactagtcgttcggtttcgtcccttcgttcccgttccttacgttcgttacttacgtttcggccgttacgggttccaggtcgtgggtaacgtactacggtaacgtcgtaacgtcggttcggtaccgtcggtcctaccgtnttaccg

SEQ ID NO: 157916 - DNA, 649 bp, Homo sapiens
  misc_feature: GYAE6OF02HUHKT.24.78.H01.1.454.CMB.1.raw
  modified_base (283)..(283): a, c, t, g, unknown or other
  misc_feature (283)..(283): n is a, c, g, or t
  modified_base (644)..(644): a, c, t, g, unknown or other
  misc_feature (644)..(644): n is a, c, g, or t
tcagactactatgtcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgtctccgaggggagagagccaccctctcctgcagggccagtcagagtgttagcagcagctactagcctggtaccagcagaacctggcctggctccgnggcctcctcatctagtggtcgccgtccaccgacgggccacgtcggcgtcggcggacgtaggtcgaggtcggcgaggttcggtcgttttagggactacggtacttacgtacctctcactccacgttaccgaacgtacggtacgtcgggaacgtacccggtaaagttacgtttcgacgtagttagttaacgtttacgtcgttacgtagtccgttttcggtttccggttccccttccttacccttaccttagttacgttacctttacggttttcggaccgttaccgggttccgtacgggttcgtagggtacgttaacgtacgtaacggtaccgtaacgtcggtcggtacgttcgacctaccgtnttccg

SEQ ID NO: 157917 - DNA, 575 bp, Homo sapiens
  misc_feature: GYAE6OF02JQQYF.24.78.H01.1.454.CMB.1.raw
  modified_base (381)..(381): a, c, t, g, unknown or other
  misc_feature (381)..(381): n is a, c, g, or t
  modified_base (395)..(395): a, c, t, g, unknown or other
  misc_feature (395)..(395): n is a, c, g, or t
  modified_base (487)..(487): a, c, t, g, unknown or other
  misc_feature (487)..(487): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggctcccagccatcaccggagaattgtgttgacgcagtctccaggcaccctgtcttgctccagggagagacgccaccctctcctgcgaggccagtcagagtgttagcagcagctactagcctcggtacagcagaaacctcggcctggcctcccgaggtcctacgtcactctagtggtcgcgtaccaccgcggccacgtcggcgtcggcgacnggtcaggtcggacngtcggtgttagggactagtactcactctcatctagcgacagacgtcggacgacgtaagttcttacgacgtgttacgttactcgtacgtacgngttacgttaggtttccgtccgttcttacttccgttagttcgttaccgttcgtttccggtaccgttacggtcgttacggtacgttacgg

SEQ ID NO: 157918 - DNA, 583 bp, Homo sapiens
  misc_feature: GYAE6OF02HQA2Y.24.78.H01.1.454.CMB.1.raw
  modified_base (156)..(156): a, c, t, g, unknown or other
  misc_feature (156)..(156): n is a, c, g, or t
  modified_base (200)..(200): a, c, t, g, unknown or other
  misc_feature (200)..(200): n is a, c, g, or t
  modified_base (380)..(380): a, c, t, g, unknown or other
  misc_feature (380)..(380): n is a, c, g, or t
tcagactactatgtcacgaccggtgctcgatttagtgtgagtagtttgggtttggggagagctgctcagttaggacccagagggaaccatggaaaccccagcgcagcttctcttcctcctgctactctggctcccagccatcaccggaggaattgngttgacgcagtctccaggcaccctgtctttgctccgaggggganagagcccaccctctcctgcagggccagccggagtgttagaagtacttaggcttggtaccaacagaaacctggaccaggctcccaggctcctcatctatgatgtctccaacgtagggtcacgtggccgtccccgcaggttcagtggcaggtgggtctgggacagacttcactctcaccgtnagcagcctagacgcctagaagttattttgtacggtttactatgtacagcagtccgttccgcttcggccgtacgttaacgtttcggggcgggggtaccgtaggggtggaaggagggacgacgaacgtggtcggctgacacctagtcttcggttcttcctactttcccgttacccgacctagttaccgtagtaactagttaacgg

SEQ ID NO: 157919 - DNA, 638 bp, Homo sapiens
  misc_feature: GYAE6OF02IL81Y.24.78.H01.1.454.CMB.1.raw
tcagactactatgtcacgaccggtgctcgatttagtgtgagtagtttgggtttgggggagagctgctcagttaggacccagagggaaccatggaaaccccagcgcagcttctcttcctcctgctactctggctcccagccatcaccggaggaattgtgttgacgcagtctccaggcaccctgtctttgtctccgaggggagagagcccacccttctcctgcagggccagtcagagtgttagcagcagctacttagcctggtaccagcagaacctggcctgcctcccagcctcctcatctagtggtcgccgtccaccgacgggccacgtggcgtcgcggacgtaggtcgaggtggcgtaggtcgggtcgttttgggacgtacgtacttacacttctctactcatcgacagtacgtacggacgacccgtaagttacgtttgacgtaggttgttatttacgtgttacctagtcgtttacggtttcggtccccttcgttacccttccttagtttccgttaccgtttacgttttccggtaccgttacggggttaccgtacgggtcgttagggtaacgtacgtaccgtaaggacccgtaacggttcggtacgggtccgttacgacccgttaccgtagtttcccg

SEQ ID NO: 157920 - DNA, 688 bp, Homo sapiens
  misc_feature: GYAE6OF02FTE77.24.78.H01.1.454.CMB.1.raw
  modified_base (202)..(202): a, c, t, g, unknown or other
  misc_feature (202)..(202): n is a, c, g, or t
tcagactactatgtcacgaccggtgctcgatttagtgtgagtagtttgggtttggggagagctgctcagttaggacccagagggaaccatggaagccccagctcagcttctcttcctcctgctactctggctcccagatgccaccggagacattgtgttgacacagtctccagccaccctgtctttgtctccgaggggaaanagccaccctctcctgcagggccagtgacaatgttaggaagttgttagccgtggtatcaacacaaacatggccaggcctccccggctccctcatctatgatgcacgtccaagtacgggccacgtcggacactccagactaggttacaggtcggctagggtcgggtcgtagggacacggtacttccgacgttcctacgaccctagtccgacgtactaggttagtacgtacgtaccgttaggtaaagttcgttttacggactttaaggttttacttacgttaggttaccaacggtcctaaccggtacgtaaccgtaaccgttaccgggtacccttaaccggtttcccgggtacccggttacgggtaacccgtaacgggtaccgtacggtacctaaccggttaacccggtaaacgtaacggtttccgggtaccggtcgtaccgtacccgttacgtacgtttcccgttaacgtttccttaacccgttcccg

SEQ ID NO: 157921 - DNA, 672 bp, Homo sapiens
  misc_feature: GYAE6OF02HMQCJ.24.78.H01.1.454.CMB.1.raw
  modified_base (242)..(242): a, c, t, g, unknown or other
  misc_feature (242)..(242): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaacccccagcgcagcttctcttcctcctgctactctggctcccagccatcaccggaggattgtgttgacgcagtctccaggcaccctgttctttgtctccgagggganagagcccacctctcctgcgagggccagtcagagtgttagcagcagctactagccgtggtaccagcaacgaaacctcggcctggcctacccgaggcctccgtacattctagtggtcgccgtccacgaggcccacgtcggccgtcggacggacgtacggttcgaggtcggcaggttcggtacgtttgggactagtccttcgaccttctacatcacgtacgaacagacgtagggaccgtacccgaaagttacgttttacggaccgttaggttacgttaacgtttaccgttacgtacgttaacgttcgttttaccgggttttccgggtaccccttttcccgtacccgtttccttaacggttccgtttaaccggtttcccgtttttaccgggacccggtttaacggggtttacccgtacgggtaccgttaacggg

SEQ ID NO: 157922 - DNA, 649 bp, Homo sapiens
  misc_feature: GYAE6OF02GYHRG.24.78.H01.1.454.CMB.1.raw
  modified_base (302)..(302): a, c, t, g, unknown or other
  misc_feature (302)..(302): n is a, c, g, or t
  modified_base (340)..(340): a, c, t, g, unknown or other
  misc_feature (340)..(340): n is a, c, g, or t
  modified_base (367)..(367): a, c, t, g, unknown or other
  misc_feature (367)..(367): n is a, c, g, or t
  modified_base (371)..(371): a, c, t, g, unknown or other
  misc_feature (371)..(371): n is a, c, g, or t
tcagactactatgtcacgaccggtgctcgatttagtgtgagtagtttggttttggggagaggagcccagcactagaagtcggcggtgtttccattcggtgatcagcactgaacacagaggactcaccatggagtttgggctgagcttgggttttcctcgtcgctcttttaagaggtgtccagtgtcaggggcagctgggtggagtcgtgggggcgcgtggccaacgtgggacgtccctgagactctcctgtgccggcctccgattcaccttcaatcttatggcagtgctacgtcgggtcccncgaggcctccgaggcaaggggctggagtgggcgccgtntattcttattgagtggaatatcgaatnttangacacgcttcgaggaacggtccgttcaaccgtatccgtacgaagacgtaactaactaccaaataactacttcttacgtttccagtaacctaaattcgaaccgtcgccgtggacgtactacgaggtacgaccgtacggtctacgttactaagtttcgagtacgaacggtaaaccgtcccggttccccccggttacctttaccgtttaaccggttacggtttacgggttccggggttacccccgtacccccgtttaaggtacggttacgggtaacccggg

SEQ ID NO: 157923 - DNA, 687 bp, Homo sapiens
  misc_feature: GYAE6OF02HOXK4.24.78.H01.1.454.CMB.1.raw
  modified_base (105)..(105): a, c, t, g, unknown or other
  misc_feature (105)..(105): n is a, c, g, or t
  modified_base (198)..(198): a, c, t, g, unknown or other
  misc_feature (198)..(198): n is a, c, g, or t
  modified_base (216)..(216): a, c, t, g, unknown or other
  misc_feature (216)..(216): n is a, c, g, or t
  modified_base (270)..(270): a, c, t, g, unknown or other
  misc_feature (270)..(270): n is a, c, g, or t
  modified_base (283)..(283): a, c, t, g, unknown or other
  misc_feature (283)..(283): n is a, c, g, or t
  modified_base (299)..(299): a, c, t, g, unknown or other
  misc_feature (299)..(299): n is a, c, g, or t
tcagactactatgtcacgaccggtgctcgatttagtgtgagtagtttgggtttggggaggagctgctcagttacggacccagagggaaccatggaaaccccagcncagcttctcttcctcctgctactctgctccagccatcacggaggaattgtgttgacgcagtctccaggccacctgtctttgctccgagggganagacgcctaccctctccngcagggcagtcagagtgtagcagcagctactagcctgacagcagaactgctgcnccagcctctcatntactgtcgctccacgngggcctactggcgtcgcggtaactaggttcaaggtcgtacgtacggtggtcgttttacgggacctaaggtaacctttctaaccttcggttaccaagtttacctaacgttaccgaaacgacggtaacgttacgggaacggaacccggtaaagttaacggtttagtaccggtaaggttacgttaacgtttacgttacgttacgtacgttacgtttacggttttcggtttacccctcttaccccgtttaccttacgttacgtttacgtttaaccgtttttaccgggtacccgtaaccgggtttccgttaacgggtcgttacgggtaacgtaacttacgaaacggtacgtacgttacggttcggccgtttacgacgttaccctaacttccgg

SEQ ID NO: 157924 - DNA, 650 bp, Homo sapiens
  misc_feature: GYAE6OF02IZ39B.24.78.H01.1.454.CMB.1.raw
  modified_base (238)..(238): a, c, t, g, unknown or other
  misc_feature (238)..(238): n is a, c, g, or t
  modified_base (375)..(375): a, c, t, g, unknown or other
  misc_feature (375)..(375): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcacctgtctttgctcgagggganagcgcccacctctcctgcagggccagtcagagtgttagcagcagctactagctggtaccagcagaacctggcctggcctcccaggcctcctcatctagtggtgccgtccaccgacggcctacgtggcgtcgcggacnggttcgaggtggcgaggtcggtcgttgggacagtacttcgactctcatcacgtacgacacgtacgtacgggtacgacccggtaagttacgttttggacgttaggttagttaaccgttttacgtcggttaccgtagttccgtttcggtttttaccggttccccctttcgtttacccctttaccgtttaacgtttaccgtttaacccgtttaccggtttttaccgggtccccgtttaaccgggggtttccccgttacgggttaccggtttaacgggg

SEQ ID NO: 157925 - DNA, 537 bp, Homo sapiens
  misc_feature: GYAE6OF02G1ITT.24.78.H01.1.454.CMB.1.raw
  modified_base (247)..(247): a, c, t, g, unknown or other
  misc_feature (247)..(247): n is a, c, g, or t
  modified_base (455)..(455): a, c, t, g, unknown or other
  misc_feature (455)..(455): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaacccccagcgcagcttctcttcctcctgctactctggctcccagccatcaccggaggaattgtgttgacgcagtctccaggcaccctgtctgtcgtctccgaaggggaaagngcccaacccctctcctgcagggccagtcagagtataagagcaactacttagcctggtatcaacagaaacctggccaggcctccagctcctcatctatggtactatccagcagggccattggcgtcccagcctaggttcaggtcggactggtgggtcgtgggacaggtagtcacgtctcaccatcacgtcagtctgctgtctgaagttntttgcttagtttctacgtgcgagcagcacgtgtcgacgtcggtccgctcgttacgttcggacggtacggaccgagggtacgg

SEQ ID NO: 157926 - DNA, 558 bp, Homo sapiens
  misc_feature: GYAE6OF02GNJIY.24.78.H01.1.454.CMB.1.raw
  modified_base (239)..(239): a, c, t, g, unknown or other
  misc_feature (239)..(239): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgctccagggganagagccaccctctcctgcagggccagtcagagtgttagcagcagctacttagcctggtaccagcagaaacctggcctggcctcccaggcctcctcatctatggtgcgtccacgaggccacgtggcgtcgcggacagggttcaggtggcaggtcggcgtttgggacgtagacttcgacttctcatctactcgacacgacgtggacgacccgaagtactttcgactagttcgttattacgtgtactagtcttgttcgtccctcttccttcctacttcgtacttacgtttcggtccgttacggttccgtaggtcgttacggg

SEQ ID NO: 157927 - DNA, 619 bp, Homo sapiens
  misc_feature: GYAE6OF02I6ETV.24.78.H01.1.454.CMB.1.raw
  modified_base (251)..(251): a, c, t, g, unknown or other
  misc_feature (251)..(251): n is a, c, g, or t
tcagactactatgtcacgaccggtgctcgattttagtgtgagtagtttgggtttgggcacgaccggtgctcgatttagtggtgagtagtttgggtttggggagagctgctcagttaggacccagtagggaaccatggaaacccccagcgcagcttctcttcctcctggcttacttctcggctcccagccactcaccggaggaatttgtgttggacgcagtcctccaggcacctgtctttgtctccaggganagacgcccaccctctacctgcaggtccagtcagagtgttagacagcagctactagcctgtaccagcaagtaacctggcctggcctccgaggcctcctcgatctagtggtcgcgtccgaccgaggcctacgtcggcgtccgcgtacacggttcacggtgacagtcggtcgtttagggacagtacttcgacgttctacgtattccgttaagtccgtaacacgtacgtggaccgtaccgtagttagttttcgacgttagttcgttacttacgtcggtaccgtagtcgttggtttacgtacccttacgtccttaccgtacgttacgttaccttcgttttcggccgttacgggttccgtacggtcgttaacgg

SEQ ID NO: 157928 - DNA, 657 bp, Homo sapiens
  misc_feature: GYAE6OF02IH0VJ.24.78.H01.1.454.CMB.1.raw
  modified_base (157)..(157): a, c, t, g, unknown or other
  misc_feature (157)..(157): n is a, c, g, or t
  modified_base (277)..(277): a, c, t, g, unknown or other
  misc_feature (277)..(277): n is a, c, g, or t
tcagactactatgtcacgaccggtgctcgatttagtgtgagtagtttgggtttggggagaggagcccagcactagaagtcggcggtgtttccattcggtgatcagcactgaacacagaggactcaccatggagtttgggctgagcttgggttttccncgtcgctcttttaagaggtgtccagtgtcaggggcagctggtggagtctgggggcgcgtggtccaacctgggagtccctgagctctcctgtcgcggcctccgattccacttcaatcttanggcatgcacgtgggtccgccaggctcccgaggcgaagggggctgggagtggggtcggccgctatcgtttatttcggattgggaaagttaatcgtaaattattatcgacagtaccttccggtagaacgggggtcccggtttacacccgtagttcctaccgaaggaacgaacctaaacttacccaaactaataccttcttacgttttcgtagtacctaaattcgacttacgcctgactacttcgtagacggacctacgggtcttcgttacttaattccgtagtacgtacgaaacggtcccttacccccggtacctttaccgtttaaccgtagtttacggttcggggttacccgtacccccgtaacgttcgtacggtaccggg

SEQ ID NO: 157929 - DNA, 626 bp, Homo sapiens
  misc_feature: GYAE6OF02IY11S.24.78.H01.1.454.CMB.1.raw
  modified_base (295)..(295): a, c, t, g, unknown or other
  misc_feature (295)..(295): n is a, c, g, or t
  modified_base (380)..(380): a, c, t, g, unknown or other
  misc_feature (380)..(380): n is a, c, g, or t
tcagactactatgtcacgaccggtgctcgatttagtgtgagtagtttgggtttggggagaggagcccagcactagaagtcggcggtgtttccattcggtgatcagcactgaacacagaggactcaccatggagtttgggctgagctgggttttcctcgtcgctcttttaagaggtgtccagtgtcaggggcaggctggtggagtctgggggcgcgtggtccaactgggagtccctgagactctcctgtgcggcctcccgattccaccttcaatcttatggcatgcactgggtccnccaggcctccgagggcaaggggctgggagtggggtcgccgctattcgtttattggacttagggaagttaactcaaattagtttangacgagaccgttcggtagacggggtcccttacacctatcctccagacgactaacgttaccaactaatacctacttcgttactgaacctaatggtaacctagcccttgacgtagttcgtagacggacgtacggctttacgtacttacgttacgttgacgtcggtaaacgtcccgttacccccggtccctttacgttacggttattacggttcggggtacccgtacccctacgtggtacggtaccggg

SEQ ID NO: 157930 - DNA, 508 bp, Homo sapiens
  misc_feature: GYAE6OF02F2UDE.24.78.H01.1.454.CMB.1.raw
  modified_base (200)..(200): a, c, t, g, unknown or other
  misc_feature (200)..(200): n is a, c, g, or t
tcagactactatgtcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgtctccaggggganagagccaccctctcctgcagggccagtcagagtgttagcagcagctattagcctggtaccagcagaaacctggcctggctcccaggctcctcatctatggtgcgtccaccagggccactggcgtcgcggacaggttcagtggcagtggctttgggacagacttcactctcatcatcgacagactggagcccgaagatttgctagtgttattactgtcagtctgtttggtccctcgtcctctatgtactactttgcctaggttccaggtctggtagactcgaagcgtaagtgtggctgactaccattcg

SEQ ID NO: 157931 - DNA, 580 bp, Homo sapiens
  misc_feature: GYAE6OF02JBXZ9.24.78.H01.1.454.CMB.1.raw
  modified_base (271)..(271): a, c, t, g, unknown or other
  misc_feature (271)..(271): n is a, c, g, or t
  modified_base (343)..(343): a, c, t, g, unknown or other
  misc_feature (343)..(343): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgtctccaggggagagacgccacctctcctgcagggccagtcagntgtagcagcagctactagcctggtaccagcaagaacctggcctggcctcccgaggcctcctcatctgtggcncgtccacgacggccagtggcgtcgcggacaggttcagtcgcaggtggcgttggacagactcgactctcatcatcgacgacgacgtcggacgaccgtaagtactttcgacgtaggtgttacgttacgtcgttcacgttcgttacggtttcggttcccttccgttcccttacgttacttacggtttaccgttaccgttttcggtacccgttacggggtttccgtacggtccgttacggg

SEQ ID NO: 157932 - DNA, 593 bp, Homo sapiens
  misc_feature: GYAE6OF02G0MJH.24.78.H01.1.454.CMB.1.raw
  modified_base (237)..(237): a, c, t, g, unknown or other
  misc_feature (237)..(237): n is a, c, g, or t
  modified_base (296)..(296): a, c, t, g, unknown or other
  misc_feature (296)..(296): n is a, c, g, or t
tcagactactatgtcacgaccggtgctcgatttagtgtgagtagtttgggtttggcacgaccggtgctcgatttagtgtgagtagtttgggtttgggagagctgctcagttaggacccagagggaaccatggaaaccccagcgcagcttctcttcctcctgctactctggctcccagccatcaccggagaattgtgttgacgcagtctccaggcaccctgtctttgctccagggganagagccaccctctcctgcagggccagtcagatgttagcagcagctattagctggtaccngcaagaaacctggcctggctcccgaggcctccctactactctacgtggtcgccgtccaccgacgggcccacgtcggcgtcgacgacaggttccaggtcggcgaggtcggtcgtttgggactacggacttcactctacatctacgtcgacacgacgtggacgaccgaagtactttcgacgtagttgttacttacgtgtacctagtcgttcgtttcggtcccttctcccttacttaacgttacgttacgttaccgttttcgggacccgttacgggtttcccgtagggtccgttaacggg

SEQ ID NO: 157933 - DNA, 585 bp, Homo sapiens
  misc_feature: GYAE6OF02JFFX4.24.78.H01.1.454.CMB.1.raw
tcagactactatgtcacgaccggtgctcgatttagtgtgagtagtttgggtttggggagaggagcccagcactagaagtcggcggtgtttccattcggtgatcagcactgaacacagaggactcaccatggagtttgggctgagctgggttttcctcgtcgctcttttaagaggtgtccagtgtcaggggcagctggtgagtctgggggcggcgtggtccaaccgtgggaggtccctgagactctcctgtgcggcctcccgattcaccttcaatacttatggcatgcacgtgggtccgccaggcctccgaggcaaggggctgggagtggggtcgccgctatcttattgatggaattatcaatattatgcagactcgtaggaacggccgttacacctatcctacaagacgactaacttaccaaactaactactctcgtttctgactaaatgtactacgccgtagcgatcgtagacgacgacggtcttgtactattacgtgtacgacgaacgtccgttccccgtaccctttacgttaaccgtagttacgttcggggtaccgtacccccgttagtacgtcggtaccgg

SEQ ID NO: 157934 - DNA, 674 bp, Homo sapiens
  misc_feature: GYAE6OF02HBL3J.24.78.H01.1.454.CMB.1.raw
tcagactactatgtcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgtctccagggggagagagccaccctctcctgcagggccagtcagagtgttagcagcagctacttagcctggtaccagcagaaacctggcctggctcccaggcctcctcatctagtggtgccgtcccaccgagggccctacgtcgggcgtcggcggactagggttcaggtcggcaggttggtcgtttgggactaggtacttcgacttctctatcactcgacagacgtggacgaccgtaagttacgtttgacgtaggttagttaactttacgttcgttacagttcgtttcggttttaccggttcccctttaccttcccgtttacctttacgtttacgtttaacccgttttacgtttttaccgggtcccgtttacggggtttacccgtacggggttcggttacggggtaacgttacgttaaccggtaacggtaccgttaacggttcgggttacgggtacccttacgggacccttaacccgttcgttaccgg

SEQ ID NO: 157935 - DNA, 679 bp, Homo sapiens
  misc_feature: GYAE6OF02J2CSZ.24.78.H01.1.454.CMB.1.raw
  modified_base (239)..(239): a, c, t, g, unknown or other
  misc_feature (239)..(239): n is a, c, g, or t
  modified_base (273)..(273): a, c, t, g, unknown or other
  misc_feature (273)..(273): n is a, c, g, or t
  modified_base (668)..(668): a, c, t, g, unknown or other
  misc_feature (668)..(668): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtcttgtctccagggganagacgcccaccctctcctgcgacggccagtcagngtgttagcagcagtctacgtacgctggtaccagcaagaacctggacctgcctccgagctccgtcactctagtcggtcgccgtaccgacggtacgggtaccctacggtcgggtccgtcgggacccggtaacgtacgggtttacgagggtcgggtaccgtacgggttcgggtaccgttttcggggaaccgtacggttaccgttaccgaccgtttcgaccgttaactccgtacgtacccgtaacgtacggtaccggtaggaaccgtaccggtaagttacgtttccgtacgtaggttaactttacgttaccgttataaccggtagtccgtttgtttaccggttcctaccgttcctccgttattccgttaacgttcgttaccggccgttacgggttaccnggtacgtacgg

SEQ ID NO: 157936 - DNA, 573 bp, Homo sapiens
  misc_feature: GYAE6OF02GLMNV.24.78.H01.1.454.CMB.1.raw
  modified_base (243)..(243): a, c, t, g, unknown or other
  misc_feature (243)..(243): n is a, c, g, or t
  modified_base (438)..(438): a, c, t, g, unknown or other
  misc_feature (438)..(438): n is a, c, g, or t
  modified_base (447)..(447): a, c, t, g, unknown or other
  misc_feature (447)..(447): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgttctttgtcctccgagggganagacgcccaccctctcctgccagggccagtcagagtgttagcagcagctacttagcctggtaccagcaagaaaccgtggcctggcctcccgaggtcctccgtcatctatcggtgccgtccacgagggccacgtggctcggcgactggttcagtcggcaggtgtcgtttgggacagtactcactctcatcatcgangactggacncgtagtatttcgactagtgttatatgtacagttcgttacggtttcggtacccttcttcccttacttacgttcgtttaaccttacggttttcggacccgttacgggttcccgtaggtcgttaacggg

SEQ ID NO: 157937 - DNA, 553 bp, Homo sapiens
  misc_feature: GYAE6OF02FM89Q.24.78.H01.1.454.CMB.1.raw
  modified_base (366)..(366): a, c, t, g, unknown or other
  misc_feature (366)..(366): n is a, c, g, or t
  modified_base (391)..(391): a, c, t, g, unknown or other
  misc_feature (391)..(391): n is a, c, g, or t
  modified_base (404)..(404): a, c, t, g, unknown or other
  misc_feature (404)..(404): n is a, c, g, or t
  modified_base (423)..(423): a, c, t, g, unknown or other
  misc_feature (423)..(423): n is a, c, g, or t
tcagactactatgtcacgaccggtgctcgatttagtgtgagtagtttgggtttggggagaggagcccagcactagaagtcggcggtgtttccattcggtgatcagcactgaacacagaggactcaccatggagtttgggctgagctgggttttcctcgtcgcttcttttaagaggtgtccagtgtcaggggcagctggtggagtctgggggcggcgtggtccaacctgggaggtccctgagactctcctgtgcggcctcccgattcaccttcaatacttatggcatgcactgggtccgccaggcctccgagggcaaggggctggagtggggtggccgctatcttatttgattgggaatatcaattnttatgcagactcgtgaaggccgttnacctatctcaganacaattccaacaatctctnttctagtcaaatgactgctgctatctgagacacggcttgtctattacgtgtagcgaaacgtccgttccccggtcccttacttaccgtatttacggttcggggtaccgaccccctacgtgtccggtaccgg

SEQ ID NO: 157938 - DNA, 548 bp, Homo sapiens
  misc_feature: GYAE6OF02IROQI.24.78.H01.1.454.CMB.1.raw
  modified_base (199)..(199): a, c, t, g, unknown or other
  misc_feature (199)..(199): n is a, c, g, or t
tcagactactatgtcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgtctccagggganagagccaccctctcctgcagggccagtcagagtgttagcagcagctactagcctggtaccagcagaacctgctggctccagctctcatctatggtgcgtccaccgaggccacgtcggcgtcgcgacaggtcagtggctaggtggtcgtttggactacgtacttcactcgtcactcatcgacagacgtaggacgacccgtaagtactttgactagttgtaattactgtcagtctgttcgtcctctccgtctagtcgttactacgtttcgccgtaggttcctaggtccgtaggacgtacgtacgaacggtccgtaacgttcggtacggtcctcggacctaccgtagttccg

SEQ ID NO: 157939 - DNA, 533 bp, Homo sapiens
  misc_feature: GYAE6OF02F3L5J.24.78.H01.1.454.CMB.1.raw
  modified_base (239)..(239): a, c, t, g, unknown or other
  misc_feature (239)..(239): n is a, c, g, or t
  modified_base (340)..(340): a, c, t, g, unknown or other
  misc_feature (340)..(340): n is a, c, g, or t
  modified_base (442)..(442): a, c, t, g, unknown or other
  misc_feature (442)..(442): n is a, c, g, or t
  modified_base (462)..(462): a, c, t, g, unknown or other
  misc_feature (462)..(462): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcacctgtctttgtctccagggganagagccaccctctcctgcagggccagtcagagtgttagcagcagctactgcctggtaccagcagaacctggcctggcctcccaggctcctcatctatggcncgtccacgcggccactggcgtcgacggacaggttccaggttcggcaggtggcgtttgggacaggtacttcactctcatcatcgacagactggacgccaagtntttgctagtgttacttactntcgtagtcttgtttcgtcccttctccttcctagtcgttacttcgtttcggcctagggttccaggtgtacgg

SEQ ID NO: 157940 - DNA, 654 bp, Homo sapiens
  misc_feature: GYAE6OF02J010S.24.78.H01.1.454.CMB.1.raw
  modified_base (171)..(171): a, c, t, g, unknown or other
  misc_feature (171)..(171): n is a, c, g, or t
  modified_base (417)..(417): a, c, t, g, unknown or other
  misc_feature (417)..(417): n is a, c, g, or t
  modified_base (642)..(642): a, c, t, g, unknown or other
  misc_feature (642)..(642): n is a, c, g, or t
tcagactactatgtcacgaccggtgctcgatttagtgtgagtagtttgggtttggggagaggagcccagcactagaagtcggcggtgttccattcggtgatcagcactgaacacagaggactcaccatggagtttgggctgagctgggttttcctcgtcgctcttttaagnggtgtccagtgtcaggggcagctggtggagtctgggggcgcgtggtccaaccgtgggaggtccctggagactctcctgtgaccggcctacccgattccaccttcaattacctagtggcatcgctacgtggggtccgccgtaggcctacccgagggccaaggggccttaggggcggtggggtcggaccggtctaatccgtttagtttgaagtaggtaaagtactacgaaatttacttagtagcgtanacgttcccgtagggaaccggggttccctacacctagtcgctagacgactaactaccgaactaagtacctacttgttctactaacaagttacgtaacgtacgtcggtaacgttcgatttaccgaggtacggaaccttacgggacttgtaccttaattaaccggtgtacgacgtaacggtcccttccggtacctttcgtaactgttacggtcgggtacccacccgtnagtcggtaccgg

SEQ ID NO: 157941 - DNA, 783 bp, Homo sapiens
  misc_feature: GYAE6OF02G5RVM.24.78.H01.1.454.CMB.1.raw
tcagactactatgtcacgaccggtgctcgatttagtgtgagtagtttgggtttggcacgaccggtgctcgatttagtgtgagtagtttgggtttggggagagctgctcagttaggacccagaggaacatggaaacccagcgcagcttctcttcctctgctactctggctcccagccatcaccggagaattgtagttgacgcagtctccaggcacccttgtctttacgctccgaggggtacgagacgcccacccttcgtccctggacgacggggtccacgtccgagtacggtagttagaccagcgaacgtcgtactttaacgccgttacgggtaacccaggtaccaacggtaaaacccgttgggcccttcgggaccctttcccggaaggtcccgttacgtacctaactcgttaacgtgggtacgccgttaccgaccgtacgggcctacggtacggtaccggtaccgcgggacctaaggggtttccaacgggtttcgggacgtacggttcgggacgttttcgggaacgtacgtacgttactaaccgtctacgtacttcgaactttcgaacgtacgtacgtcgaccggtaccgtaacgtacgtttagacgtaacggttacgttaactttacgtacgttccgtagttccggtttcggttttaccgttaccccggttcccgttaaccgtttacccgtttaaccgttaccggttttaaccgttccggtttttaacccgggtccggtttaaacccgggtttcccggtaacgggtttaccgttaaccgggg

SEQ ID NO: 157942 - DNA, 603 bp, Homo sapiens
  misc_feature: GYAE6OF02IBIOH.24.78.H01.1.454.CMB.1.raw
  modified_base (281)..(281): a, c, t, g, unknown or other
  misc_feature (281)..(281): n is a, c, g, or t
  modified_base (300)..(300): a, c, t, g, unknown or other
  misc_feature (300)..(300): n is a, c, g, or t
  modified_base (336)..(336): a, c, t, g, unknown or other
  misc_feature (336)..(336): n is a, c, g, or t
  modified_base (361)..(361): a, c, t, g, unknown or other
  misc_feature (361)..(361): n is a, c, g, or t
  modified_base (367)..(367): a, c, t, g, unknown or other
  misc_feature (367)..(367): n is a, c, g, or t
  modified_base (370)..(370): a, c, t, g, unknown or other
  misc_feature (370)..(370): n is a, c, g, or t
  modified_base (372)..(372): a, c, t, g, unknown or other
  misc_feature (372)..(372): n is a, c, g, or t
tcagactactatgtcacgaccggtgctcgatttagtgtgagtagtttgggtttggggagaggagcccagcactagaagtcggcggtgtttccattcggtgatcagcactgaacacagaggactcaccatggagtttgggctgagcttgggttttcctcgtcgctcttttaagaggtgtccagtgtcaggggcagctggtggagtcgtgggggcgcgtggtccaacctgggagtccctgagactctcctgtgcggcctccgattcacctttcaattacttanggcatgcacgttgggtccnccgaggctcccgaggccgaaggggctgggagtgggnggccgctatcttattgatggaatanctaatntangnagactcgtagagggtcccgtcactactctacagacaactactaccaaataacttacttacttcgttttactacgtaactaagtagtacctacgcctagcgtagtacgtagtacgaccgacggtactcgttactaagttaccgtgtacgtacgtaacggtccgttaccccgtaccctttcgttaaccgtagtttacgttcggggtcccgtccccgtagtacgtgggtaccgg

SEQ ID NO: 157943 - DNA, 724 bp, Homo sapiens
  misc_feature: GYAE6OF02HAJFL.24.78.H01.1.454.CMB.1.raw
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccgagccaccgtgttctttcgtcctccggagggagacgcgacccaccctctcctgcgacggccagtcagtgttgtacgcagcgacgccttaacgtcgccgttacggtaccgacgacgaacgtaaccggtcggtccgtcggacctccggacgtccttccgtactacttccgtaggtcggtaccgtcccgtaccgaccggacggcctacggtcggccggtaccggaccgggtaacttcgggtcgagggtcggacgtacgggttcggttcggttacgggactacgttaccttcgtacttcgtcgtaactctaacgtacgaacgtacgtacgtggaaccggaccgttaagtttacgttcgaacggttaggttaacttacgttacggtcgtacgtacgttcgtttcggttttacccgtcccgtttccctttacccgttacgtttacgttaaccgtttaccgtttaccggttttaccgggacccgggtttaccgggtcggttacgggtccggttaacggg

SEQ ID NO: 157944 - DNA, 786 bp, Homo sapiens
  misc_feature: GYAE6OF02IPVMO.24.78.H01.1.454.CMB.1.raw
  modified_base (172)..(172): a, c, t, g, unknown or other
  misc_feature (172)..(172): n is a, c, g, or t
  modified_base (271)..(271): a, c, t, g, unknown or other
  misc_feature (271)..(271): n is a, c, g, or t
  modified_base (298)..(298): a, c, t, g, unknown or other
  misc_feature (298)..(298): n is a, c, g, or t
tcagactactatgtcacgaccggtgctcgatttagtgtgagtagtttgggtttggggagaggagcccagcactagaagtcggcggtgtttccattcggtgatcagcactgaacacagaggactcaccatggagtttgggctgagctgggttttcctcgtcgctcttttaagnggtgtccagtgtcaggggcagctggtggagtcgtgggggcgcgtggtccaacgtgggaggtccctgagactctcctgtgcggcctccgatttcaccttnaatcttatggcatgcacgtcgggtccnctacggcctccgaggcgaacggggctggacggtgggtcggccgctatcgttagttgatggtaaagtaactctaaagttattatggtacaagtaccgtaccggtaggaacggggtcccggtttacaacctacgttaccgtaccgtaacgaacggtaaacctaaaccgtttacccgtaaaactaaacttaacccgttacctttacggttttaccgtaacggttaacccttaaaagttaccggtaaccgttaacggtaacccgtcggtaaccgttaacttaccggttaacggaaacgggtacccggtaacccggtaccgttaccgtttaaccgttaaacgtttaaccgttcgggtacggttaaccggttaaaaccggtccccgtttaccccccgggttaccctttaacccgtttaaccgttaacggttttaacggttccggggttaccccggtaccccccgtttaacgtaccggtaccgggttaacccggg

SEQ ID NO: 157945 - DNA, 555 bp, Homo sapiens
  misc_feature: GYAE6OF02G5NFR.24.78.H01.1.454.CMB.1.raw
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggctccagccatcaccgggagaattgtgttgacgcagtctccaggcaccctgtctttgctccgaggggagagagccacctctcctgcagggccagtcagagtgttagcagcagctatagcctggtaccagcaagaacctggcctggcctccgaggcctcctcatctagtggtcgccgtaccaccgaggcctacgtcggcgtcgacggtacaggttcaggtcggacaggttcggtcgtttagggactagtaccttcgacttctctatcatcgacagctcggacgaccgtaagtactttgaccgtagtgtattacgtgacgtgtcgttgttcgtccctcgtcctctatcgttacttacgtttcggtacgtacgggtctaggtcgtagg

SEQ ID NO: 157946 - DNA, 625 bp, Homo sapiens
  misc_feature: GYAE6OF02GF5V6.24.78.H01.1.454.CMB.1.raw
  modified_base (302)..(302): a, c, t, g, unknown or other
  misc_feature (302)..(302): n is a, c, g, or t
  modified_base (465)..(465): a, c, t, g, unknown or other
  misc_feature (465)..(465): n is a, c, g, or t
  modified_base (481)..(481): a, c, t, g, unknown or other
  misc_feature (481)..(481): n is a, c, g, or t
tcagactactatgtcacgaccggtgctcgatttagtgtgagtagtttgggtttggggagaggagcccagcactagaagtcggcggtgtttccattcggtgatcagcactgaacacagaggactcaccatggagtttgggctgagcttgggttttcctcgtcgcttcttttaagaggtgtccagtgtcaggggcagctggtggagtcgtgggggcggcgtggtccaaccgtgggacgtccctgagactctcctgtcgcgcctccgattccaccttcaatactatgcatcgcacgtcgggtccnccaggcctccgaggcgaacggggctgggagtggggtcggccgcttatcctttagttgattgggaaagtaatctaaattattagtcgacaggtactccggtaggaacgggtccgttacacctatcctaccagacactactaccaataatactattcgttactanacaatgactacgtccngcgtatcgtagacgacgacggtcttacgtacttacttacgttggtacgtacggtaacgtccgtttacccccggtcctttaccgttaccgttagtttacggttcggggttccccgtacccccgttacgacgttaccgggtaccgg

SEQ ID NO: 157947 - DNA, 620 bp, Homo sapiens
  misc_feature: GYAE6OF02F17G8.24.78.H01.1.454.CMB.1.raw
  modified_base (200)..(200): a, c, t, g, unknown or other
  misc_feature (200)..(200): n is a, c, g, or t
tcagactactatgtcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgtctccgagggganagacgccaccctctcctgcagggccagtcagagtgttagcagcagctactagcctggtaccagcagaaacctggcctggcctccaggcctcctcatctagtcggtcgccgtccaccgagggccacgtcggccgtcggcggacaggttcaggtggctaggtcgggtctttgggacaggtacttcacttctctatcactcgacacgacgtggacgacccgaagtactttcgactagttgttacttacgttcgtctagtaccgtttggtttccggttcccttacgttcctttaccttacgtttacgttaccgttaccgttttcgggtccgttaccggggtttccgacggtccgtagggtaacggtacgtacgtaacggtaccgtaacgttggtacggtcttacggtacctaccgtacgttacg

SEQ ID NO: 157948 - DNA, 633 bp, Homo sapiens
  misc_feature: GYAE6OF02JL192.24.78.H01.1.454.CMB.1.raw
  modified_base (276)..(276): a, c, t, g, unknown or other
  misc_feature (276)..(276): n is a, c, g, or t
  modified_base (288)..(288): a, c, t, g, unknown or other
  misc_feature (288)..(288): n is a, c, g, or t
  modified_base (366)..(366): a, c, t, g, unknown or other
  misc_feature (366)..(366): n is a, c, g, or t
  modified_base (372)..(372): a, c, t, g, unknown or other
  misc_feature (372)..(372): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagaggaaccatggaaaccccagcgcagcttctcttcctcctgctactctggctcccagcccatccgaccggaggaattgtgttgacgcagtctccgaggcacctgttctttagctaccgagggacagacgccaccctctcctagcaggccagtcagntgttagcagcanctactacgcctacggtaccagccaagaacctggcctaggcctccgaggctcctcagtctgtggtacgccgtaccacgnggaccncgtcggccgcgcgaacgtggtccagggtcgcgagtggtacgtttcgggaacacgtacgttccacgttctactactcctagtacgtaacacgttctacggaccgcccggtaagttactttcggacctaggttacgttaatttacgtcgtcgtaacgtcgtttgtttcggtacccctttcgtacccgtttccgtagttaaccgttaccgtttaccgttttaccgggtacccttaccgggtttccgttaggcccgtttaagggg

SEQ ID NO: 157949 - DNA, 639 bp, Homo sapiens
  misc_feature: GYAE6OF02H2EOK.24.78.H01.1.454.CMB.1.raw
  modified_base (241)..(241): a, c, t, g, unknown or other
  misc_feature (241)..(241): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggctcccagccatcaccggagaattgtgttgacgcagtctcaggccaccctgttcctttgctccgagggganagacgcccaccctctccgtgccgagggccagtcagagtgttagcagcagctacttagcctgtaccagcagaaccgtggcctggcctcccgaggtcctccgtcacttctaagtcggtacgcccgtccaaccgacgggccctaacgtcggccgttacggccggaacgtacgggttccagggtccggacgtacggtcgggtacgttttcggggaactacgtaccttcaaccttctctattctatcgaagtacgtacgtacggacgtacccggtaaagttcgtttacgacgtaggttagttacttacgtcgtacgtacgtcgttacggttcgtcccgtcttaccttctacgttcgttaccgttacgttttcgggccgggtttaccgaggttacgtggtaacg

SEQ ID NO: 157950 - DNA, 611 bp, Homo sapiens
  misc_feature: GYAE6OF02HHHP8.24.78.H01.1.454.CMB.1.raw
  modified_base (270)..(270): a, c, t, g, unknown or other
  misc_feature (270)..(270): n is a, c, g, or t
  modified_base (295)..(295): a, c, t, g, unknown or other
  misc_feature (295)..(295): n is a, c, g, or t
  modified_base (363)..(363): a, c, t, g, unknown or other
  misc_feature (363)..(363): n is a, c, g, or t
  modified_base (397)..(397): a, c, t, g, unknown or other
  misc_feature (397)..(397): n is a, c, g, or t
tcagactactatgtcacgaccggtgctcgatttagtgtgagtagtttgggtttggggagaggagcccagcactagaagtcggcggtgtttccattcggtgatcagcactgaacacagaggactcaccatggagtttgggctgagctgggttttcctcgtcgctcttttaagaggtgtccagtgtcaggggcagctggtggagtctgggggcggcgtggtccaaccgtgggagtccctgagactctcctgtgcggcctccgattcaccttnaatcttatggcatgcactgggtccnccaggtcctccgaggcaaggggctgggagtgggtcgccgctatcttattgatggaatatcaatattangcagtactcggtgaacggggtccgttacaccgtntcctccgagacgaacctaattacccaaactaactacctcttcgttttactagactaaagttcgaaccttacgcctggaccgtagttacgtgacggaccacggtcttcgtactattaccgtgtacgacgtaaacggtccttacccccggtacctttacccgttacggtatttacggttcggggtacccgtcccccttagtaccgtggtaacccgg

SEQ ID NO: 157951 - DNA, 560 bp, Homo sapiens
  misc_feature: GYAE6OF02F6F3O.24.78.H01.1.454.CMB.1.raw
  modified_base (240)..(240): a, c, t, g, unknown or other
  misc_feature (240)..(240): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgtctccagggganagagccaccctctcctgcagggccagtcagagtgtagcagcagctacttagcctggtaccagccaagaaacctggccctggcctcccaggcctcctcatctagtggtcgccgtccacagggcccacgtcggccgtcgcggactagggttcaggtcggcgaggtggtcgtttgggacacgtacttcaccttctcactctatcgacagacgtggacgacccgaagtatttgactagttacgttattacgtgtcgagtcgttcgttcgtccgtctccttcctatcgttactcgtttcggccgttagggtcctaggtcgtacgg

SEQ ID NO: 157952 - DNA, 697 bp, Homo sapiens
  misc_feature: GYAE6OF02IMHPE.24.78.H01.1.454.CMB.1.raw
  modified_base (352)..(352): a, c, t, g, unknown or other
  misc_feature (352)..(352): n is a, c, g, or t
  modified_base (394)..(394): a, c, t, g, unknown or other
  misc_feature (394)..(394): n is a, c, g, or t
tcagactactatgtcacgaccggtgctcgatttagtgtgagtagtttgggtttgggggaggaggagcccagcactagaagtcggcggtgtttccattcggtgatcagcactgaacacagaggactcaccatggagtttgggctgagctgggttttcctcgtcgctctttttaaagaggtgtaccagtcgtcgagggcagctggtggagtcgtggggcgcgtcggtccaaccgtgggacgtccctgagactctcctgtcgccggcctccgattccaccttcaatacttatcggcagtgccacgtgggtccgccaggcctcccgaggcgaaggggctgggagtgggtcgccgtntattctttagttgattagggaagttactactaaatttattancgtacacgtacctacggtagaacgggtccgtttaccacctactcctaccgagaacgaactaacttacccaaactaacttacctactttcgtttctacgtactaaagtcgtaacgtaacgtccgtgacgtacttacggtacggaacggtaccgaacggttctttacggttactttaacgttaccgttaggtacgaaccggttaacgttccccgtttacccccgggtacctttttaacgtaaccgttacggttttacggttcgggggttaccccgtaccccgtaagtcggtacgggttacccggg

SEQ ID NO: 157953 - DNA, 717 bp, Homo sapiens
  misc_feature: GYAE6OF02JT443.24.78.H01.1.454.CMB.1.raw
  modified_base (254)..(254): a, c, t, g, unknown or other
  misc_feature (254)..(254): n is a, c, g, or t
  modified_base (386)..(386): a, c, t, g, unknown or other
  misc_feature (386)..(386): n is a, c, g, or t
  modified_base (667)..(667): a, c, t, g, unknown or other
  misc_feature (667)..(667): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaacccccagcgcagcttctcttcctcctgctactctggcctcccagccctatccgaccggaggaatttggtgttgacgtcagttcctccaggccaccctgttctttcgctccgaggggangacgccaccctctccgtgccgtacgggccagtccagagttagttacgcagccgagtccttacgttagcccttacgggtacccaggtaccaacgtaaccgtcggaccttgacctcccgaacgtccttccctanaccttcgtaacgttggtacgcccgttacccgaccggtcggtccctacggtcgggtcgtaccggaccggtactacgggttaccgagggtccggacggaggtttcggtacggttttacgggactaacggtacccttaccgtaacgttacgtccctaggttacctacgttaccgaacgtaccgtacggtacggacccggacgttaacgttcgtttacgtcgtagtttcgttaacgttctcggacctaggttatttcgggttacttcccgtctttccgttacctnttccgttaccttcgggtttaacgccggtaccggtttcacgggtctacggg

SEQ ID NO: 157954 - DNA, 555 bp, Homo sapiens
  misc_feature: GYAE6OF02FJ12D.24.78.H01.1.454.CMB.1.raw
  modified_base (334)..(334): a, c, t, g, unknown or other
  misc_feature (334)..(334): n is a, c, g, or t
tcagactactatgtcacgaccggtgctcgatttagtgtgagtagtttgggtttggggagaggagcccagcactagaagtcggcggtgtttccattcggtgatcagcactgaacacagaggactcaccatggagtttgggctgagctgggttttcctcgtcgctcttttaagaggtgtccagtgtcaggggcagctggtggagtctgggggcgcgtggtccaaccgtgggaggtccctgagactctcctgtgcggcctcccgattcaccttcaatacttatggcatgcacgtgggtccgccaggctccaggcaaggggctggagtgggtggccgntatcttatttgatggaatatcaatattatgacagactcggtgaacgggtccggttacaccatctccagagacaataccaacaatactctgttctgtacaatgactagcctgcgtatcgtgaggaccacggtctgtactattactgtgacgaacgtacgttccccggcccttcttaccgatttacgttcggggtaccgtccccctacgtacgtcggtaccgg

SEQ ID NO: 157955 - DNA, 776 bp, Homo sapiens
  misc_feature: GYAE6OF02HHPUF.24.78.H01.1.454.CMB.1.raw
  modified_base (244)..(244): a, c, t, g, unknown or other
  misc_feature (244)..(244): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagaggaaccatggaaaccccagcgcagcttctcttcctcctgctactctggctcccagccatcaccggaggaattgtgttgacgcagtctccgaggccaccctgttctttgtcctccgagggganagacgccacctctccctgcacgggcagtcgagagtgttagcacgcagcttacttacgccgtacggtaccacgacgaacggtaaacccgtcggtaccctcggcccttaccccggaaggttcccctccccgttctaacgttaccgtaagttcgggtccgtcccggtacccaaaccgggtacggccctacgtcggggacccggtcccggtaccgggaaccgttaacgggtttaccgcggggtttacgggaccgtacgggttcgggtaccggtttttaggggaaacccgtacggtacccgttaccggtacttaccgtaccgtaacttaccgtaacgtacccgtaacgtaacgtacgtacgggtaaccgacccggtaagttacgttttacgacgtacgttacgtttacgtacgttctacgacgttcgtttcggtttccggttacccttccgttacccttacgttacctttaccgttaccgtttaccggttttccggtaccgggtttaaccgggtccggttaccggtcggttaacggg

SEQ ID NO: 157956 - DNA, 603 bp, Homo sapiens
  misc_feature: GYAE6OF02GCIKK.24.78.H01.1.454.CMB.1.raw
  modified_base (295)..(295): a, c, t, g, unknown or other
  misc_feature (295)..(295): n is a, c, g, or t
tcagactactatgtcacgaccggtgctcgatttagtgtgagtagtttgggtttgggggaggagcccagcactagaagtcggcggtgtttccattcggtgatcagcactgaacacagaggactcaccatggagtttgggctgagctgggttttcctcgtcgctcttttaagaggtgtccagtgtcaggggcagctggtggagtcgtgggggcggcgtggtccaacctgggaggtccctgagactctcctgtgcggcctccgattcaccttcaatacttatgcatgcactgggtccnccgaggctccgaggccgaaggggctgggaggtgggtggccgctatcttatttgatggaagtaatcaattattatgacagaccttcgtaggaacgggtccgttacaccatctaccagacgacaacttaccaaactaaatactcttgtttctgtactaaatgactacgtctgacatctagacgacgaccggtcttgtacttagttactgtacgacgtaacgtaccgttcccccggtacctttaccgttaacgtagtttaggttccggggttaccggtacccccgttagtacggttacggtaccgtccggg

SEQ ID NO: 157957 - DNA, 685 bp, Homo sapiens
  misc_feature: GYAE6OF02INIGF.24.78.H01.1.454.CMB.1.raw
  modified_base (252)..(252): a, c, t, g, unknown or other
  misc_feature (252)..(252): n is a, c, g, or t
  modified_base (272)..(272): a, c, t, g, unknown or other
  misc_feature (272)..(272): n is a, c, g, or t
tcagactactatgtcacgaccggtgctcgatttagtgtgagtagtttgggtttggcacgaccggtgctcgatttagtgtgagtagtttgggtttgggagagctgctcagttaggacccagagggaaccatggaaacccccagccgcagcttctcttcctcctgctactctggcctcccagccatccaccggaggtaacttgtgttgacgcacgttctccgaggccacccgtgtcttttgtctaccgaggganacgacgcctaccctctccgngcgacggccacgtcgagacgtgtacgcaagcaggctaactgcctggtacccagtcaacgaaaccgtcgacctcggcctacccgacggcctacctcttacgtctacgtggtcgtcccgtaccgaccgtacggggccctaccggttcggccggttcgccggaaaccgtcgggttaccacgggtacggcgtaggtcggtacggtttgggaaccgtacggtacttaccgtaccttacctcgacctactaccgcgtaccgtacgtacgtacgacgtccgtaacgtaagttacgtttacgtacgttaagtttcttacgttagtacgagtaccgtaccgttagaaccgtacgtaccggccttaaccggttccggaccgttacggacccgtagtaacccgtacggtactaccgtaacccgg

SEQ ID NO: 157958 - DNA, 720 bp, Homo sapiens
  misc_feature: GYAE6OF02INBBE.24.78.H01.1.454.CMB.1.raw
  modified_base (203)..(203): a, c, t, g, unknown or other
  misc_feature (203)..(203): n is a, c, g, or t
  modified_base (209)..(209): a, c, t, g, unknown or other
  misc_feature (209)..(209): n is a, c, g, or t
tcagactactatgtcacgaccggtgctcgatttagtgtgagtagtttgggtttgggggagagctgctcagttaggacccagagggaaccatggaaaccccagcgcagcttctcttcctcctgctactctggctcccagccatccaccgggaggaattgtgttgacgcagtctccaggcaccctgtctttgtctccgagggganaggacncccacccttctcctgcacgggccagtcgagtagtgttagcacgcagcttacgtagcctggtaccagcacgaacctggaccgtggcctccgaggtcctcctctatctagttcggtcgccgtccaccgacggacctaccgtcggcgtcgccggacgtaggttccgaggtcggacgtaggtcggttcgtttacggggactacggtacctttaccgacctttaccgttacgtactttaacctacgttaccggaacgtaacggtaccggttacggggtacccggtaacccggttaaaggtttacgttttacggtacgttaacggtttcgtttaaacgttttacgttcggttacgtacgtttacgtttcggttttacccgttcccttccgttaccctttacttacgttcgtaccgtttacgtttccggtacgttaccgggtttaccgaggttcgtacggtagtacgtacgtaacggtaccgtaacgttgtcggtccgtacgtaccgtacctagttcg

SEQ ID NO: 157959 - DNA, 718 bp, Homo sapiens
  misc_feature: GYAE6OF02IEIQ0.24.78.H01.1.454.CMB.1.raw
  modified_base (239)..(239): a, c, t, g, unknown or other
  misc_feature (239)..(239): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggctcccagccatcaccggagaattgtgttgacgcagtctccaggcacctgtctttgtctccgagggganagagccaccctctcctgcgacggccagtcaggagtgttagcagcagtctacttcgccgttggtaccagacaacgtaacctcggcctaggcctcccgacggtcctcctactactcgtagtcggtcgccgtccaccgacggccacgtcggaccgtcggacggacgtacggttcagggtcggacgtaggtcgggtacgtttcggggaactacggttaccgtttctaaccgttccgttacctaacgttaccgtaacttaccggaaaccgtacggtaaccggtacgggaaccggtaccccggttaaagttacgttttacggacgttacggttacgtttaacgtttacgttacgttacgtacggttccgttttcgggttttacccggttccccgtttaccgttccccgtttaccgttacgttacgtttaacccgtttcggttttaccgggtaccgttacgggtttaccgtacgggtcgttacggg

SEQ ID NO: 157960 - DNA, 569 bp, Homo sapiens
  misc_feature: GYAE6OF02ICTE5.24.78.H01.1.454.CMB.1.raw
  modified_base (198)..(198): a, c, t, g, unknown or other
  misc_feature (198)..(198): n is a, c, g, or t
  modified_base (230)..(230): a, c, t, g, unknown or other
  misc_feature (230)..(230): n is a, c, g, or t
  modified_base (259)..(259): a, c, t, g, unknown or other
  misc_feature (259)..(259): n is a, c, g, or t
tcagactactatgtcacgaccggtgctcgatttagtgtgagtagtttgggtttggggagagctgctcagttaggacccagagggaaccatggaaaccccagcgcagcttctcttcctcctgctactctggctccagccatcaccggaggaattgtgttgacgcagtctccaggcaccctgtctttgtctccagggganagagcccaccctctcctgcagggccagtcagngtgttagcagcagctactgcctggtaccngcagaacctggcctggctccaggctcctcatctatcggtgcgtccaccgacggcctacgtggtccgtcggcggactaggtttcaggtacggccaggtggctttcgggactacgtacttcacgtctacatactactacgacaggactaggacgaccgaagtacgtttcgcgtagtgttattactgtctagtcttggttgtcctctacctctactgttacttcgtttcgccgtacgggttcacgggtctacgggatacgtacgtaacgtacgtaacggttcgtcgggtctacggtacctaccgtagttaccg

SEQ ID NO: 157961 - DNA, 947 bp, Homo sapiens
  misc_feature: GYAE6OF02JWZK8.24.78.H01.1.454.CMB.1.raw
tcagactactatgtcacgaccggtgctcgatttagtgtgagtagtttgggtttgggggaggagcccagcactagaagtcggcggtgtttccattcggtgatcagcactgaacacagaggactcaccatggagtttgggctgagctgggttttcctcgtcgcttcttttaagaggtgtccagtgtcaggggcagctggtggagtcgtggggcggcgtggtccaaccgtggggacggtccctggacgtaccgttcctcccgtggtcggcccgggtccccttccccggaatttcccaaccccttttcaaaactttacctttaagtgggacctaagttcgcctaaccggttccggggttcccgaccccgaaggggtcccctaccgaacggggtccgaaaggggggtcccttaggggtaacgggttgggggttccgggaccccggtactttaacgttttccgttttaagttttaggtaacggttaacgggtaaaagttaaacttacgtaaaatttaagttttaacgtgaccgtaaggtaccgttccggttaagggaaccggggttccccggtttaacaacccgtatttacccgtaccgaaggtaacgtaaacccgttaaacgttacccctaaaaccgtaaactttaccgtttaccgtttacgtttttaccctaacggtaaaccttaaaacgttaccgtaaaccgttaaccgtcccgttacggtaccgttaacgttaccggttacgggaaccggttaacccggaaccggttcgtttacgttacctttacgttaccgttagtaccggtaaccgtaaacggtttcccccgtttaccccccggtttaccgttttaaccggtttaaccggttaaggttttaccgggtttaccgggggttaccccgtaaccccccgtttacggtaaccggtttacgggtacccggtttaacccggggg

SEQ ID NO: 157962 - DNA, 687 bp, Homo sapiens
  misc_feature: GYAE6OF02GRKLU.24.78.H01.1.454.CMB.1.raw
  modified_base (243)..(243): a, c, t, g, unknown or other
  misc_feature (243)..(243): n is a, c, g, or t
  modified_base (255)..(255): a, c, t, g, unknown or other
  misc_feature (255)..(255): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaacccccagcgcagcttctcttcctcctgctactctggctcccagccatcaccggagaattgtgttgacgcagtcctccaggccaccctgtctttgcctccgagggganagagccaccctntcctgccagggccagtcagagtgttagcagcagctacgtagccgtggtaccagctacgaaaccgtggacctggcctcccgaggcctccgtctatctagtcggtgccgtccaccgacgggccacggtcggtccgtcggaccggacgtacggttcaggtcggacgtaggtcgggtcgtttacggggaactacggtacgttaccgacgttccgtactacgtaccgtaacgtaccgacgtacgtacgtacggacggtaccccgtaaggtacgttttcgacgttacgttacgttaacgttaccgttcggttacgtacgtccggtttcgtttacggttcccgttcccgttacccgttacccttaacgttaccggttaacctttaccggttttacggtacccgttaaccggggtttaccctacgggtaccgttaacggg

SEQ ID NO: 157963 - DNA, 722 bp, Homo sapiens
  misc_feature: GYAE6OF02G3DIM.24.78.H01.1.454.CMB.1.raw
  modified_base (246)..(246): a, c, t, g, unknown or other
  misc_feature (246)..(246): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggctcccagatcgccaccggagacattgtgttgacacagtcctccagcctaccctgtctttgtctccgagggaaacngccaccctctcctgcgagggccagtcgacaagttggttaaggtaagttgttacgccttaggtactacaaacaacaaacagtcggccaggccctcccggctcctcaacttcgtatcgatcgcactccgaaagtacgggccacgtggccacgtccagtacgtacgttacgaggtcggacgtagggtcggtcgtagggaactacgtaccgttccacgtacctccaccctataccagtacgtaagtaggtaacggtacgtaccgttaggtaaacgtttcgttttacgggtaccggtttttaaccgtacgttcgttaccgtaacgtccgtaacgggttcccgttacccggtccggttacccgggaccccggtttaaccgggttttaaccggggttccccgggggtacccggggggtaacccgttacggtacccggttaccgggtaaccctaacccgtaacccggtaaacccggttaacggg

SEQ ID NO: 157964 - DNA, 588 bp, Homo sapiens
  misc_feature: GYAE6OF02F3NRD.24.78.H01.1.454.CMB.1.raw
  modified_base (240)..(240): a, c, t, g, unknown or other
  misc_feature (240)..(240): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaacccccagctcagcttctcttcctcctgctactctggctcccagccatcaccggaggaattgtgttgacgcagtctccaggcacctgtctttgtctccagggganagagccaccctctcctgcagggccagtcagagtgttagcagcagctacttagcctggtaccagcagaacctggcctggcctcccgaggtcctccgtcatctagtggtgccgtccaccgtagggcccacgtcgggccgtcggaccggactagggttcagggtcgacgaggtcggtcgtttgggactaggtacttctactcctcatcactacgacagacgtggacgaccgtaagtacgttttcgacgtagttgttattactcgtacgtagtcgttcgttcggtcccttctccttactacgttcgttacgttaccgttttcggaccgttacgggtccgtacggtgtacggg

SEQ ID NO: 157965 - DNA, 651 bp, Homo sapiens
  misc_feature: GYAE6OF02HZW92.24.78.H01.1.454.CMB.1.raw
  modified_base (241)..(241): a, c, t, g, unknown or other
  misc_feature (241)..(241): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaacccccagcgcagcttctcttcctcctgctactctggcctcccagccatcaccggaggaattgtgttgacgcagtctccaggcaccctgtctttgctccgaggggnagagcccaccctctcctgcagggccagtcagagtgttagcagcagctacttagcctggtaccagacacggaacctcggcctggcctcccgaggcctcctcatctagtcggtcgccgtccaccgcgggccacgtggacgtcgcggactagggttcaggtggcgtaggtcggtcgtttgggactagtcttctactctacatcactcgacgacgacgtcggaacgtcccgtaagttagtttacgacgtaggttagttaactttaccgtgttacgtaaggttccgttttacggttttcccggttcccctttacccgtttcccgtttaccgttaacgtttaccggttaacgtttacccggtttttcgggtaccccggtttacggggtttcccgtaccgggttccggttaacgggg

SEQ ID NO: 157966 - DNA, 582 bp, Homo sapiens
  misc_feature: GYAE6OF02F8SW0.24.78.H01.1.454.CMB.1.raw
  modified_base (243)..(243): a, c, t, g, unknown or other
  misc_feature (243)..(243): n is a, c, g, or t
  modified_base (387)..(387): a, c, t, g, unknown or other
  misc_feature (387)..(387): n is a, c, g, or t
  modified_base (400)..(400): a, c, t, g, unknown or other
  misc_feature (400)..(400): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaacccccagcgcagcttctcttcctcctgctactctggctcccagccatcaccggaggaattgtgttgacgcagtctccaggccaccctgtctttgtctccgagggganagacgcccaccctctcctgcagggccagtcagagtgttagcagcagctactagcctggtaccagcagaacctggcctggcctcccgaggcctcctcactctagtggtcgccgtccaccgagggcccacgtcggcgtcgcggacnggttcaggtgcgnggtggtcgtttgggacagtacttcactcgtcatcgtatcgacaggactggacgaccgtagtactttgacgtagttagttacttagtcgtcgtagttcttgtttccggtcccttcttcccgttacttacttacgttaccttacgttttccggccggttacggttcccgtaggtccgttacggg

SEQ ID NO: 157967 - DNA, 587 bp, Homo sapiens
  misc_feature: GYAE6OF02GAJ4M.24.78.H01.1.454.CMB.1.raw
  modified_base (301)..(301): a, c, t, g, unknown or other
  misc_feature (301)..(301): n is a, c, g, or t
  modified_base (335)..(335): a, c, t, g, unknown or other
  misc_feature (335)..(335): n is a, c, g, or t
  modified_base (354)..(354): a, c, t, g, unknown or other
  misc_feature (354)..(354): n is a, c, g, or t
  modified_base (359)..(359): a, c, t, g, unknown or other
  misc_feature (359)..(359): n is a, c, g, or t
  modified_base (363)..(363): a, c, t, g, unknown or other
  misc_feature (363)..(363): n is a, c, g, or t
  modified_base (403)..(403): a, c, t, g, unknown or other
  misc_feature (403)..(403): n is a, c, g, or t
tcagactactatgtcacgaccggtgctcgatttagtgtgagtagtttgggtttggggagaggagcccagcactagaagtcggcggtgtttccattcggtgatcagcactgaacacagaggactcaccatggagtttgggctgagctgggttttcctcgtcgctcttttaagaggtgtccagtgtcaggggcagctggtggagtcgtgggggcggcgtggtccaacctgggacggtccctgacgactctcctgtcgcggcctcccgattccaccttcaatacttatggcatgcactgggccncaggctcgaggcaaggggctggagtgggtgccgntatcttattgatggaatancaatnttangacagactcgtaggaacgggccgttacaccatctacaganacaattaccaaacaactactcttacgttctagactaaattcgaactacgcctagacgtatcgtagacggtacgacgcttcgtactagttaccgtgtacgacgtaaacgtccgttaccccggtcccttacgtttaccgtatttacggttcggggttccgaccccctacgtacggtacggtaccgg

SEQ ID NO: 157968 - DNA, 535 bp, Homo sapiens
  misc_feature: GYAE6OF02FNXFI.24.78.H01.1.454.CMB.1.raw
tcagactactatgtcacgaccggtgctcgatttagtgtgagtagtttgggtttggggagaggagcccagcactagaagtcggcggtgtttccattcggtgatcagcactgaacacagaggactcaccatggagtttgggctgagctgggttttcctcgtcgctcttttaagaggtgtccagtgtcaggggcagctggtggagtctgggggcgcgtggtccaacctgggaggtccctgagactctcctgtgcggcctcccgattccaccttcaatacttatggcatgcactgggtccgccaggctccgaggcaaggggctggagtgggtggccgctatcttattgatggaatatcaatattatgcagctccgtgaagggtccggttcaccgatctccagagacaattccaacaatactctgttctgcaaatgactagcctgcgatctgagacgacgctgtctattactgtgacgaagtcttccccggccttcgttacgtatttacgttcggggtccgtcccctatacgtggtaccg

SEQ ID NO: 157969 - DNA, 619 bp, Homo sapiens
  misc_feature: GYAE6OF02FQ5ZJ.24.78.H01.1.454.CMB.1.raw
  modified_base (274)..(274): a, c, t, g, unknown or other
  misc_feature (274)..(274): n is a, c, g, or t
  modified_base (300)..(300): a, c, t, g, unknown or other
  misc_feature (300)..(300): n is a, c, g, or t
  modified_base (334)..(334): a, c, t, g, unknown or other
  misc_feature (334)..(334): n is a, c, g, or t
  modified_base (359)..(359): a, c, t, g, unknown or other
  misc_feature (359)..(359): n is a, c, g, or t
  modified_base (392)..(392): a, c, t, g, unknown or other
  misc_feature (392)..(392): n is a, c, g, or t
tcagactactatgtcacgaccggtgctcgatttagtgtgagtagtttgggtttggggagaggagcccagcactagaagtcggcggtgtttccattcggtgatcagcactgaacacagaggactcaccatggagtttgggctgagcttgggttttcctcgtcgctcttttaagaggtgtccagtgtcaggggcagctggtggagtctgggggcggcgtggtccaaccgtgggacggtccctgagactctcctgtgcggcctcccgattcaccttnaatacttatggcatgcactgggtccnccaggctcaggcgagggctggagtggggtgccgntatcttattgatggaataatcaatnttatgcagactcgtagacgggtccgttcacctntcctccagagacaattccaaactaatacttctagtttctgtacaaatgtactacgcctgacgtatcgtacggacggaccgtacggtcttcggttacttaatttacgttggttacgaccggtaaacggtacccgtttaccccccggtcccttttaccgtttaacgttacgttttaacggttccgggggttacccggtaccccccttacgtaccgtcgggttaacccgg

SEQ ID NO: 157970 - DNA, 587 bp, Homo sapiens
  misc_feature: GYAE6OF02FIFWC.24.78.H01.1.454.CMB.1.raw
  modified_base (242)..(242): a, c, t, g, unknown or other
  misc_feature (242)..(242): n is a, c, g, or t
  modified_base (399)..(399): a, c, t, g, unknown or other
  misc_feature (399)..(399): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaacccccagcgcagcttctcttcctcctgctactctggctcccagccatcaccggaggaattgtgttgacgcagtctccaggcaccctgtctttgtctccgagggganagagccaccctctcctgcagggccagtcagagtgttagcagcagctacttagcctggtaccagcacgaacctggcctggcctccgaggtctcctcactctagtggtcgccgtccaccgagggccacgtcggcgtcggcgacgtacggtcaggtcggntacggtgtcgttgggactagtacttcactctcatcatcgacgcgacgtggacgtccgtaagtagtttcgacgtaggttagttacgttacgttgtctagtcgtttggttccggtcccttccgtccttaccgttgttccgttacttacgttttcgggaccttacggggtttacccgtaggttcggtacgg

SEQ ID NO: 157971 - DNA, 689 bp, Homo sapiens
  misc_feature: GYAE6OF02HYSPN.24.78.H01.1.454.CMB.1.raw
  modified_base (330)..(330): a, c, t, g, unknown or other
  misc_feature (330)..(330): n is a, c, g, or t
  modified_base (367)..(367): a, c, t, g, unknown or other
  misc_feature (367)..(367): n is a, c, g, or t
tcagactactatgtcacgaccggtgctcgatttagtgtgagtagtttgggtttggggagaggagcccagcactagaagtcggcggtgtttccattcggtgatcagcactgaacacagaggactcaccatggagtttgggctgagctgggttttcctcgtcgctcttttaagaggtgtccagtgtcaggggcagctggtggagtctgggggcggcgtggtccaaccgtgggaggtccctgagactctcctgtgcggcctccgattcacttcaatcttatggcatgcacgtgggtccgccaggctcccgaggcaagggggctgggagtgggnggccgctatcttattgatggaagtaatcaattattangacagacctccggagtaacgggtccggttacaccgtacttctaccacggacgaactaacttacccgaaacctaacttacctcttcgttttacctagtactaaacgttacgtaacctacggacccttggtacgaacgttaccgtacggaacgggtacccgaaccgggtccgtttacggttccgttaacgttttaccgttacggttacgacggtaaaacgtacccggtttaccccccggtaccgttttaccgtttaccgttagttttacgggtttcggggttacccggttaccccccgtaacgtaccggttacgggttacccgg

SEQ ID NO: 157972 - DNA, 610 bp, Homo sapiens
  misc_feature: GYAE6OF02FF5WQ.24.78.H01.1.454.CMB.1.raw
  modified_base (244)..(244): a, c, t, g, unknown or other
  misc_feature (244)..(244): n is a, c, g, or t
  modified_base (255)..(255): a, c, t, g, unknown or other
  misc_feature (255)..(255): n is a, c, g, or t
  modified_base (329)..(329): a, c, t, g, unknown or other
  misc_feature (329)..(329): n is a, c, g, or t
  modified_base (352)..(352): a, c, t, g, unknown or other
  misc_feature (352)..(352): n is a, c, g, or t
tcagactactatgtcacgaccggtgctcgatttagtgtgagtagtttgggtttgggcacgaccggtgctcgatttagtgtgagtagtttgggtttgggggaggaactgctcagttaggacccagagggaaccatggaagcccccagctcagcttctcttcctcctgctactctggctcccagagacccaccggagaaattgtgttgacacagtctccaggcaccctgtctttgctccagggganagagccacctntcctgccagggccagccggagtgttagtaagtactaggctggtaccaacagaacctgccaggctccaggcctcncatctatgatcgtcctaccaagngggtccacgtgggccttccccgacgtagggttcaggtggctaggtcgggtctgggacaggaccttcactctcaccgtcagcacgcctagacgtcctagaagttagtttcgacggtttactacgtacgtacagtcctagtccgttaccgccgtacggccgtacgttaaccgttcggggaccgggggtaccaggggtacggaggtacgggaacgtacggtaacggttcggtcggtacgttacggaccgtaccgtattccg

SEQ ID NO: 157973 - DNA, 611 bp, Homo sapiens
  misc_feature: GYAE6OF02HO7T7.24.78.H01.1.454.CMB.1.raw
  modified_base (300)..(300): a, c, t, g, unknown or other
  misc_feature (300)..(300): n is a, c, g, or t
  modified_base (371)..(371): a, c, t, g, unknown or other
  misc_feature (371)..(371): n is a, c, g, or t
tcagactactatgtcacgaccggtgctcgatttagtgtgagtagtttgggtttgggggagaggagcccagcactagaagtcggcggtgtttccattcggtgatcagcactgaacacagaggactcaccatggagtttgggctgagctgggttttcctcgtcgctcttttaagaggtgtccagtgtcaggggcagctggtggagtcgtgggggcgcgtggtccaacgtgggacggtccccgagctctctgtgcggcctcccgattccaccttcaatacttatggctatgcacgtgggtccncgaggctccgaggcgaaggggctggaggtgggcggccgctatctttattgagtggaatatacaatatttancgacagtactccggtagaacgggtccgttcacctattcctccagacgaactaaacttccaaactaataccttcttgtttcctagactaaatgaacttacgcgtgcctatcgtaggacggactcgggcttgtacttattacgtgtacgacgtaacgtcccgttcccccggtaccctttcgttaaccgtatttacggttcggggtacccgtccccttaagtacggtaccgggtacgttcggg

SEQ ID NO: 157974 - DNA, 617 bp, Homo sapiens
  misc_feature: GYAE6OF02GICFX.24.78.H01.1.454.CMB.1.raw
  modified_base (355)..(355): a, c, t, g, unknown or other
  misc_feature (355)..(355): n is a, c, g, or t
  modified_base (406)..(406): a, c, t, g, unknown or other
  misc_feature (406)..(406): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgtctccgaggggagagacgccaccctctcctgcagggccagccggagtgttagtaagtacttaggctggtaccaacagaaacctggaccaggcctcccgaggctcctcatctatgatcgtctccaacngggtcacgtcggccgtccccgcaggttcaggtcgctaggtggtctgggacngacttcactcgtcaccgtcagcacgcctagacgcctagtaagtacttttcgacgtttactacgttgtacagtcaggtccgttccgccgtcggcccgtacgttaaccggtttccggggccgggggtaaccgtagggggttacgggaacgggtaacggggtacgtaaccgggtaacgttcgggtacgggtccgtacggacccgtaccgtacgg

SEQ ID NO: 157975 - DNA, 704 bp, Homo sapiens
  misc_feature: GYAE6OF02HAWFM.24.78.H01.1.454.CMB.1.raw
  modified_base (348)..(348): a, c, t, g, unknown or other
  misc_feature (348)..(348): n is a, c, g, or t
tcagactactatgtcacgaccggtgctcgatttagtgtgagtagtttgggtttggggagaggagcccagcactagaagtcggcggtgtttccattcggtgatcagcactgaacacagaggactcaccatggagtttgggctgagctgggttttcctcgtcgctcttttaagaggtgtccagtgtcgaggggcagcgtgggtggagtcgtggggggcggcggtggtccaaccgtggggacggtccctgacgtactctccgtgtcgccggccctcccgattccaccttcaattacttatggcatgctacgtcgggtcccgccacggcctccgaggcgaaggggctagggnggtggggtcggccgtctattctttagtttggacttagggaataatactaaattattatagctaacgtaccgtacggtaggacggggtccgttacaccacttcacgagacgactaactaccaaactaactactcttcgtttactacgaactaaagtacgtaacgtacgaccgtacggcgtagttacgtacggacgggaccgtacggtaccgttcggttaccttaacgtttactacgggtacgtaacggtaaaccggttacccggtttacccccggttaccttttacccgttacgttaacgtttacggtttcggggtacccggttacccccgtacgttacggtaccgggttaaccggg

SEQ ID NO: 157976 - DNA, 614 bp, Homo sapiens
  misc_feature: GYAE6OF02H6SHA.24.78.H01.1.454.CMB.1.raw
  modified_base (239)..(239): a, c, t, g, unknown or other
  misc_feature (239)..(239): n is a, c, g, or t
  modified_base (251)..(251): a, c, t, g, unknown or other
  misc_feature (251)..(251): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgctccagggganagagccaccctntcctgcagggccagtcagagtgtagcagcagctacttagcctaggaccagcagaaacctggcctggcctcccaggctcctcatctatggtgccgtcaccgacggccacgtcggcgtcggcgacgtaggttcgaggtcggcaggtcggtacgtttcgggacgtacgtacttcactctcgtatcagtacgaacgagtacgtacggacgcccgtaagtactttcgacgtagttagttaacttacgtcgttacgtacgtcgttcggttttccggtccccttcgttacccttccgttaacgttcggtttaacgtttacccggttttcgggacccgttacggggtttacccgacgggttcgttacgggg

SEQ ID NO: 157977 - DNA, 674 bp, Homo sapiens
  misc_feature: GYAE6OF02F8AWB.24.78.H01.1.454.CMB.1.raw
  modified_base (237)..(237): a, c, t, g, unknown or other
  misc_feature (237)..(237): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctgctccagccatcaccggaggaattgtgttgacgcagtctccaggcacctgtctttgtctccagggganagagccaccctctcctgcagggccagtcagagtgttagcagcagctacttacgcctggtaccagacacgaaaccgtggcctggcctccgaggcctctcactctatcggtcgcgtaccacgcggccagtcggcgtcgacggacgtacggttcaggtcggcgtacgtcgggtacgtttcgggaacgtacgttacgttaccgaccttcctacgtacttccgtaacttccggaactaacggtaccgttacgggaaccgtacccggtaaaggtttacttttacggactacggtttattacgtttaactcgttacgtacggttacgtttcggtttccggtaccctttcccgtaccgtttcccgttaagttaccgtttacccgtttaccgggttttcgggtaacccggtttaacggggtttcccgtacggttaccggtaacggg

SEQ ID NO: 157978 - DNA, 621 bp, Homo sapiens
  misc_feature: GYAE6OF02G58CI.24.78.H01.1.454.CMB.1.raw
  modified_base (199)..(199): a, c, t, g, unknown or other
  misc_feature (199)..(199): n is a, c, g, or t
  modified_base (442)..(442): a, c, t, g, unknown or other
  misc_feature (442)..(442): n is a, c, g, or t
  modified_base (616)..(616): a, c, t, g, unknown or other
  misc_feature (616)..(616): n is a, c, g, or t
tcagactactatgtcacgaccggtgctcgatttagtgtgagtagtttgggtttggggagagctgctcagttaggacccagagggaaccatggaaaccccagcgcagcttctcttcctcctgctactctggctcccagccatcaccggagaattgtgttgacgcagtctccaggcaccctgtctttgtctccgagggganagacgcccaccctctcctgccgagggccagtcagagtgtagcagcagtctacttagcctggtaccagcagaaacctggacctggcctcccgaggcctaccgtcatcctagtggtcgccgtccaccgacgggccacgtcggcgtcgcggacgtacggttcgaggtcggcgaggttcggtacgttttgggactagtacttacgactctcactcagtacgacagtacgtacggacgaccgtaagtntttacgcgtagttgttattactgtacgtacgtcgttacggttcgttcccttaccgttcccttacttacgttcgttacccgtttacgttttcggacccgttacggttccgtacggtcgttacggtcgtacgtacgtaacgaccgtaagttcggtacgcgtacgtaccgtaccgtnttccg

SEQ ID NO: 157979 - DNA, 923 bp, Homo sapiens
  misc_feature: GYAE6OF02FF93G.24.78.H01.1.454.CMB.1.raw
  modified_base (252)..(252): a, c, t, g, unknown or other
  misc_feature (252)..(252): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagaggaaccatcggaaaccccagcgcagcttctcttcctcctgctactctggcctccagcctatcaccggagaattgtgttgacgcagtcctcacggccaccttgtctttcgtctccgaggggtacgagaccnccctacccgttctcccgtggaccgacggggtccacgtcgaaggtacgttcggtttaacgcctacgcctaacggtaccttaaccgttcggtacccgttacggtacccgacggaccgtaaacggtaaaccgtccggtaccgtccgggtacccgttaccccgacggtcccttcccctacctacttacgttacggttcggtccggtacccgtacccgaaccggtaccgggtaccgtaaccggttcgggtaccggtaccgggtaccgggtaaccgttacgggtcgtaacgggttacggaccgtacgggttcgggtacgtttacgggaaccgtaccggttaccgttaccgtaccgttccgtacctacgtacctaaccgtaaccggtaaccgtaaccgggtaccgtacgggtaacccggttaaccccgggttaagttaaccgtttttaccggaaccggttttaacggttaaccggttttaaaccgtttaccgtttacgggtacccgtttaccggttaccggtttttacccggtttaccccgggttaccccctttacccgtttacccgttaacccggtttaacgtttaacccgttttaaccggttttaacccgggtttttaccgggtaccccgggtttaaccggggttaccccggttacggggttaccgttaaccgggg

SEQ ID NO: 157980 - DNA, 717 bp, Homo sapiens
  misc_feature: GYAE6OF02HTB7M.24.78.H01.1.454.CMB.1.raw
  modified_base (351)..(351): a, c, t, g, unknown or other
  misc_feature (351)..(351): n is a, c, g, or t
  modified_base (387)..(387): a, c, t, g, unknown or other
  misc_feature (387)..(387): n is a, c, g, or t
tcagactactatgtcacgaccggtgctcgatttagtgtgagtagtttgggtttggggagaggagcccagcactagaagtcggcggtgtttccattcggtgatcagcactgaacacagaggactcaccatggagtttgggctgagctgggttttcctcgtcgctctttttaagaggtgtccagtgtcaggggcagctggtggagtcgtgggggcggcgtggtccaaccgtgggaggtccctgacgtactctcctgtcgccggccctcccgattccaccttcaatacttatggcatgcacgtgggtccgcacggcctccgagggcgaagggggctgggagtggggtcggccgntatctttagttgagtaggaatatcgtaaattattancgactagaccgttccggtaggaacgggtcccggttacaaccctattccctaccgaaggaacgtaaacctaacctttacccaaaacgttaaacctttacctacgttttacgttttaccgtaagtaaccttaaaagtcgtaaaccgtacggtccctaggtccgtaacttacggtacggaaacggtaccgaccgggtcttacggttacttaaggttccttaggtacggtaacgtaaacgtccgttaccccccggttacctttacgttaacggttaattttcgggttccggggttacccggtacccccttaacggtacggttacgggtacccgg

SEQ ID NO: 157981 - DNA, 537 bp, Homo sapiens
  misc_feature: GYAE6OF02FFTXR.24.78.H01.1.454.CMB.1.raw
  modified_base (196)..(196): a, c, t, g, unknown or other
  misc_feature (196)..(196): n is a, c, g, or t
  modified_base (240)..(240): a, c, t, g, unknown or other
  misc_feature (240)..(240): n is a, c, g, or t
  modified_base (272)..(272): a, c, t, g, unknown or other
  misc_feature (272)..(272): n is a, c, g, or t
  modified_base (343)..(343): a, c, t, g, unknown or other
  misc_feature (343)..(343): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggctcccagccatcaccggagaattgngttgacgcagtctccaggcaccctgtctttgtctccaggggganagagccaccctctcctgcaggggccagtcagngtgttagcagcagctacttagcctggtaccagcagaacctgcctggctccaggctcctcatctagtggtcncgtccaccagggcccagtggcgtcgcggacaggttcagtgcgagtgcgttgggacagtacttcactctcatcatcgacacgacgttggacgaccgtaagattttcgactagttgttattacttgtctagtcttgttcgtccctctcctcctatcgttacgtactttcggtccgtaggttccgtaggtcgtacgg

SEQ ID NO: 157982 - DNA, 667 bp, Homo sapiens
  misc_feature: GYAE6OF02HSI1Y.24.78.H01.1.454.CMB.1.raw
  modified_base (243)..(243): a, c, t, g, unknown or other
  misc_feature (243)..(243): n is a, c, g, or t
  modified_base (283)..(283): a, c, t, g, unknown or other
  misc_feature (283)..(283): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaacccccagcgcagcttctcttcctcctgctactctggctcccagccatcaccggaggaattgtgttgacgcagtctccaggccaccctgtctttgtctccgagggganagagcccaccctctcctgcagggccagtcagagtgtagcngcagctacttagcctggtaccagcaacgtaaaccgtggcctcggcctcccgaggcctcctcatctacgtggtcgccgtccacgacgggccacgtcgggccgtccggcggtacgtacgggttcagggtcggcgtaggtcgggttacggtttacggggacctacggtaccttccgaacttccgtactactacctaacgtccgaaacgtacgtaacgtacgggaccggtacccgtaaggttagttttacgacgtagttacgttagttacgtcgtacgtcgtcgtttacggtttccggtcccttccgttacccttcgttaacgttcgtttaacccgtttccggttttccggacccggtttacggggttccgtacgggtcgttaacggg

SEQ ID NO: 157983 - DNA, 577 bp, Homo sapiens
  misc_feature: GYAE6OF02HFICB.24.78.H01.1.454.CMB.1.raw
  modified_base (240)..(240): a, c, t, g, unknown or other
  misc_feature (240)..(240): n is a, c, g, or t
  modified_base (338)..(338): a, c, t, g, unknown or other
  misc_feature (338)..(338): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgtctccagggganagagccaccctctcctgcagggccagtcagagtgttagcagcagctacttagcctggtaccagcagaaccgtggcctcggcctcccgaggccttcctnacttctagtggtcgccgtacccaccgagggcccacgtcgggcgtccgacggtactagggttcagggtcggcgtaggtcggtcgtttgggacacgtacttcacgttcgtcatcactcgacacgacgtggaccgaccgtaagtcgtttcgctacgtctattacgtgtcgagtcgttgtttcggtcccttcgtcctcttattcgttacttcgtttcggtccgtgggttacgacggtgtacgg

SEQ ID NO: 157984 - DNA, 669 bp, Homo sapiens
  misc_feature: GYAE6OF02G0CC6.24.78.H01.1.454.CMB.1.raw
  modified_base (198)..(198): a, c, t, g, unknown or other
  misc_feature (198)..(198): n is a, c, g, or t
tcagactactatgtcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcacctgtctttgctccgagggganagagcccaccctctcctgcagggccagtcagtagtgttagcagcagctacttagcctaggtaccagcaacgaaacctggacctggcctcccgaggtcctcctcgatcctagtcggtcgccgtaccacgtacggccacgtcggcgtcgcgacgtggtcagtcgctaggtgtcgtttgggactagtcttcacgtctcatcagtcgacagtacgtggaacgaccgtaagttacgtttgaccgtagttacgttaacttacgtgttacgtacgttcgtttacgggttttcccggttccccttacgtttccctttaccgtttaacgtttacggtttaacctttaaccgggtttttccggaacccgtttacggggtttaccctacgggttcgtaacgggtaacgttaacgtaccggtaaacggttaccggtaacgtttcgggtacggtaccgttcggacctaccgttaagtttcccgg

SEQ ID NO: 157985 - DNA, 723 bp, Homo sapiens
  misc_feature: GYAE6OF02IAGTU.24.78.H01.1.454.CMB.1.raw
  modified_base (317)..(317): a, c, t, g, unknown or other
  misc_feature (317)..(317): n is a, c, g, or t
tcagactactatgtcacgaccggtgctcgatttagtgtgagtagtttgggtttggggagagctgctcagttaggacccagagggaaccatggaaaccccagcgcagcttctcttcctcctgctactctggctcccagataccactggagaagtagtcatgacgcagtctccagcccaccctgtctgtcgtctccgaggggaaagacgcccaccctctcctgcgagggccagtgagtaatgttggctagctaacttcgccgtggtaccagcaagaaacctggccaggcctcccaggcctcctctctatcgcttgtccnccgaccgacgggtcccctggtccgtccccagccgtacggttcggttgggcgggttggtcgtcggggactaggtacttttcacgttcctccgaacctagtccgacgccggtacccttccgtacgttacgtaggtaaagtttacgttttcgtacctttacttttacgtttaccgttcgttaactaaaccttactttagttcggtacgttacgtacgggtcccttaccgttaacccgttaccggtttttaccggaccggtaaccggggtaaccgttaaaaccgggtgggtaacgtaacgttaaccgtaaaacgtaaccggttgggtacggtcggtaaccggacctaaccgttacgtaccgtttcggtttaccctttcctaccgtttcccgttccccggtacttaacccg

SEQ ID NO: 157986 - DNA, 666 bp, Homo sapiens
  misc_feature: GYAE6OF02J2VS7.24.78.H01.1.454.CMB.1.raw
  modified_base (242)..(242): a, c, t, g, unknown or other
  misc_feature (242)..(242): n is a, c, g, or t
  modified_base (306)..(306): a, c, t, g, unknown or other
  misc_feature (306)..(306): n is a, c, g, or t
tcagactactatgtcacgaccggtgctcgatttagtgtgagtagtttgggtttgggcacgaccggtgctcgatttagtgtgagtagtttgggtttggggagagctgctcagttaggacccagagggaaccatggaaaccccagcgcagcttctcttcctcctgctactctggctcccagccatccaccggaggatgtgttgacgcagtctccaggcaccctgtctttgtctccgaggggtanagacgcccaccctctcctgccgaggccagtcagagtgtagcagcagctacttagcctggtaccngcacgaactcggcctcgcctcccgaggcctcctcatctagtgcgtcgtccgacgaccgggcctacgtcggcgtccgcggaacttcgggtccacggtgtcgaggtcggtcgtttacgggacgtacgtaccgttcgtaccttactcgtacacacgtccgtaacgaccgtagtacgggaccgaacccggttaagttcgtttacgcgttagttacgttaagttccgttactacggtaccgttgtttaccgggtttccgttacccgttccgtttaccccgtacgttaaccgttcgtttaacccgtttcggttttacccgggtaccggttacccgggtttacccggtacggttaccggttaccggg

SEQ ID NO: 157987 - DNA, 696 bp, Homo sapiens
  misc_feature: GYAE6OF02FMORF.24.78.H01.1.454.CMB.1.raw
  modified_base (242)..(242): a, c, t, g, unknown or other
  misc_feature (242)..(242): n is a, c, g, or t
tcagactactatgtcacgaccggtgctcgatttagtgtgagtagtttgggtttggcacgaccggtgctcgatttagtgtgagtagtttgggtttgggggagagctgctcagttaggacccagagggaaccatggaaacccccagcgcagcttctcttcctcctgctactctggctcccagccatcaccggaggaattgtgttgacgcagtctccaggcaccctgtctttgtctccagggganagacgcccaccctctcctgcgagggccagtcagagtgttagcagcagctactacgcctggtaccagcaagaaacctggacctcggctcccaggcctcctacatctagtggtacgccgtaccaccgacgggccctacgtcggcggtccggaccggtactacgggttacgaggtcggcgtacggtggtcgtttagggaccaggtaccttcaccgtactacactactacgtacgacgacggtaacgtcgggacggtacccgtaaggtaccttttaggacctacggttagttaacttacgtcgttacgtaccggttacgttcggtttttaccggccccttttccgttccccgtttaccggtaaccgttttaaccggttaaccgttttaaccggttttttaccgggtaccccgggtttaaccggggtttcccgggttacgggttacccggttaacgggg

SEQ ID NO: 157988 - DNA, 675 bp, Homo sapiens
  misc_feature: GYAE6OF02JFVN0.24.78.H01.1.454.CMB.1.raw
  modified_base (204)..(204): a, c, t, g, unknown or other
  misc_feature (204)..(204): n is a, c, g, or t
  modified_base (236)..(236): a, c, t, g, unknown or other
  misc_feature (236)..(236): n is a, c, g, or t
  modified_base (248)..(248): a, c, t, g, unknown or other
  misc_feature (248)..(248): n is a, c, g, or t
  modified_base (252)..(252): a, c, t, g, unknown or other
  misc_feature (252)..(252): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacncagtctccaggcacctgtcttgctccgagggnagagccaccctntccngcagggccagtcagagtgttagcagcagctactagcctggtaccagcaagaacctggacctcggctcccaggcctctcatctagtggtcgccgtaccacgacgggccacgtcgggcctcggccgtactacgggtcagggtcggcgtaggtcggtcgtttacgggactacggtaccgttcgaccgttcgtaccgtacgttaccgtaacgttaccgaacctaacggtaccgtacgggaccgtacccggtaaacgttacgtttttaccggacgttaacggttacgttaacgtttaccgttacggtaccgtacggttccgttcggttttaccggtcccctttcccgttaccttaccgttacttaccgtttaaccgttacggttttccggtacccggttaccgggtttaccgacggttccgttacggg

SEQ ID NO: 157989 - DNA, 644 bp, Homo sapiens
  misc_feature: GYAE6OF02IP7Z4.24.78.H01.1.454.CMB.1.raw
  modified_base (198)..(198): a, c, t, g, unknown or other
  misc_feature (198)..(198): n is a, c, g, or t
  modified_base (210)..(210): a, c, t, g, unknown or other
  misc_feature (210)..(210): n is a, c, g, or t
  modified_base (229)..(229): a, c, t, g, unknown or other
  misc_feature (229)..(229): n is a, c, g, or t
tcagactactatgtcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgctccagggganagagccaccctntcctgcagggccagtcagngtgtagcagcagctacttagcctggtaccagcagaaacctggcctggctcccaggctcctcatcagtcggtgccgtccacagggcctacgtggcgtcgcggacaggttcaggtgcgagtggtactttgggactagactttcacgtctacatcgaactcgaacgagacgtacggacgacccggtaaagtacgtttgaccgtaaggttaggttaactttaccgttaggtaccgtaacgtccgtttagggtttttccggttacccttccttcccctaccttaaccgttacgttaactttaaccgttttcggaccgttaacgggttttaccgacgggtaccgttcgggtaaacgtacttaccggaacgttaccgaacgtttcgggtacggtccgttacggacctaaccgtacgttaccg

SEQ ID NO: 157990 - DNA, 580 bp, Homo sapiens
  misc_feature: GYAE6OF02GQZBX.24.78.H01.1.454.CMB.1.raw
  modified_base (240)..(240): a, c, t, g, unknown or other
  misc_feature (240)..(240): n is a, c, g, or t
  modified_base (358)..(358): a, c, t, g, unknown or other
  misc_feature (358)..(358): n is a, c, g, or t
  modified_base (383)..(383): a, c, t, g, unknown or other
  misc_feature (383)..(383): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgtctccagggganagagcccaccctctcctgcagggccagtcagagtgttagcagcagctacttagcctggtaccagcaagaaccgtggcctggcctcccgaggcctctcatctagtggtgcctccaccgngggcccagtcggcgtcgacgtacgnggttcaggtgtcgaggtggtcgttgggactaggtacttcactctcatctacgcacagacgtgacgaccgtagtatttcgctagttagttacgttacgtgtacgtagtcgttcgtttcgtcccgttcttaccttccttactttcgttaccgttacgttttccggtaccgttaccgggttccgtacggtccgttacggg

SEQ ID NO: 157991 - DNA, 813 bp, Homo sapiens
  misc_feature: GYAE6OF02GOX25.24.78.H01.1.454.CMB.1.raw
tcagactactatgtcacgaccggtgctcgatttagtgtgagtagtttgggtttggggagaggagcccagcactagaagtcggcggtgtttccattcggtgatcagcactgaacacagaggactcaccatggagtttgggctgagctgggttttcctcgtcgcttcttttaagaggtgtccagtgtcgaggggcagctggtggagtcgtgggggcggcgtggtccaaccgtgggaggtccctgagactctcctgtgccggcctcccgattccaccttcaattacttatcggcatgcacgtgggtccgccaggcctcgaggcgaaggggctagggaggtggggtcggccgctagttctttagtttcgagtgggtaaagttactacgtaaattattatgacaacgtaccgtccggtagggaacggggtcccggtttacaccctaagttcccgtaccgacggaacgtaacccgtaaacgtttaaccccaaaacgtaaacttaaccgttaccgtttacgttttaccgttacgtaaaccgtaaaacgtttacggtaaacccgttaacgtcccgttacgggacccggttaagttaccggttacgggtaaaccggggtaacccgtacccggggtaccgttccgggtttaccttaaacgttttaccggttacgttacgggtaaccggttaaaaccggttccccggtttaccccccggttaccccgtttacccgtttaaccgttaaccggttttacgggtttacccggggggttaccccggttaccccccggttaacgttaccggttaccgggttaacccggg

SEQ ID NO: 157992 - DNA, 619 bp, Homo sapiens
  misc_feature: GYAE6OF02FU045.24.78.H01.1.454.CMB.1.raw
  modified_base (240)..(240): a, c, t, g, unknown or other
  misc_feature (240)..(240): n is a, c, g, or t
  modified_base (271)..(271): a, c, t, g, unknown or other
  misc_feature (271)..(271): n is a, c, g, or t
  modified_base (278)..(278): a, c, t, g, unknown or other
  misc_feature (278)..(278): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgtctccagggganagagccaccctctcctgcagggccagtcagngtgttancagcagctacttgcctggtaccagcagaacctggccaggcctcccaggtcctcctcctctatcgctagtcctccaccaggccctggtcgtcccacgcctagggttcgttaggcggttgggtcgtgggacgtagtacgtttcacttctcgacctacgtcctacgccgtacccttccagttcctagtacgttacgttttcgccttaacttttactttccttagttacctaaacctcgttaacgttcgtagtaccgttcggtccctaccgttcgtaccgttttcggaccgtacgggtaaccctaacggtcggtaaccgtagtaccgtaaaccgtacgttacggg

SEQ ID NO: 157993 - DNA, 650 bp, Homo sapiens
  misc_feature: GYAE6OF02GRG40.24.78.H01.1.454.CMB.1.raw
  modified_base (461)..(461): a, c, t, g, unknown or other
  misc_feature (461)..(461): n is a, c, g, or t
tcagactactatgtcacgaccggtgctcgatttagtgtgagtagtttgggtttgggggaggagcccagcactagaagtcggcggtgtttccattcggtgatcagcactgaacacagaggactcaccatggagtttgggctgagctgggttttcctcgtcgctcttttaagaggtgtccagtgtcaggggcagctggtggagtcgtgggggcggcgtggtccaaccgtgggagtccctgagactctcctgtcgcggcctcccgattccaccttcaattacttatggcatcgctacgtcgggtccgccgaggctaccgagggcgaagggggctgggagtgggtcggccgctatcttattgatggaagtatcaatattatgcagtactcggtagaacgggtccgttacacctacgtactcgagaacgaactaacttaccaaactaattactcttagtttacctnactaaatgacctagtcctagacgatcgtaggacggaacctccggtacttcgttacttaacgttacgtgtacgaccggttaacgtacccgtttcccccggtaccctttaccggtttaaccgtaacgttttacggttacgggggttcccgtacccccgttaacggtacggttccgggtaaccggttccggg

SEQ ID NO: 157994 - DNA, 783 bp, Homo sapiens
  misc_feature: GYAE6OF02H3S60.24.78.H01.1.454.CMB.1.raw
  modified_base (248)..(248): a, c, t, g, unknown or other
  misc_feature (248)..(248): n is a, c, g, or t
tcagactactatgtcacgaccggtgctcgatttagtgtgagtagtttgggtttgggggaggagcccagcactagaagtcggcggtgtttccattcggtgatcagcactgaacacagaggactcaccatggagtttgggctgagcttgggttttcctcgtcgcttcttttaagaggtgtccagtgtcgaggggcagctggtggagtgtgggggcgcgtggtccaacgtgggacgtcctgacgctctccnggtcgccgcctcccgattccacttcaattacttagtgcatgcacgtggtcccgcgtaggcctaccaggacgaacggggtcgtggaggttgggcggccgtcttattcgttagtttagagtaggtaaatacgtactaaattagttactcggactaagtacccggttccggtaaggtaaccggggtcccgttaccgaacctacttaccgtaccgaacgtaactaacggggggggggtaaaccttaaaccgtaaacctaaacttaaccgtttaccttaccgtttacgttacgttaaccgttaaacgttacgtaaccgttaacgtacgtacgtaccgtacgttaaccgtacggacggtaaccgtaccggtacgttaccgtttacgtaacgttacgttacgttacgtaccgtaacggtaacccggttcccccggttaaccccggtttacccgtttaacgtttaaccgtttaacgggtttacccgggttacccgggttacccccgtttaaccggttacggtacggttaccggttaaccgggg

SEQ ID NO: 157995 - DNA, 713 bp, Homo sapiens
  misc_feature: GYAE6OF02FZX3P.24.78.H01.1.454.CMB.1.raw
  modified_base (249)..(249): a, c, t, g, unknown or other
  misc_feature (249)..(249): n is a, c, g, or t
  modified_base (359)..(359): a, c, t, g, unknown or other
  misc_feature (359)..(359): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctacctctggctcccagccatcaccggaggaattggtgttgacgcagtctccaggccaccctgtctttgtcctccgaggggagacgngccccaccctctcctggcacgggccagtcagagtgttagcagcagctactcgtcctggtaccagacaagaacctggcctggccctccgagcctccgtcatctagtcggcnccgtccaccgacggccagtcggcgtcgaccgtagtacggttcagggtcgcgtaggttcggtcggtttacggggaactacggttaccgttacacctttccgtactacttaccgttaacgtaccgtaaccgtagggtacccggtacggacccggaacccggttaaaagttacgttttcggaccgttaaggtttccgttaaacgtttcgttacgtcgtacgttccgtttcggttttcccggtacccctttccgttaccccgttaccctttaacgtttacccgtttaacccgtttaaccggtttttccgggtaaccccggttacgggttttaccccggaagggttcccggtaacgggg

SEQ ID NO: 157996 - DNA, 755 bp, Homo sapiens
  misc_feature: GYAE6OF02GQH6X.24.78.H01.1.454.CMB.1.raw
  modified_base (200)..(200): a, c, t, g, unknown or other
  misc_feature (200)..(200): n is a, c, g, or t
tcagactactatgtcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgtctccgagggganagacgcccaccctctcctgcagggccagtcagagtgttagcagcagctacttagcctggtaccagcaagaaacctggacctcggcctccgacggccttcctcactcttagtggtcgccgtaccgaccgacgggcccacgtcggacgtcggcggacgtacggttcgacggtcggcgaggttggtacgttttcgggaactaggtacctttcgaccttctactactacgtacgtaccgaacgaacggtacggtacgggaccggtaacccggtaaaggttacgtttttacggacgttaggtttacgttaacgtttacgttggttaccgtaacggttccgttttcggttttccgggtttcccctttaccgtttcccgtttaccgtttaacgtttccgttttaaccgttttaccggtttttaccgggtacccggtttaacggggtttcccggttacgggttccggttacgggtaacggttacggttaacccgtaacggtaccggtaacggttcggttaccgggtaccgttaccggtacccttaacccggtagtttacccgg

SEQ ID NO: 157997 - DNA, 780 bp, Homo sapiens
  misc_feature: GYAE6OF02IOUDD.24.78.H01.1.454.CMB.1.raw
  modified_base (156)..(156): a, c, t, g, unknown or other
  misc_feature (156)..(156): n is a, c, g, or t
  modified_base (257)..(257): a, c, t, g, unknown or other
  misc_feature (257)..(257): n is a, c, g, or t
  modified_base (279)..(279): a, c, t, g, unknown or other
  misc_feature (279)..(279): n is a, c, g, or t
  modified_base (288)..(288): a, c, t, g, unknown or other
  misc_feature (288)..(288): n is a, c, g, or t
  modified_base (412)..(412): a, c, t, g, unknown or other
  misc_feature (412)..(412): n is a, c, g, or t
tcagactactatgtcacgaccggtgctcgatttagtgtgagtagtttgggtttgggggaggagcccagcactagaagtcggcggtgtttccattcggtgatcagcactgaacacagaggactcaccatggagtttgggctgagcttgggttttccncgtcgcttcttttaagaggtgtccagtgtcgaggggcagctggtggagtcgtgggggccggcgtggtccaaaccgtgggacgtccctgagacctctcctgngccggcctcccgattcaccttnaatacttanggcatgaccacgtgggtcccacgaggcctccgaggaccgaagggggctagggaggttcggggtcggcccgtacgttattacgttagttttagaagttagggaaattaatctaaagttaatttancggactaacggacctaccgggtaaggaaacggggtcccggttaacaacccgtagttcccgtaaccgaaggaaccgtaaactaaaccgtttacccaaaactaaattaccttcgttagtttccgaagaacctaaagttccgaaacgttacgtcctaggaccgttacgtaccgtaggtaaccgaaccgtacggtaccttacgttaacgtttaaacttccggttaagtaacggggtaaccttaaaaccggttccccgttaaccccccggttaccccttttaacggtttaacgtaacgtttttaacggggttcccgggtaaccccgggtaaccccccttaggtaaacggttccgggtaacccgttaacggggg

SEQ ID NO: 157998 - DNA, 629 bp, Homo sapiens
  misc_feature: GYAE6OF02FVHVP.24.78.H01.1.454.CMB.1.raw
  modified_base (241)..(241): a, c, t, g, unknown or other
  misc_feature (241)..(241): n is a, c, g, or t
  modified_base (245)..(245): a, c, t, g, unknown or other
  misc_feature (245)..(245): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaacccccagcgcagcttctcttcctcctgctactctggctcccagccatcaccggaggaattgtgttgacgcagtctccaggcaccctgtctttgtctccagggganaganccaccctctcctgcagggccagtcagagtgttagcagcagctacgttacgctggtaccagcagaacctggcctgctcccaggctccgtcatctatggtgcgtcccacgacgggccacgtggccgtcggaccggacgtaggttcagggtcggcgtacggttgggtccgtttagggaccaggttaccttcgtacctactcctactcatccgacgtacgacctaggacgaccggtaacgtacgttttacgcgtaacggttgttaacttacgtcgttcacgttcgtttcggtttcggtcccttcccgttaccgtttaccctaacgtttacgttaaccttaccgttttcgggtacccgttacgggtttcccgtagggttaccttacggg

SEQ ID NO: 157999 - DNA, 730 bp, Homo sapiens
  misc_feature: GYAE6OF02JHWGW.24.78.H01.1.454.CMB.1.raw
  modified_base (203)..(203): a, c, t, g, unknown or other
  misc_feature (203)..(203): n is a, c, g, or t
tcagactactatgtcacgaccggtgctcgatttagtgtgagtagtttgggtttggggagaggagcccagcactagaagtcggcggtgtttccattcggtgatcagcactgaacacagaggactcaccatggagtttggctgagcttgggttttcctcgtcgcttcttttaaggaggttgtccagtgtcgaggggcagcgtggnggagtcgtgggggcgcgtggtccaaccgtgggacgtcctgagactctcctgtcgccggccctccgtattccaccttacaattacttagtcggctatcgctacgtcgggtcccgccaggtccctccgagggaccgaacgggggtctaggggacggtcgggtcggacccgtcgttagttaccgtttagtttaggaagtagggtaaaattactactaaatttagttacgtgacaacgtaccgttaccggtaagggaaccggggttcccgttacaaccgtacttacccgtaccgaaacggtaacgaacctaaacgttaccctaaaactaacttaaccttacctttacgttaccttagtaactaaacgttacgaacctacgtacctcgtacgtacgttacgtagacggtactacggtcttacggtacttattaccgtgtacgaacgtaacgttcccgttaccccgttaccttaccgttaccgttagtttaccggttacgggtacccgtcccgtaagtaccggtcggtaccgg

SEQ ID NO: 158000 - DNA, 825 bp, Homo sapiens
  misc_feature: GYAE6OF02FTCEN.24.78.H01.1.454.CMB.1.raw
  modified_base (199)..(199): a, c, t, g, unknown or other
  misc_feature (199)..(199): n is a, c, g, or t
  modified_base (298)..(298): a, c, t, g, unknown or other
  misc_feature (298)..(298): n is a, c, g, or t
tcagactactatgtcacgaccggtgctcgatttagtgtgagtagtttgggtttggggagagctgctcagttaggacccagagggaaccatggaaaccccagcgcagcttctcttcctcctgctactctggctcccagccatcaccggaggattgtgttgacgcagtctccaggccacctgtctttgtctccgagggganagagcccaccctctcctgcagggccagtcagagtgtagcagcagctacttagcctggaccagcaagaacctggccaggcctccgagcctcctcctctangctcgtcctccaccgacgggtccccctggtccgtcccgacggtacccgtagggtttccgttcggggtccgggttggggttccgtagggggacctaggtacgttttcgaaccgtttccgtaccaacccgtactccggtaacggtcccgggtacccttacccgaacggttccgttaagggtaaacgttttacgtttttacggaaacccttttacgttttttacgtttccggttacgttacccttaaaacgtaaccgtttacggttacggggttacgtaaccgttcccgggttacccgtttacccgtttaaccggttttaccggtttttacccggggaacccgggtaaaccgggggttaaacccgttaaaaccgggtcggtaaacggttaaaccgttaaccggtaaaaccgttaaccggtttacgggtaccgggttaccggttaaccggtaacccgttaacccgtaacgtttccggtttaccggtttaacctttaccccggtaccgtttaccccgttaccccgtaccccg

SEQ ID NO: 158001 - DNA, 695 bp, Homo sapiens
  misc_feature: GYAE6OF02H3EKW.24.78.H01.1.454.CMB.1.raw
  modified_base (241)..(241): a, c, t, g, unknown or other
  misc_feature (241)..(241): n is a, c, g, or t
  modified_base (390)..(390): a, c, t, g, unknown or other
  misc_feature (390)..(390): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgtctccgagggganagagccacctctcctgcagggccagtcagagtgttagcacgcagctactagcctggtacccagcacgaaacctggcctggctcccgaggctccgtcatcagttggtacgccgtaccgaccgacgggcctaacgtggccgtcggcgacgnggttccagggtcggacgaggtcggtaccgtttaggggactaacggcctttacgaccttccgtctacgttaccgtaactccggtaacgtacggtaacgttcgggaaccggaccccgtaaacggttacgttttacggaccgtaaggttacgtttaacgttaccgtggttacctacgggtaccgttttaggtttcccgggttaccccttccgtttccccttaccgtaacgttttaccgttaacccgtttacggttttaccgggacccggtttaacggggtttcccctacggggttaccgttaacgggg

SEQ ID NO: 158002 - DNA, 900 bp, Homo sapiens
  misc_feature: GYAE6OF02HWT2J.24.78.H01.1.454.CMB.1.raw
  modified_base (176)..(176): a, c, t, g, unknown or other
  misc_feature (176)..(176): n is a, c, g, or t
tcagactactatgtcacgaccggtgctcgatttagtgtgagtagtttgggtttggggagaggagcccagcactagaagtcggcggtgtttccattcggtgatcagcactgaacacagaggactcaccatggagtttgggctgagtcgttgggttttcctcgtcgcttcttttaagnggtgtccagtgtcgagggcagctggtggagtcgtgggggcgtcgtggtccaacgtgggacgtccctgacgtacctctcgtggtcgccggccctccgattccacctttcaaattacttagcggctatcgctacggtcgggtacccgccgtacggtcctccgaggaccggaacgggggtctggggaggtcggggtcggacccgtgtttaagttccgttttaagttcggaagttaaggggtaaacttaaataccgttaaaatttagttaacgtcgacgtaaacgtaccgttacccggggtaagggtaaaccggggttccctttaccgaacccgttacgttacccgtaaccgaacggtaaacgaaaccttaaaaccgttacccgtaaaaacttaaactttaacccgtttcgttttacgttttaccgtaacgttaaaccgttaaacgttacggtaaacccgttacggtacccgttaacggtaccgtaacgtttacggtaaccgggtaacggtacccggtaacgggtttaccgttacgtttaaaccgttaacgttttaaccgtagggttaccgggtaaaccggtttaaacccggttaaccccgttttccccccgggttaccgttttaacccgtttaaaccgggttaaccgtttttaaccggggttaccccgggggtttaaccccgaccccccggtttaaacgttaccggggttaccggggttaacccggg

SEQ ID NO: 158003 - DNA, 801 bp, Homo sapiens
  misc_feature: GYAE6OF02IXR4R.24.78.H01.1.454.CMB.1.raw
tcagactactatgtcacgaccggtgctcgatttagtgtgagtagtttgggtttggggagagctgctcagttaggacccagagggaaccatggaaaccccagcgcagcttctcttcctcctgctactctggctcccagccatcaccggaggattgtgttgacgcagtctccaggcaccctgtctttgtctccgagggagagagccacctctcctgcgacgggccaggtcagacgtgttagcagcagctacttagccgtggtaccagcaacgtaaaccgtggacctacggcctcccgacggtcctcctctatcctagtcgggtcgccgttacccgaccgtacggggtacccacgttcggggccggttaccgggaccggggtaacgtacggggttttaccgaacgggttcgggaccggttaacgggttcgggttacccggttttacgggggaacctacgggtaaccttttcgaacccgtttccgtacacgttaccgtaacgtacgtaccggaacgtaacgttacgggacgtacccggtaaagttcgtttcgacgtacggtttaggttaaccttacggttcggtaccgtaggtcttttacgggtttccgttccccgttacctttacccgttaccttttaaaggttcccttaaccgttttaccggttttaccgggtaccccggttttaaggggttcccgttacgggttacgttacggggtaaaccgttacgttaaccgggtaacgtaccggttaaccggtttcggtccgggttaccgtccgggtaaccttaaccggtctttccggg

SEQ ID NO: 158004 - DNA, 734 bp, Homo sapiens
  misc_feature: GYAE6OF02HG7A6.24.78.H01.1.454.CMB.1.raw
  modified_base (311)..(311): a, c, t, g, unknown or other
  misc_feature (311)..(311): n is a, c, g, or t
  modified_base (407)..(407): a, c, t, g, unknown or other
  misc_feature (407)..(407): n is a, c, g, or t
  modified_base (449)..(449): a, c, t, g, unknown or other
  misc_feature (449)..(449): n is a, c, g, or t
tcagactactatgtcacgaccggtgctcgatttagtgtgagtagtttgggtttggggagaggagcccagcactagaagtcggcggtgtttccattcggtgatcagcactgaacacagaggactcaccatggagtttgggctgagcttgggttttcctcgtcgctcttttaagaggtgtccagtgtcaggggcagctggtggagtctgggggcgcgtggtccaaccgtggggaggtccctgagactctcctgtcgccggcctcccgattccacctttcaaattacttagtcggacatgacacgtgggtcccnccgaggcctccgaggcgaagggggctggggaagttcggggtcggacccgtgttattcttttaattggaacttgggaaatatactaaattagtttangctaagaccgttccgtaggaacggggtccgttaccaaccgtntcctaccaggacgaaacgtaacttaccaaactaactaccttctacgttttactagtaaccgtaaatacgtaacgtacgtacctagtctaacgttacgacggaacggtaaccgtaaccgggtcgtttaccggttacttaacgtttaccgttcgtacggaacggtaaaccgtcccgtttaccccccggtacccgtttaacccgttaacggtttaacggttttacgggtttaccgggggtaccccggttaccccccgtaacggttaccggtaccgggttaacccgggg

SEQ ID NO: 158005 - DNA, 661 bp, Homo sapiens
  misc_feature: GYAE6OF02GLKIP.24.78.H01.1.454.CMB.1.raw
  modified_base (242)..(242): a, c, t, g, unknown or other
  misc_feature (242)..(242): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaacccccagcgcagcttctcttcctcctgctactctggctcccagccatcaccggaggaattgtgttgacgcagtctccaggcaccctgtctttgtctccgagggganagagcccaccctctcctgcacgggccagtcagagtgttagcagcagctacttagcctggtaccagcaagaacctggcctggcctccaggctcctcatctagtcggtcgccgtccaccgagggcctacgtcggctcggacggactagggttcaggtcggcgaggtcggtcggtttgggaactacgtaccttctacttcctactactcctaacgtccgaacgacgtacgtacggaccggacccgttaagtacgttttcgacgttaacgttagttaacgtttaccgtcggttactacgttcgttacggttttcggttccccgttccgttacccgttaccgtttaagttaccgttaaccggtttaccggttttaccgggttaacccggtttacgggttacccgtacgggttaccggttacggg

SEQ ID NO: 158006 - DNA, 693 bp, Homo sapiens
  misc_feature: GYAE6OF02H331J.24.78.H01.1.454.CMB.1.raw
  modified_base (177)..(177): a, c, t, g, unknown or other
  misc_feature (177)..(177): n is a, c, g, or t
  modified_base (309)..(309): a, c, t, g, unknown or other
  misc_feature (309)..(309): n is a, c, g, or t
  modified_base (397)..(397): a, c, t, g, unknown or other
  misc_feature (397)..(397): n is a, c, g, or t
tcagactactatgtcacgaccggtgctcgatttagtgtgagtagtttgggtttggggagaggagcccagcactagaagtcggcggtgtttccattcggtgatcagcactgaacacagaggactcaccatggagtttgggctgagcggtcggtttcgcgtacggctctttaagaggtntaccagtgtcgagggcagctggtggagtcgtgggggcgcgtggtccaacgtgggaggtcctgagtactctccgtgtcgcggcctccgattcaccttcaaagtacttagtggactagtgcacgttcgggtccncgaggcctaccgaggaccgaaggggctagggtagtgggttcgccggttactaagtcgtttaatttaggattagggaaactttaaacgnttaaagttataagtacggtacgtacggtaccgttcgggtaagggaaccggggttccctactaacctgtcgtacgtacgtaacgtaaacgtaacctaacctaaactaactacttacttagttactagtaactaaacgtagtaacgtcgacgtacgtgtacgtacgttacgaacgaccgacgtacgttcgtactaagttacgtacgtagaaccggtaacgtacccggttacccgtaccgttaacgttaacgtacgttacggttaccgggtccgtaccctacggtacggtacggtacgg

SEQ ID NO: 158007 - DNA, 729 bp, Homo sapiens
  misc_feature: GYAE6OF02JRE47.24.78.H01.1.454.CMB.1.raw
  modified_base (155)..(155): a, c, t, g, unknown or other
  misc_feature (155)..(155): n is a, c, g, or t
  modified_base (171)..(171): a, c, t, g, unknown or other
  misc_feature (171)..(171): n is a, c, g, or t
  modified_base (356)..(356): a, c, t, g, unknown or other
  misc_feature (356)..(356): n is a, c, g, or t
  modified_base (592)..(592): a, c, t, g, unknown or other
  misc_feature (592)..(592): n is a, c, g, or t
  modified_base (637)..(637): a, c, t, g, unknown or other
  misc_feature (637)..(637): n is a, c, g, or t
tcagactactatgtcacgaccggtgctcgatttagtgtgagtagtttgggtttggggagaggagcccagcactagaagtcggcggtgtttccattcggtgatcagcactgaacacagaggactcaccatggagtttgggctgagcgtggttttcncgtacgctctttaagngtgtccagtgtcagggcagctggtgagtcgtagggggcgacgttcggaccaacgttgggacggtccctaggacgacttctcccgtggtcggaccggtcctcccggatttcctacccttacgaattaccgttacgtcgggtcctaagttcgaccgtcgttcggggacccccggtaagccgtaccgnggacgtaacgggctgggacggttgggaccggtccgactttaagttccgtttagtttacggacgttagggtaaaacttacttacggaaattttcggttaattggaccaaacgtcccgttacgggtacggttaaacccgggggccctttaacaccgtactttccgtacctaagggtacctaaccgtacgtaccggtaaacaacttacgttacgttacttacgtggtaaaccaacgttnaccgttacgaccgtgactacgtgtacgacgtatccgggattcggnttaactgtacgtcgaacgtaacgccgttacccgcgtttaacgtccgtaatttcgggtccggtaaccccgtcttaacggacgttacggtacgg

SEQ ID NO: 158008 - DNA, 659 bp, Homo sapiens
  misc_feature: GYAE6OF02G1SJ7.24.78.H01.1.454.CMB.1.raw
  modified_base (307)..(307): a, c, t, g, unknown or other
  misc_feature (307)..(307): n is a, c, g, or t
  modified_base (405)..(405): a, c, t, g, unknown or other
  misc_feature (405)..(405): n is a, c, g, or t
tcagactactatgtcacgaccggtgctcgatttagtgtgagtagtttgggtttggggagaggagcccagcactagaagtcggcggtgtttccattcggtgatcagcactgaacacagaggactcaccatggagtttgggctgagctgggttttcctcgtcgctcttttaagaggtgtccagtgtcaggggcagctggtggagtcgtgggggcgcgtggtccaaccgtgggacgtccctgacgactctcctgtcgcggcctcccgattccaccttcaattaccttatggcatcgcacgtcgggtcccncgaggcctccgagggccgaagggggtctagggaggtggggtcggcccgtctattcgtttagtttgaagttggaaagttaactcgtaaatttattaagngacagtaccgtccggtaggaacgggtcccgttacaccgtattccgtacgagacgaactaacttaccaaactaacttaccttacttcgtttactagtaactaaagttacgacctacgcctcggactacttacgtaggacgacgtacgtcttcgttacttaattacgtcgtagacgtaacgtcccgttccccgtacctttacgttaccgttagttacggttcggggtcccgtaccccgtagtacgtacgggtaccg

SEQ ID NO: 158009 - DNA, 642 bp, Homo sapiens
  misc_feature: GYAE6OF02IA7O1.24.78.H01.1.454.CMB.1.raw
  modified_base (168)..(168): a, c, t, g, unknown or other
  misc_feature (168)..(168): n is a, c, g, or t
  modified_base (172)..(172): a, c, t, g, unknown or other
  misc_feature (172)..(172): n is a, c, g, or t
  modified_base (314)..(314): a, c, t, g, unknown or other
  misc_feature (314)..(314): n is a, c, g, or t
  modified_base (344)..(344): a, c, t, g, unknown or other
  misc_feature (344)..(344): n is a, c, g, or t
tcagactactatgtcacgaccggtgctcgatttagtgtgagtagtttgggtttggggagaggagcccagcactagaagtcggcggtgtttccattcggtgatcagcactgaacacagaggactcaccatggagtttggctgagcgtggttttcgcgtgctctttaagnggtntcagtcgtcgagggctagctggaggatcgtggggcgcgtggtaccaacgtgggatcccgtgagtctcgtcgtgcgcggcctccgtaaatttcaccttacggaattacttagtcggcagtcgcgtacgttcgggtcccaacgnggccttaccgaaggccgaagggtctagggnggtcggcgccgtacttagttcgtttagtgaaggtaggtaactaacgtctaagttacgtagccggtactacggtaccgtacgtagtaccggtctaccacgtctacctacgacgtacgactacgtacaatactactgttacttacgagtaactacgtacgtacgtacgtcgacgacgtacgtcgagacgtacgaccgtgttcgttactacgtgttacgacgtaaccgtacgtcccgttacccgtacttaccgttacgttacgttcgggtaccggtcccgtaccgttacgtcgtcggtacg

SEQ ID NO: 158010 - DNA, 926 bp, Homo sapiens
  misc_feature: GYAE6OF02IRH66.24.78.H01.1.454.CMB.1.raw
  modified_base (147)..(147): a, c, t, g, unknown or other
  misc_feature (147)..(147): n is a, c, g, or t
  modified_base (292)..(292): a, c, t, g, unknown or other
  misc_feature (292)..(292): n is a, c, g, or t
  modified_base (341)..(341): a, c, t, g, unknown or other
  misc_feature (341)..(341): n is a, c, g, or t
tcagactactatgtcacgaccggtgctcgatttagtgtgagtagtttgggtttggcacgaccggtgctcgatttagtgtgagtagtttgggtttggggagagctgctcagttaggaccccagagggaacccatggaaaccccagcgnagcttctcttcctcctgctactctggctcccagccatccaccggaggtattcgtgttgacgcagtcctccaggccaccctgtctttgtcctccgagggacgagtacgcccaccgtctcctgcgacggccagtcagtagtcgttancgagcagtccttattacgccttaggtacccaggacgtaaacggtaaccncgggtacctgggacccctaccgacggtccctaccgtacacttcttaggtcggtcgtacccgtcccgtaaccggacgggaccctacggtcggacccggttccgggacccggtaacttcggggtttaccacggggttcgggtaccggtaacggggttcgggtttaacccgggttttacggggaacccgttaaccggttacccgttttaaaccggtacccgtttaccgttaacccgtaacgtttaaccggttaacgttccggtaaaacccggtaccgggttaaacccggttacggggttaaacccgggtacccggtttaaaacggttttcgtttttaccggaaccggttttaagggttaaccgttttaacctttttaccgggtaacggttttacccgaaccgggttttttccggtttacccggggtttttcccgtttaaccccccggttttccgttttaaacccccgtttccgttttaaccgttaacccggtttttaacccgttttacccgggttttttcccgggtaaaccccgggttttaccgggggtttaacccgttttaaccccggggggttttaaacccggggg

SEQ ID NO: 158011 - DNA, 592 bp, Homo sapiens
  misc_feature: GYAE6OF02FMQSH.24.78.H01.1.454.CMB.1.raw
  modified_base (199)..(199): a, c, t, g, unknown or other
  misc_feature (199)..(199): n is a, c, g, or t
  modified_base (345)..(345): a, c, t, g, unknown or other
  misc_feature (345)..(345): n is a, c, g, or t
tcagactactatgtcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcacctgtctttgtctccgagggganagacgccaccctctcctgacagggccagtcagagtgtagcagcagctacttagcctggtaccagcaagaaacctggcctggcctcccgaggcctcctcatctagtggtcgccgtaccaccgacggccacgtggccgtcggcggacnggttcagtgggcaggtcgtcgtttgggactaggtacttcacgtctcatcactcgaacagtcgtagggacgtaccggtaagttactttgactaggtattatacgtgtcgacgtcgtttcggtttcgttcccgtcttcctacgttacgttcgttacttaccgtttgccgtacggttccgagtcggtaggtacgtactacgtaacggtccgtaacgttcggtcggtaccttcgaccgtaccttgttaccg

SEQ ID NO: 158012 - DNA, 704 bp, Homo sapiens
  misc_feature: GYAE6OF02JJRSI.24.78.H01.1.454.CMB.1.raw
  modified_base (245)..(245): a, c, t, g, unknown or other
  misc_feature (245)..(245): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggctcccagccatcaccggagaattgtgtgacgcagtctccaggccacccttgttctttcgtcctccgaggggtanagacgcccacctcctcctgcgagggccagtcagagtgttagcagcagctacgttagcctggtaccagcagtaaacctggccgtaggcctacccgacggccttccctactacttcgtaagttggtcgccgtacccgaccgacgggcccaacgtccgggtcgtccgggaccggtactaagggtccaggtcggcgtacggttggtaccgtttgggaaccgtagtaccttcgtaccttcgtacctattccgtatacgacgaagacgttcggaccgaccgaacgttatttcggaagtcgttacgtacgtttacgtgtaccgtagttcgtttcgggtttcccgtaccccgttttccctacccgtttaacctttcggttaacgttttaacccgtttaccggtttttaccgggttaacccgggttacccggggtttacccggtaaccgggtttcgttaaaccggggg

SEQ ID NO: 158013 - DNA, 539 bp, Homo sapiens
  misc_feature: GYAE6OF02G6SNG.24.78.H01.1.454.CMB.1.raw
  modified_base (329)..(329): a, c, t, g, unknown or other
  misc_feature (329)..(329): n is a, c, g, or t
  modified_base (341)..(341): a, c, t, g, unknown or other
  misc_feature (341)..(341): n is a, c, g, or t
  modified_base (350)..(350): a, c, t, g, unknown or other
  misc_feature (350)..(350): n is a, c, g, or t
  modified_base (372)..(372): a, c, t, g, unknown or other
  misc_feature (372)..(372): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgtctccaggggagagagcccaccctctcctgcagggccagtcagagtgtagcagcagctactagcctgaccagcaagaacctggcctggcctccaggctccnactctatggtcncgtccacgngggccacgtgggctcgcggacnggttccaggtgcagtgtcgttgggacagtactcactctcatcatcgacagacgtggacgccgaagtatttcgatagtgttattactgtctagtcttgtttcggtcccttctccttcctagttcgttacttacgttttcggccgtacgggtttccgtaggtcgtacgg

SEQ ID NO: 158014 - DNA, 554 bp, Homo sapiens
  misc_feature: GYAE6OF02GVA99.24.78.H01.1.454.CMB.1.raw
  modified_base (238)..(238): a, c, t, g, unknown or other
  misc_feature (238)..(238): n is a, c, g, or t
  modified_base (339)..(339): a, c, t, g, unknown or other
  misc_feature (339)..(339): n is a, c, g, or t
  modified_base (368)..(368): a, c, t, g, unknown or other
  misc_feature (368)..(368): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgctccaggganagagccaccctctcctgcagggccagtcagagtgttagcagcagctacttagcctggtaccagcagaacctggcctggctccaggctcctcatctatggtncgtccaccaggccagtcggcgtcgcgacnggttcagtgcagtggctttgggacagacttcactctcactcatccgacagtaccgtggacgacccgaagtacgttttgcgtagtgttacttacgtgtactagtcgttgtttacgtccccgtcttacccttctacgttcgttaccttacgttttcggacccgtacggtttcccgaggttcgtacggg

SEQ ID NO: 158015 - DNA, 847 bp, Homo sapiens
  misc_feature: GYAE6OF02JX8DC.24.78.H01.1.454.CMB.1.raw
  modified_base (319)..(319): a, c, t, g, unknown or other
  misc_feature (319)..(319): n is a, c, g, or t
tcagactactatgtcacgaccggtgctcgatttagtgtgagtagtttgggtttgggggaggagcccagcactagaagtcggcggtgtttccattcggtgatcagcactgaacacagaggactcaccatggagtttgggctgagctgggtttcctcgtcgctcttttaagaggtgtccagtgtcaggggcagctggtggagtcgtggggcgcgtggtccaaccgtgggacgtccctggacgtacctctccgtagtcgaccggtcctcccggattccaaccgttcaattacttagcggactatgactacgtggggttcccncgaggtcctaccgaagggcctaagggggcttagggaaggtcgggggttacgcccgggtacttacgtaccgtttagttcgtaagttagggtaaacttaaacgttacgtaaataagttttaagcgtaacggtaacgtaccgttaccgggtaaggtaaccgggggtacccggttttacaaccccgttacgttacccgtaacccgaacggtacggtaaacccgtaaacttaaccccgaaaacgttaaacgttaaccgtacgtttaacggtttaccgtacgtaaacgtaaaccttaacggaaccttaccggaccctttacggaaccgttacgttaaccggtccggtaaacggtaacccgtaacgggttaccgttacgttaaccgttacgtttaacttacgggttacgaaccgttaaggttaccccgtacccccgggttacccttttaacggttaacccgttaggtttaccggtttaccgggggttcccgacccccgttaaccgtacggttaccgggtacccgttacccggggg

SEQ ID NO: 158016 - DNA, 642 bp, Homo sapiens
  misc_feature: GYAE6OF02HH68E.24.78.H01.1.454.CMB.1.raw
  modified_base (268)..(268): a, c, t, g, unknown or other
  misc_feature (268)..(268): n is a, c, g, or t
  modified_base (433)..(433): a, c, t, g, unknown or other
  misc_feature (433)..(433): n is a, c, g, or t
tcagactactatgtcacgaccggtgctcgatttagtgtgagtagtttgggtttggggagaggagcccagcactagaagtcggcggtgtttccattcggtgatcagcactgaacacagaggactcaccatggagtttgggctgagcttgggtttttcctcgtcgcttcttttaagaggtgtccagtgtcgaggggcagctgggtggagtcgtgggggcggcgtggtccaaccgtggggagtccctgagactctcctgtgccgcctccgntcaccttcaatacttagtggcatgcacgtcgggtcccgccgaggtcctccgaggcgaagggggctgggaggtcgggtcggccgtcttagtctttattgagtaggaattaactactaaatattatgactagtaccgttcggtaggaacgggtcccggttacacctntacctccgagacgtaactaacttaccaaactaacttacttcttgtttctagtactaatcgtactacgctcggtactatcgtagacggacgacgtcgttgttactacgttcgtcgtagtaacgtaacgtacccgttccccgtacccgtttacgttaaccgttagtttacgggttccgggtcccgtccccgtacgtcggtaccggtacggg

SEQ ID NO: 158017 - DNA, 619 bp, Homo sapiens
  misc_feature: GYAE6OF02GMFAO.24.78.H01.1.454.CMB.1.raw
  modified_base (297)..(297): a, c, t, g, unknown or other
  misc_feature (297)..(297): n is a, c, g, or t
  modified_base (339)..(339): a, c, t, g, unknown or other
  misc_feature (339)..(339): n is a, c, g, or t
  modified_base (363)..(363): a, c, t, g, unknown or other
  misc_feature (363)..(363): n is a, c, g, or t
  modified_base (367)..(367): a, c, t, g, unknown or other
  misc_feature (367)..(367): n is a, c, g, or t
tcagactactatgtcacgaccggtgctcgatttagtgtgagtagtttgggtttggggagaggagcccagcactagaagtcggcggtgtttccattcggtgatcagcactgaacacagaggactcaccatggagtttgggctgagctgggttttcctcgtcgctcttttaagaggtgtccagtgtcaggggcagctggtggagtcgtgggggcgcgtggtccaaccgtgggaggtccctgagactctcctgtgcggcctccgattcaccttcaatacttatggcatgcactgggtccnccaggcctccagggacaagggggctgggagtggggtcgccgntatcttattgatggaatatcaatntatncagactcgtaggaacgggtccgttacaccctatcctccgaagagaacctaacttaccaaactaacttactcttacgtttctacgtactaaagtcgtaacgtacgtcctgacgtactcgtagacggtaccgacggtctcgttacttacttacgttgtacgacgtaaacggttcccgttaccccggtaccctttacgttaccgtaagtttacggttcgggggtcccgtaccccgtacgtcggtacggtaccggg

SEQ ID NO: 158018 - DNA, 920 bp, Homo sapiens
  misc_feature: GYAE6OF02HWJDN.24.78.H01.1.454.CMB.1.raw
  modified_base (235)..(235): a, c, t, g, unknown or other
  misc_feature (235)..(235): n is a, c, g, or t
  modified_base (269)..(269): a, c, t, g, unknown or other
  misc_feature (269)..(269): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatgggaaaccccagcgcagcttctcttcctcctgctactctggctccagccatcgaccggaggtattgtgttgacgcagtctccaggccaccgtgtcttttcgtcnccgtaggggagacgacgacccaccctcttaccgngaccgacgggccagtacgtacgaaggtttagttaacggcctaggaccgtagtaccgtttaacgttacggtacccgtcggttaacccgaaggtacccgtaaaacgggtaaaaccgtcgggtaacccgttgggacccccgttaccccgaacgggttcccgtacctttacaacgttaccgttaacgtttacggggtccgttaaccccgtacccgggtaaccgggtacggggtaaccccgtaaggttccggggtccgttaccggggacccggggtaaaacggttccgggttaaccgtacggggtcgggttaccggtaacggggtttaacggggtttcccggttttacggggggtaaccgtaacgggttaaccctttcggttaaaccctttcgtaccgttaacgttaccgtaaccggtttaacgaaccggtaacgggttaaccggtacggtaaccgggtaacccgtaacggtttacgtttaacgtaccgttaagttacggtttaacttacggtttacgtacggttaacgttcccggttttcgtttacccggtttcccgtaccgttttcccgttacgttaccgttaaccgttttaccgttacgggttttacccgggaccgtttaaccggggtttacccgtagggttccgttaacggg

SEQ ID NO: 158019 - DNA, 650 bp, Homo sapiens
  misc_feature: GYAE6OF02JEZH1.24.78.H01.1.454.CMB.1.raw
  modified_base (240)..(240): a, c, t, g, unknown or other
  misc_feature (240)..(240): n is a, c, g, or t
  modified_base (373)..(373): a, c, t, g, unknown or other
  misc_feature (373)..(373): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggctcccagccatccaccggagaattgtgttgacgcagtctccaggcacctgtctttgtctccgagggganagacgccaccctctcctggacagggccagtcagagtgttagcagcagctattagcctggtaccagctaagaacctggacctggcctcccgaggcctcctcactctagtcggtcgccgtaccacgtcgggaccncgtcggtcgtacgaccgggactagggttccagggttcgacgtacggtcggtcgtttacgggactaacggtcttacgactcgtacacgttcgaacgttaccgacgtacggaacgtcggaaccgtaccggtaaagttcgttttacgacgtttaacggtacgttaacgtttacgtcgttaccgtacgttcggtttcgttccggtacccttcttaaccttcgtacttacggttaccttacggttttcggacccgttaggttacccgtagggtcttaacggg

SEQ ID NO: 158020 - DNA, 704 bp, Homo sapiens
  misc_feature: GYAE6OF02JIJNA.24.78.H01.1.454.CMB.1.raw
  modified_base (244)..(244): a, c, t, g, unknown or other
  misc_feature (244)..(244): n is a, c, g, or t
  modified_base (466)..(466): a, c, t, g, unknown or other
  misc_feature (466)..(466): n is a, c, g, or t
tcagactactatgtcacgaccggtgctcgatttagtgtgagtagtttgggtttggcacgaccggtgctcgatttagtgtgagtagtttgggtttgggggagagctgctcagttaggacccagagggaaccatggaaacccccagcgcagcttctcttcctcctgctactctggcctcccagccatcaccggaggaattgtgttgacgcagtctccaggcaccctgtctttgtctccgagggganagacgcccaccctctcctgcagggccagtcagagtgttagcagcagctacttagcctggtaccagcaacgaaccgtggcctggcctcccacggcctcgtcatctagtggtcgcctccaccgcggccacgtcggacgtcgcggacgtacggttcaggtcgcgtacggtcggtcggtttgggactaggtacccttcacgttctacacgtactacgccgtaacgngtaccgtcgggaccgtaccgaaggttacgttttcggaccgttaaggttacgtttaacgtttaccgttacggtaaccgtagtttacccggttttacggtttttacccgggtccccctttacccggtttaccccttaccgttttaaccgggttaccgtttaacccgttttaccggggttttaccgggtacccccggtttacgggggttttaccccgtacggggttccggtttaaccgggg

SEQ ID NO: 158021 - DNA, 814 bp, Homo sapiens
  misc_feature: GYAE6OF02I7GJ5.24.78.H01.1.454.CMB.1.raw
  modified_base (188)..(188): a, c, t, g, unknown or other
  misc_feature (188)..(188): n is a, c, g, or t
  modified_base (237)..(237): a, c, t, g, unknown or other
  misc_feature (237)..(237): n is a, c, g, or t
tcagactactatgtcacgaccggtgctcgatttagtgtgagtagtttgggtttgggcacgaccggtgctcgatttagtgtgacgtagttgggttgggagagctgctcagttaggacccagagggaaccatggaaaccccagcgcagcttctcttcctcctgctactctggctcccagccatcaccggnggaattgtgttgacgcagtctccaggcacctgtcttgctccaggggtanagagccaccctctacccgtgcgtagggcccaggttccaggaagtgttagcaagtccaagcgtaacttgccttggtaccagcagaaacctggaccttggcctcccaggcctccgtacagtcctagttcggtcgtaccgtcccgtaaccgacggggtaccctaaccgttcggggcccgttaccgggaccgggtacccgttaacggggtttcccgtaacgggttcgggacccgtaagggttcgggttaccgttttacgggggaaccctaacgggtaccgttttaccgaccgtttaccgttaccgtaacgttccgaacgtttccggaaccgtacggtaaaccgtcggggtaacgaccccgggtaaagttaccgttttacggcccgtaaggtttcggttaaaccgtttccgttacgggttacctaacggggttccctttgggttttaccgggttacccccgttttaccggttaccccgtttttacccgttaacggttttccgtttaacccgttacccggttttttaggtaccccccgggtttaagggtttacccccgtagggttacccccgttttaacgggg

SEQ ID NO: 158022 - DNA, 719 bp, Homo sapiens
  misc_feature: GYAE6OF02FJEAI.24.78.H01.1.454.CMB.1.raw
  modified_base (246)..(246): a, c, t, g, unknown or other
  misc_feature (246)..(246): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgctagtctccaggccacccttgttctttgtcctccgagggganagacgcccaccctctcctgcgacgggccagtcaggagttgtagcagcagctactcgcctggtaccagcaagtaaccgtggccgtggcctcccaggtcctcctcatctagtgggctccgtacccgaccgacggggtcccacggtcgggtacggtccggaccgggtactaaccggggttttccgaagggttccggggacgtacgggttacgggtaccggttttcggggaacgtaacgggttacccgtttaccgtaaccgttcccgtaccgtaacttaccgtaacgttaccgaaccgacggtaaccgtacgggtaaccgacccggtaacgttagttttcggaccgtaggtttacgttacgtttaccgtgttccgtagttcgtttaccgttccggttcccttaccttcccttaccgttacgttccgttacgttaccgttttccggtaccggttacggttccgtacggtcgtaacggg

SEQ ID NO: 158023 - DNA, 895 bp, Homo sapiens
  misc_feature: GYAE6OF02HCSWH.24.78.H01.1.454.CMB.1.raw
  modified_base (156)..(156): a, c, t, g, unknown or other
  misc_feature (156)..(156): n is a, c, g, or t
  modified_base (172)..(172): a, c, t, g, unknown or other
  misc_feature (172)..(172): n is a, c, g, or t
  modified_base (213)..(213): a, c, t, g, unknown or other
  misc_feature (213)..(213): n is a, c, g, or t
  modified_base (235)..(235): a, c, t, g, unknown or other
  misc_feature (235)..(235): n is a, c, g, or t
  modified_base (273)..(273): a, c, t, g, unknown or other
  misc_feature (273)..(273): n is a, c, g, or t
  modified_base (315)..(315): a, c, t, g, unknown or other
  misc_feature (315)..(315): n is a, c, g, or t
tcagactactatgtcacgaccggtgctcgatttagtgtgagtagtttgggtttggggagaggagcccagcactagaagtcggcggtgtttccattcggtgatcagcactgaacacagaggactcaccatggagtttgggctgagctgggttttccncgtcgctcttttaagnggtgtccagtgtcaggggcagctggtgagtcgtgggggcgngtggtccaacgtgggacgtccnggagctctccgtgtcgccggcctccgattccgaccttnaaattaccttagtcggactagtcgacctacgtcggggtcccnccgaggtccctaccgagggcggtaacggggctaggggacgtcggggtcggacccgtcttagtttccgtttaagtttcggaagttagggtaaaacgttaacttacgtaaaatttagttacgttacggaccgtaaacggtaccgtttaccggggtaagggtaaaccgggggttccccgtttaaccaacccgttagttacccgtaccgtaacggtaaccggtaaaccttaaaccgttaaccctaaaaccgttaaacgttaaacccgtttaccgttttacgttttaccgttacggttaaaccgttaaacgttacggtaaccgtttaaaccggtaccgttaccgggttaccggtaccttacggttaccgggtaacgggtaacccggtaccggttccggttacgtttaccgttaacgttttacggttacggttaccggtaaccggttaaaccggttaccccggtttaccccccgggttacccgttttaacccggttaacccggtttaacggttttacccggggttttaccggggttaccccgggttaccccccgtttaacggtaccggttaccgggttaacccggg

SEQ ID NO: 158024 - DNA, 801 bp, Homo sapiens
  misc_feature: GYAE6OF02IQKCI.24.78.H01.1.454.CMB.1.raw
  modified_base (123)..(123): a, c, t, g, unknown or other
  misc_feature (123)..(123): n is a, c, g, or t
  modified_base (293)..(293): a, c, t, g, unknown or other
  misc_feature (293)..(293): n is a, c, g, or t
  modified_base (336)..(336): a, c, t, g, unknown or other
  misc_feature (336)..(336): n is a, c, g, or t
tcagactactatgtcacgaccggtgctcgatttagtgtgagtagtttgggtttgggggaggagcccagcactagaagtcggcggtgtttccattcggtgatcagcactgaacacagaggactnaccatggagtttgggctgagctgggttttcctcgtcgctcttttaagaggtgtccagtgtcaggggcagctggtgagtctggggcgcgtggtccaacctgggaggtccctgagactctcctgtgcggcctccgattcaccttcaatacttatggcatcgcactgggtccnccaggcctccgaggcaaggggctcggaggtcgggtcggccgtntacgttccgttaagttttcgaattgggaaattacgtacaaattatttaattggactaagtacgttccggtagaaacggggtcccggtttacaaacccgtctaccgttacccgaacgggtacgaaaccgtaaacgttacccgaaaaccttaaattaaaccgttaccgttacggtttttacccgtagttaaccgtaaaagtacggttaaacccttaacggtacccgttaaggtcccgtaacgttaaccgttacggaacgggtaaccgtaaccgggtccgttacgggttaaccctttaaacgttttaaccgtacgggttacggttaaccgggtaaacgttaacccgggtttaaccccccggttacctttaaccggtttaacccccgtaagttttttaacgggttacgggggttaccggtacccccccgttaacgttaaccggttaccgggtaaccgtttaacccgggg

SEQ ID NO: 158025 - DNA, 703 bp, Homo sapiens
  misc_feature: GYAE6OF02GYWK2.24.78.H01.1.454.CMB.1.raw
  modified_base (278)..(278): a, c, t, g, unknown or other
  misc_feature (278)..(278): n is a, c, g, or t
  modified_base (298)..(298): a, c, t, g, unknown or other
  misc_feature (298)..(298): n is a, c, g, or t
tcagactactatgtcacgaccggtgctcgatttagtgtgagtagtttgggtttggggagaggagcccagcactagaagtcggcggtgtttccattcggtgatcagcactgaacacagaggactcaccatggagtttgggctgagctgggttttcctcgtcgctcttttaagaggtgtccagtgtcaggggcagctggtggagtcgtggggcgcgtggtccaacgtgggacgtcctgagactctcctgtgcggcctccgattccaccttcaatacttanggcatcgcacgtcgggtccnccgaggcctccgaggccaaggggctgggacgggtggggtcgcccgtacttaagttcgttttagttggacgttagggtaaagttaacgtactaaatttaagtttactcggacctaaggtacccttacccgggttaaggaaacccggggtccgggtttaccaacccggttactcctacccgaagggtaacaacgtaacttacccgaaaactactaccttacgtctttacgtcgaactaaagttcgaacctcgcctagacgtatcgtaggacgacgtaccgcttagtaccttaagtttaccttacgacgttaaacgtcccgtttacccccggtaccttttacgtaacgttacgtttaggtacccggggttccgaccccgttacgtacggttcgggtaccgttacgggg

SEQ ID NO: 158026 - DNA, 627 bp, Homo sapiens
  misc_feature: GYAE6OF02JPXER.24.78.H01.1.454.CMB.1.raw
  modified_base (179)..(179): a, c, t, g, unknown or other
  misc_feature (179)..(179): n is a, c, g, or t
  modified_base (253)..(253): a, c, t, g, unknown or other
  misc_feature (253)..(253): n is a, c, g, or t
  modified_base (348)..(348): a, c, t, g, unknown or other
  misc_feature (348)..(348): n is a, c, g, or t
  modified_base (352)..(352): a, c, t, g, unknown or other
  misc_feature (352)..(352): n is a, c, g, or t
  modified_base (359)..(359): a, c, t, g, unknown or other
  misc_feature (359)..(359): n is a, c, g, or t
  modified_base (379)..(379): a, c, t, g, unknown or other
  misc_feature (379)..(379): n is a, c, g, or t
  modified_base (595)..(595): a, c, t, g, unknown or other
  misc_feature (595)..(595): n is a, c, g, or t
tcagactactatgtcacgaccggtgctcgatttagtgtgagtagtttgggtttggggagaggagcccagcactagaagtcggcggtgtttccattcggtgatcagcactgaacacagaggactcaccatggagtttgggctgagctggttttcctcgtcgctcttttaagaggtgtccngtgtcagggggcagctggtggagtcgtgggggcggcgtggtccaaccgtggacggtccctgagactcctccgtntgccggcctccgattccaccttcaattactagtggacatgctacgtcgggtcccgcgacggcctccgaggacgaggggctggagtggggtggccntatnttattgnttaggaatatcgaattattncgcagtacctcggtagaacgggtccgttaccacgtatcctaccgagacactaactaccaaacattacctcgttagttcttacgtactaaatcgtactaacgttcccagtcgttaatccgtagtaaccggacgtaccggtcttacgttcgttaactttcgggtattacgaacgtacggtcccttcccggttcttaaccgttagtagttttaccgggngggttacccgtccctatacggtcgtaacccgg

SEQ ID NO: 158027 - DNA, 714 bp, Homo sapiens
  misc_feature: GYAE6OF02JN4XZ.24.78.H01.1.454.CMB.1.raw
tcagactactatgtcacgaccggtgctcgatttagtgtgagtagtttgggtttgggagagctgctcagttaggacccagagggaaccatggaaaccccagcgcagcttctcttcctctgctactctgctcccagccatcaccggaggaacttgtgttgacgcagtctccaggcacccgtgtctttgtctccgaggggatgagcccacctctcctgcagggccaggtcacgagtcgttagctagccaggtactacgtttacgcccgtaggtacccagaccgaacgtaaaaccgtcggtcccgtcggtccttaccccgaacggtcccttccctaccgtacttaccgtagtcggtcgtccgtacccgaccgtacgggcctacgtcggtacgtccggcggaccgtcgggtactacggtcgggcgtagtcggtcgttttacgggaacgtcggtacttccgacgttccgtacgtactacgtacgtacgtaacgtacgtacgtagggaccgtacccgaagttcgtttacgaccgtagttacgttactttaacgtgttaaccgtcgtcgttcggtttccgttccgttacctcccgttacttacgttcgttaacgttcgttttacggacccgttacgggttaccacggttcggtacggtacgttacttcggaacgttacccgaaggttcggtacggtaccgtacgtaccgtacgtacttacgg

SEQ ID NO: 158028 - DNA, 908 bp, Homo sapiens
  misc_feature: GYAE6OF02ILI6E.24.78.H01.1.454.CMB.1.raw
  modified_base (174)..(174): a, c, t, g, unknown or other
  misc_feature (174)..(174): n is a, c, g, or t
tcagactactatgtcacgaccggtgctcgatttagtgtgagtagtttgggtttggggagagctgctcagttaggacccagagggaaccatcggaaacccccagcgcagcttcctcttcctcctgcctactcgtggcctccagccatccacggaggattgtgttgacgcgagtcnccaggccaccttgtctttcgtacctccggaggggtacgagacgacccctacccttccgtccgtcgcggaacgggccaggtacgacgtaggtcggttaacgcaacggtcctaaggtaccttaaccgtttacggaccgttacgggtaacccaggtaacctaaccggttaaaacccggtcggtaccgttcgggacccgtaccccgtacgggtcccctaccgttactacgttacgttaggtcgggttccgaccggtacccgaccggtacggccctacggttcggccggtacgaccggtacggtacggtcgtaggtcgacgtaggttcggtacgttacgggactacgtacgttcctacgtctaccgactttcgagtacggaactacggtacctacgggaaccgtaacccggttagtacgtttacggaaccgttaggttacgttaaccgtttacgtacgttaccgttacggtttccggttttacggtttacccggtttccccttacccgttttacccgttaccgttcgttttaaccggttacccgttttaccgggtttacccggggttaccgtaacccggggttttaccgtacggggttaaccgtttaccgggggtaaccgttaaccggttaaccgggtttaaaccccggaccgggttttaacccgtttacgggggttaaccgggtttaacccgtacccggggttaaccccggttacccgttttcccggtttaacccggg

SEQ ID NO: 158029 - DNA, 724 bp, Homo sapiens
  misc_feature: GYAE6OF02HSP0B.24.78.H01.1.454.CMB.1.raw
  modified_base (205)..(205): a, c, t, g, unknown or other
  misc_feature (205)..(205): n is a, c, g, or t
tcagactactatgtcacgaccggtgctcgatttagtgtgagtagtttgggtttggggagagctgctcagttaggacccagagggaaccatggaaaccccagcgcagcttctcttcctcctgctactctggcctcccagccatccaccggaggaattgtgttgacgcagtctccgaggccaccctgttctttgtctccgaggggangacgcccaccctctcctgcgacgggccagtcagtgttgtagcagcagctacttagcctaggtaccagcaagaacctggccgtcgcctccgagcctcctctatactagtcggtcgcctaccgaccgacggccacgtggccgtcggcgtacgtaggtccaggtcggctaggtcggttcgtttaggactacgtaccttcgaccttctacgactactacgtacgaaccgtaacgaccgtaggtacccgaaccggttaatttcgttacgcgtttaacggttacgttatttaccgcggttaactcgggtttcgttttaccgggtttccgttacccccgttacgtttaccccgtttacttaacggttttacccgttaaccgttttttaacccggtttccggaaccccggttttaccgggtttccggaaccgggttcgtaagggtaaccgttacggttaaccggaacggttaccggttaacgttccgggttacgtccgttaccgaacccgttaccgtacgtttcccg

SEQ ID NO: 158030 - DNA, 692 bp, Homo sapiens
  misc_feature: GYAE6OF02JA8AS.24.78.H01.1.454.CMB.1.raw
  modified_base (239)..(239): a, c, t, g, unknown or other
  misc_feature (239)..(239): n is a, c, g, or t
tcagactactatgtcacgaccggtgctcgatttagtgtgagtagtttgggtttggcacgaccggtgctcgatttagtgtgagtagtttgggtttgggggagagctgctcagttaggacccagagggaaccatggaaaccccagcgcagcttctcttcctcctgctactctggcctcccagccatcaccggaggaattgtgttgacgcagtctccaggcacctgtcttgctcgagggganagagcccaccctctcctgcgaggccagtcagagtgtagcagcagctactacgccgtagtaccagcgagaaaccctggcctcggacctcccgaaggcccttccgactactcctagtcggtcgccgtacccaaccggacggggtcccacgttcggccggttaccggaccgggtaaccaacggggtttaccgaagggtcggacgtacgggttcggtacggtttacggggacgtaacggtacctttcgaccttccgtactactacgtacgtacgacgtaacgtacgtaccggaccgtacccggtaagttacgttttacgacgtaggttagttactttacgtacgtacaggttcgtttacgtttccggtcccgttccgttcccttacttacgttacggttacctttacgggttttaccggaccggttaccggggtttaccggacggttcgttaacggg

SEQ ID NO: 158031 - DNA, 863 bp, Homo sapiens
  misc_feature: GYAE6OF02GD4E2.24.78.H01.1.454.CMB.1.raw
tcagactactatgtcacgaccggtgctcgatttagtgtgagtagtttgggtttggggagaggagcccagcactagaagtcggcggtgtttccattcggtgatcagcactgaacacagagactcaccatggagtttggctgagcttgggttttcctcgtcgcttcttttaagaggtgtccagtgtcgaggggcagctggtggagtcgtgggggcggcgtggtccaaccgtgggacggtccctgagactctcctgtgccggcctcccgattccacctttcaattaccttatggcattcgctacgtcggtccgccaggccctaccgagggccgaaggggtctagggacggtggggtcgggcccgtacgttacgttcgtttagttttgagttagggtaaacttaatactaaagttattagtcgactaaggtacctccgggtaggtaacggggtcccgttaccgaacctacgttcccgttaccaacggaaacgtaaccgtaaaaccgtttacccgaaaaccttaaacctttaaccgtttaccgtttacgttttacccgttacggtaaacctaaaacgtttcggtaaaccgttaccggtacccgttaccggtaaccggtaacgtttaccggtacgggtaaaccgggaacccggtaaccgggttaccgtttaccgttaacccgttttaacgtttaacccggttacggttacggtaacccggttaaaaccgggttacccccggttttacccccccggttaaccccgtttttaacccgtttaaccggtttaaccggtttaaccggggttttcccgggggttaccccggtaacccccccgtttacggttacggttacccggggttaacccggg

SEQ ID NO: 158032 - DNA, 642 bp, Homo sapiens
  misc_feature: GYAE6OF02FWC80.24.78.H01.1.454.CMB.1.raw
  modified_base (350)..(350): a, c, t, g, unknown or other
  misc_feature (350)..(350): n is a, c, g, or t
tcagactactatgtcacgaccggtgctcgatttagtgtgagtagtttgggtttggggagaggagcccagcactagaagtcggcggtgtttccattcggtgatcagcactgaacacagaggactcaccatggagtttgggctgagctgggttttcctcgtcgcttcttttaagaggtgtccagtgtcaggggcagctggtggagtcgtgggggcggcgtggtccaaccgtgggacgtccctgagactctcctgtgcggcctccgattccaccttcaatcttatcggcatgcacgtcggggtcccgccaggcctccgaggccgaagggggtcctgggagtggggtcgcccgntagttctttagttggatggaaagtatactaaattattatgacacgtactcggtaggaacggggtccgttacaacctgtccctacgaagacaacctaacttaacccaaactaacttaccttcttacgtttcctagtaacctaaatcgtaacctacgtcctggactagtacgtggaacggtacgacggtcttacgttactagttactggtacgaaccggtaacgtaccgttccccggttccttacgttacgtagttacggttccggggtaccgtcccctagtacgtcggtacgg

SEQ ID NO: 158033 - DNA, 673 bp, Homo sapiens
  misc_feature: GYAE6OF02H2OEC.24.78.H01.1.454.CMB.1.raw
  modified_base (237)..(237): a, c, t, g, unknown or other
  misc_feature (237)..(237): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggctcccagccatcaccggagattgtgttgacgcagtctccaggcaccctgtctttgctccgaggganagacgcccacctctcctgcagggccaggtcagagtgtagcagcagctattagcctgaccagacaagaacctggctggcctccgaggtcctcctacgtatctagtcggtcaccgtccacgtacgggcccagtcgggtacgtccggcggtaacgtccgggtttcagggttcgggacgtaggtcggttcgtttcgggactacggtacttcgacgtctactagtctacgttacgactaacgtacgtaggaccgaccgtaagtacgtttagacgttaggttacgttaagtttaccgcggttacgttacggtccgttttccgggtttacgttccccgttcgtttccccgtttaaccttaaccgtttaccgttaaccgtttaccggtttttaccggacccgggtttaacggtttaacccgggtacgggttacgtttaaccggg

SEQ ID NO: 158034 - DNA, 690 bp, Homo sapiens
  misc_feature: GYAE6OF02IFY68.24.78.H01.1.454.CMB.1.raw
  modified_base (157)..(157): a, c, t, g, unknown or other
  misc_feature (157)..(157): n is a, c, g, or t
  modified_base (276)..(276): a, c, t, g, unknown or other
  misc_feature (276)..(276): n is a, c, g, or t
  modified_base (286)..(286): a, c, t, g, unknown or other
  misc_feature (286)..(286): n is a, c, g, or t
  modified_base (292)..(292): a, c, t, g, unknown or other
  misc_feature (292)..(292): n is a, c, g, or t
  modified_base (471)..(471): a, c, t, g, unknown or other
  misc_feature (471)..(471): n is a, c, g, or t
tcagactactatgtcacgaccggtgctcgatttagtgtgagtagtttgggtttgggagaggagcccagcactagaagtcggcggtgtttccattcggtgatcagcactgaacacagaggactcaccagtggagtttggctgagtcttgggttttccncgtcgcttcttttaaggaggtcgtccagtgtacgagggcagcgtggtaggacgtcgtgggggcgtgtggtaccaacgtgggacgtcctgacgtctctcgtgcgcgcctcgattcacttnaattacttanggctancgacacgtcgggtaccacgacggcctaccgaaggacggtaacgggggtctaaggggtggttcgggtccggcccgtattaacgtttcttttaagttggaagtttaagggaaacttattactaaagtttataacgtcgaactaacgtaccgtcgggtaagaacggggttcctacaaccgtntccgtacgagaacgtactaaactaacaacgtaacttactactttacgttactaacgaactaacgtagtaactacgtacgtacgactacgtacgtacgacggtacgacgttcttacgtacgttacgttacgtcgtacgaacgtacgtacccgttacccgtacttacgttacgtacgtttacggtaccggttacccgtacccgtagtacggttacgtacgg

SEQ ID NO: 158035 - DNA, 676 bp, Homo sapiens
  misc_feature: GYAE6OF02G6OZV.24.78.H01.1.454.CMB.1.raw
  modified_base (205)..(205): a, c, t, g, unknown or other
  misc_feature (205)..(205): n is a, c, g, or t
tcagactactatgtcacgaccggtgctcgatttagtgtgagtagtttgggtttgggggagaggagcccagcactagaagtcggcggtgtttccattcggtgatcagcactgaacacagaggactcaccatggagtttgggctgagcttgggttttcctcgtcgcttcttttaagaggtgtccagtgtcgaggggcagctggtggngtcgtgggggcgcgtggtccaccgtgggacgtcctgagacctctccgtgtcgccggccctcccgattccaccttcaaacttacttagtggcagtcgctacgtggtcccggaccgacggcgtacccgaggccgaaggggtcgtgggaggtggggtcggccgtctagttctttagttgagtaggtaattaattcgaattattatgacgagtacgtccgtaggaacgggtccgttacacctactactcagacgaactaactaccaataactctacttcgttcgtatactaactgtactacgtccgtagcgtataccgtagtaccgacgtaccgtcgttaccgttcgttaagtttaccggtagtacggtaaccgtaaccggttcccgtttacccccgttacccgtttacgttaaccgtagttttacggttaccgggttacccgtaccccgttacgtacggttacgggtaaccggg

SEQ ID NO: 158036 - DNA, 789 bp, Homo sapiens
  misc_feature: GYAE6OF02GHS9M.24.78.H01.1.454.CMB.1.raw
  modified_base (173)..(173): a, c, t, g, unknown or other
  misc_feature (173)..(173): n is a, c, g, or t
  modified_base (401)..(401): a, c, t, g, unknown or other
  misc_feature (401)..(401): n is a, c, g, or t
tcagactactatgtcacgaccggtgctcgatttagtgtgagtagtttgggtttggggagaggagcccagcactagaagtcggcggtgtttccattcggtgatcagcactgaacacagaggactcaccatggagtttgggctgagctgggttttcctcgtcgcttcttttaagnggtgtccagtgtcaggggcagctggtggagtcgtgggggcggcgtggtccaaccgtgggacggtccctgagactctcctggtcgccggtcctcccgattccaccttcaatacttatggctatgcacgtgggtccgccaggcctaccgaggccgaagggggtctgggagtggggtcggccgtattattcgtttagttgaagtagggaaagttaactctaaattattagngactaaggtaccttccggtaggaaacggggttccccggttacaaccgtagttacctaccgaagtaacgaactaaaccttacccgaaaacctaaacttaccttacgtttcgttttacgtacgtaacgtaaacgttacgtaaccgttaacgtcccgttaggtaccgtaacgttaccgttacgggaaaccgggtaaaccggtaccgggtaccgttacgttaccgtttaaacgtttaccggttacggttacggtaaccgggtaaaccggtttccccggttacccccgggtttaccccgtttaacccgtttaacggttaacgtttaaccgggttttccgggggtaaccccggttaccccccgtaacggttaccggtaccgggttaacccgggg

SEQ ID NO: 158037 - DNA, 686 bp, Homo sapiens
  misc_feature: GYAE6OF02IWK3Y.24.78.H01.1.454.CMB.1.raw
tcagactactatgtcacgaccggtgctcgatttagtgtgagtagtttgggtttggggagagctgctcagttaggacccagagggaaccatggaaaccccagctcagcttctcttcctcctgctactctggctccagagaccgccggagaaggtgtgttgtcgcacgtccccgaggccaccctgtcgttgtctccgaggggacacgagccactcctcctcctgcgaacggaccagtcacgcctctctacctaacccttacgccgttggttacccaaacgaaaacgtccgtacggaccacgtacctaccaccgtacctcgtacattacctatagtactaacgataaccggaaaacggccgacgtcgggacctacccgacgcgtacggtcgcgtaggcgtaggttcgggcgtcggacacgtactctacctcacacatacagtacgtacgcgtggacgtaacgtaggtaacgtttaatttgaacgtaagttgttacttactacgtacagtccgagtacgtacgtaacgtactccgtacctaccgtaagttacctttacttaaccggtttcggaccggttaacgggaaacctaggtacgtaggaaccttagtaccgaaccggtaacggtacgttagtccgggtaacctccgtaacgaacccgtagtttaaccttcggtttacttaacccgg

SEQ ID NO: 158038 - DNA, 759 bp, Homo sapiens
  misc_feature: GYAE6OF02G6EH7.24.78.H01.1.454.CMB.1.raw
  modified_base (237)..(237): a, c, t, g, unknown or other
  misc_feature (237)..(237): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcacctgtctttgctcgaggganagacgccaccctctccgtgcgacgggccagtcagagtgttagcagcacgctaacgttagcctaggtaccaggacctaacggaaaacccttggccctaggaccctacccgaagggtcccttaccgtactaacgttactacgtcggtacgtccggtacccaaccggacggacctaacgtcggggccgttaccggaccggtaacgtacgggttacgtaacggtgggaccctaaggtcgggttaccgttttacgggggaacctacgggttaccttaccgtaacgttccgttaacgtacttaccgaacgttaccgaacgtaacggaaccgttcgggaaaccgtacccggttaaagttacgttttaccggaacgttaaccggttagtttaaacgttttcggtacgttacgtaccggtcgttttacggtttaccggtaccctttccgtaacccttccgttaacgtaccgtttaaccgttacggttttaccggacccggtacgggtttacccgtacggtcgtttaacggg

SEQ ID NO: 158039 - DNA, 797 bp, Homo sapiens
  misc_feature: GYAE6OF02IC02S.24.78.H01.1.454.CMB.1.raw
tcagactactatgtcacgaccggtgctcgatttagtgtgagtagtttgggtttggcacgaaccggtgctcgatttaagtgtgagtagtttgggtttggggagagctgctcagttaggacccagagggaaccatggaaaccccagcgcagcttctcttcctcctgctactctggtctcccagccatccaaccggaggtaattcggttgttgacgcagtctccaggccaccctgtctttcgtccgtccgaggggagagacgcccacccgtctcctgcgacggccagtcagagtgttagcgacgccacgctacttacggccttaggtaccgacgacgtaacgtaaaccgtcggaccgtcggtccctcccgtacggtcccttcttcctacttacgtacgtcggtacgtccgtccgaaccggacggtaccctacgtcggtccgtaccggtccgtaacgtcgggttacacgggtcggtacgtacggttcgggtacgtttacgggaaccgtaacgtaccgtttaccgtacgttacctaccgtttataacgttaaccgtaccgtaaccggtaacggtacccgtaagggtacccgtaaccggtaaacggtttaccgtttttaggacgtttaacggttcggtttaacggtttaccgtacggttacgtacggtttccgtttacgggttttaccccggtttacccgttcccttacccgttacccgttaacgtttcccggtttaaccgtttccggttttacccggtcccggtttaccggggttaccgttacccggggtacgttacccggg

SEQ ID NO: 158040 - DNA, 746 bp, Homo sapiens
  misc_feature: GYAE6OF02GB4AP.24.78.H01.1.454.CMB.1.raw
tcagactactatgtcacgaccggtgctcgatttagtgtgagtagtttgggtttgggggagagctgctcagttaggacccagagggaaccatggaaaccccagcgcagcttctcttcctcctgctactctggctcccagccatcacggaggattgtgttgacgcagtctccaggcacccttgtctttgtctccgaggggagagacgccaccctctcctgcagggccagtcagagtgttacgcagcagcttacttacgccgtggtaccagacaagaaacctcggcctggcctccccgaggcctccctctactctagtggtcgccgtccgaccgacggtcccacgtcggccgtcggcggacctggttacacggtcggaccgtggttcgggtcgttttacgggaacgtacggtacctttccgaaccgttccgttacctacgttaccgtaacgtaccgtaacccgtaacgggtaaccgtcggggtaaacccgtaaccccgggttaaagtttaacggtttttaccggacgttaaccggtttacggttttaaacgtttacgtttaccggttacgtacggttacggttttacggttttcccggtttcccggtttacccttcccgtttaccctttacgtttaccgtttaacccgtttcgtttaccggtccggttacggttacccgtggtcgtacggtaacgtacgtacggtacgtaacgtacgttcggtacggacgtcgtaccgtactagttccg

SEQ ID NO: 158041 - DNA, 609 bp, Homo sapiens
  misc_feature: GYAE6OF02G42DU.24.78.H01.1.454.CMB.1.raw
  modified_base (199)..(199): a, c, t, g, unknown or other
  misc_feature (199)..(199): n is a, c, g, or t
  modified_base (542)..(542): a, c, t, g, unknown or other
  misc_feature (542)..(542): n is a, c, g, or t
  modified_base (603)..(603): a, c, t, g, unknown or other
  misc_feature (603)..(603): n is a, c, g, or t
tcagactactatgtcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgtctccagggganagagccaccctctcctgcagggccagtcaggagtgttagcagcagctacttagcctggtaccagcagaaacctggcctggctcccgaggcctcctcatctagtggtcgcgtccaccgagggccacgtggcgtcgcggacaggtcgagtgcaggtggtcgtttgggacagacttcactctactatcacgtcgacacgacgtcgggaccgtaccggtaagttcgtttacgacgtagttacgttaacttacgttcgtacgtacgttcgttacggtttacccgttcccttccgttcccttaccgttacgttcgttaacctttcggttaccggtcgtaccggttccgnggcgttaggaactcgtaacgtaacggtaccgtagttcggtcgtaccgtacgacctacgttnttaccg

SEQ ID NO: 158042 - DNA, 819 bp, Homo sapiens
  misc_feature: GYAE6OF02IYN4X.24.78.H01.1.454.CMB.1.raw
tcagactactatgtcacgaccggtgctcgatttagtgtgagtagtttgggtttggggagaggagcccagcactagaagtcggcggtgtttccattcggtgatcagcactgaacacagaggactcaccatggaggtttgggctgagcttgggttttcctcgtcgcttcttttaagaggtgtccagtgtcaggggcagctggtggagtcgtgggggcgcggtggtccaacgtgggacgtcctgagacttctccgtgtcgccggccctccgattccaccttcaattaccttagtcggctagtcgtccacggtcggggtcccgccgacggccctaccgaggggacgtaacgggggtcttaggggaggttcggggtcgggccccgttagttacgtttccgttttaagttttacggaagttaagggtaaagtttaaacgtaccttaaaatttactttaagtcggacgtaacggtaccgttaccgggtaggggtaaacccggggttcccggtttaccaacccgtacttcccgtaccgtaacggaacgtaaacctaaccgttaacccaaacttaaaccgtttaaccttaccgtttagttttcctaacggtacgtaaaactttacgtaccgttaaccgtccgtacgtaccggtacttaccgtaagggtaccgtacggtaccggttcgttcgttaaccttaacgtttacgtacgttacgaacggtaaaccgttcccggttcccccggttacctttacccggttacgttacggttttacgggtttccggggtaccccgttaccccggtacgtaccggttccggtaccggg

SEQ ID NO: 158043 - DNA, 649 bp, Homo sapiens
  misc_feature: GYAE6OF02GWT8P.24.78.H01.1.454.CMB.1.raw
  modified_base (201)..(201): a, c, t, g, unknown or other
  misc_feature (201)..(201): n is a, c, g, or t
  modified_base (511)..(511): a, c, t, g, unknown or other
  misc_feature (511)..(511): n is a, c, g, or t
  modified_base (644)..(644): a, c, t, g, unknown or other
  misc_feature (644)..(644): n is a, c, g, or t
tcagactactatgtcacgaccggtgctcgatttagtgtgagtagtttgggtttggggagagctgctcagttaggacccagagggaaccatggaaaccccagcgcagcttctcttcctcctgctactctggctccagccatcaccggaggattgtgttgacgcagtctccaggccaccctgtctttgtcctccgaggggganagacgcccaccctctcctgcagggccagtcaggagttgtacgcagcagcttacttagcctaggtacagacaacgtaaccgtcggcctggccctcccgaggtccttcctctacgttctacgttcgggtcgtccgtacccgaccggtaacgggccctacggtcgggtaccggtccggaccggtacgtacgggttccgaggtcggacgtacgggtcgggttacggttttaggggaactaggtaccttacgtacttccgtactactcacgtacgactacggacgtacggacgaccgtaagttacttgcgtagtnttagttcgtgtctagttcttcggtttctcccttcttcccgttacttagtcgttaccgttcgtcggtaccgtacggttccaggtcgtaggtcgtactcgaacgtaccgtagtcggtagtcctacgcctaccgtnttccg

SEQ ID NO: 158044 - DNA, 658 bp, Homo sapiens
  misc_feature: GYAE6OF02H5FWZ.24.78.H01.1.454.CMB.1.raw
  modified_base (208)..(208): a, c, t, g, unknown or other
  misc_feature (208)..(208): n is a, c, g, or t
tcagactactatgtcacgaccggtgctcgatttagtgtgagtagtttgggtttggggagagctgctcagttaggacccgagagggaaccatcggaaaccccacgaccgcagcttctcttcctcctgctactctggctcccagccatcaccggaggaattgtgttgacgctagtctccgaggcaccctgtctttgtcctccgagggganagacgccaccctctcctggcgacgggccagtccaaggtgtgttagcaagcagctacttagcctggtaccagcgaagaaacctggcctggctcccgaggcctcctcactctagtggtgccgtccacgacgggccacgtcgggccgtcgcggtaacgtggttccaggtcggactaggtggtccgtttagggactacggtaccttcactcctcatactatcgactacgaccgttggaaccgtaccggtaaagtactttcgacgtacgtagttacgtttacctagtccgtagttcgtcggttttcggtcccttcgttacccgttaccttacgttacgtttaccttacggtttcggacccgttacgggttacccgacggttcggtacggtaagtaccgttacgaaacggtaccgtacgttggtccgggtaccttcgggacctaccgtagttcccg

SEQ ID NO: 158045 - DNA, 683 bp, Homo sapiens
  misc_feature: GYAE6OF02JER3B.24.78.H01.1.454.CMB.1.raw
  modified_base (242)..(242): a, c, t, g, unknown or other
  misc_feature (242)..(242): n is a, c, g, or t
  modified_base (615)..(615): a, c, t, g, unknown or other
  misc_feature (615)..(615): n is a, c, g, or t
tcagactactatgtcacgaccggtgctcgatttagtgtgagtagtttgggtttgggcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgtctccgagggganagacgccctaccctctcctgcagggccagtcagagtgttagcagcagtctacttagcctaggtaccagcagaacctggctcggctcccaggcctccgtcatctagtggtcgtcgtcccaccgcgggaccacgtcgggccgtcggccggacgtacggttcaggtcggcgaggtggtacgtttgggacgtagtaaccgtttcacttccgtacacttaccgtaacgttacgaacgtaacggacgttacgggacccgtaacccggtaaggttacgttttacggaccgttaaggtttacgttaacttttaacggttacgttaccgtaggttccgttttcgggttttccggttccccttccgtttcccttaacccgttnttaccgtttaccgtttaccgttttcggtacccgttacgggtttcccggtacgggttccgttaacgggg

SEQ ID NO: 158046 - DNA, 698 bp, Homo sapiens
  misc_feature: GYAE6OF02J0JQQ.24.78.H01.1.454.CMB.1.raw
  modified_base (676)..(676): a, c, t, g, unknown or other
  misc_feature (676)..(676): n is a, c, g, or t
tcagactactatgtcacgaccggtgctcgatttagtgtgagtagtttgggtttgggagagctgctcagttaggacccagagggaaccatggaaaccccagcgcagcttctcttcctcctgctactctggctcccagccatcaccggaggaattgtgttcgacgcagtccccaggcaccctgtcttgtctcgaggggagagagccctaccgtctccgtagccgacgggccaagtcagacgtgttacgacgagcagtacgttacttacgcctacggtacagtaccgaagtaacccttcggacctggcccgttacccgaggtccctccgtactacgtccgtagtcggtcgaccgtacccgaccggtacgggtcctaccggttcggaccgtccggacggacgtacggttcgaggtggtaccgtaggtggtaccgtttcgggaaacctacggtaaccttccacgttcctaccgtacgtaccgtacgtacgtacgaacgtaccggtacgaaccgggtacgtaagtacgtttcgacgttacgttagttacgttacgtcgtacgtacgtcgttagtttaccgtccttccgtccttacgtacgttacctacgttacgtttccggaccttaacggtccgtaggtcgtaggtacgtactacggagtaccggttaacgtgtacgtcgngtaccgacgttcgtacgttccg

SEQ ID NO: 158047 - DNA, 740 bp, Homo sapiens
  misc_feature: GYAE6OF02GYOC8.24.78.H01.1.454.CMB.1.raw
  modified_base (247)..(247): a, c, t, g, unknown or other
  misc_feature (247)..(247): n is a, c, g, or t
tcagactactatgtcacgaccggtgctcgatttagtgtgagtagtttgggtttggcacaaccggtgctcgatttagtgtgagtagtttgggtttggggagagctgctcagttaggacccagagggaaccatggaaaccccagcgcagcttctcttcctcctgctactctggcctcccagccatccaccggaggaattgtgttgacgcagtcctccgaggccacctgttctttcgtctccgagggganagacgcccaccctctccgtgcgacgggccagtcagagtgtagcagcacgactacgtcgccgtacgtaccagaccgaacgaaccgtcggaccgtcggcctcccgagccctcctacgtacttacgtagtcggtcgcccgtacccgaccggcggtacctacggtcggccggtcggaccggtacgtaggttccgacgggtcggacggtacgggtcgggttcggtttacgggtaccgtacggtaccgttaccgtacgttcctacgtactactacgtaccgaaccgtacggaaccgtcggaaccggtaccggtaacgtttacgtttacgacgttaggttaactttagtttaccgtacgtacgttaggttccgtttcggtttaccgtttccccgttaccgttaccccgtttaccttaaccggtttaccgtttacccgttttaccggtttaccgggttacccggtttaacgggtttacccggtacgggttacgttaacggg

SEQ ID NO: 158048 - DNA, 638 bp, Homo sapiens
  misc_feature: GYAE6OF02HPI1K.24.78.H01.1.454.CMB.1.raw
  modified_base (284)..(284): a, c, t, g, unknown or other
  misc_feature (284)..(284): n is a, c, g, or t
  modified_base (345)..(345): a, c, t, g, unknown or other
  misc_feature (345)..(345): n is a, c, g, or t
  modified_base (366)..(366): a, c, t, g, unknown or other
  misc_feature (366)..(366): n is a, c, g, or t
  modified_base (413)..(413): a, c, t, g, unknown or other
  misc_feature (413)..(413): n is a, c, g, or t
  modified_base (447)..(447): a, c, t, g, unknown or other
  misc_feature (447)..(447): n is a, c, g, or t
  modified_base (492)..(492): a, c, t, g, unknown or other
  misc_feature (492)..(492): n is a, c, g, or t
  modified_base (512)..(512): a, c, t, g, unknown or other
  misc_feature (512)..(512): n is a, c, g, or t
  modified_base (522)..(522): a, c, t, g, unknown or other
  misc_feature (522)..(522): n is a, c, g, or t
  modified_base (542)..(542): a, c, t, g, unknown or other
  misc_feature (542)..(542): n is a, c, g, or t
  modified_base (617)..(617): a, c, t, g, unknown or other
  misc_feature (617)..(617): n is a, c, g, or t
  modified_base (625)..(625): a, c, t, g, unknown or other
  misc_feature (625)..(625): n is a, c, g, or t
tcagactactatgtcacgaccggtgctcgatttagtgtgagtagtttgggtttggggagaggagcccagcactagaagtcggcggtgtttccattcggtgatcagcactgaacacagaggactcaccatggagtttggctgagtcgttgggttttcctcgtcgcttcttttaaggaggtgtccagtgtcagggcagtctgggtggagtcgtgggggcgcgtacggtccaacggtgggacgtccctgacgcctctcgtgtcggccgcctccgattccgaccttanattcttagtggctagtgccagttcgggcccacgtaggcctacgaaggtcgaaacgggggtntcgggagttcgggcggccctnttaacgttctttaggttgattacgggaaattaactgtaaattgttancggacaacgcgtacggtagacggtcctacaactntaccgacgagtacgacgtaactaccaataactacgtcttcgttangtaactaatgtaaccgtacncgtagtacgnttacgacgaacgctacggtntacgtacttaacgtgtcgtagaccgtaagtacccgtcccgttcttaacgttacgtcgtttaggtcgggttacccncccggtanccggtagtaccgg

SEQ ID NO: 158049 - DNA, 663 bp, Homo sapiens
  misc_feature: GYAE6OF02F3X4Q.24.78.H01.1.454.CMB.1.raw
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacacagtctccaggccaccctgtctttgtctccgaggggagagacgccaccctctcctgcacgggccacgccggagtgttagtaagtacgttaggctaggtaccaacacgaaaccgtcggaccgttttacggcctcccgacggcctccctcctctactcgtctcgtcctccaccgaccgggtcccgtcggtccgtcccgacgccgtacggtttcggttcgggtcgggtcgggtcgtgggacgtagtactttcgtacctcctaccacctacgtccgacggtccggtcccgtaccgtacgttccgtaggtaacgttactttcgtacttacttttactttcttacgttactaactacttagtggtacgtacgtcgtcctccgttacgttacgttcggtccgtacgggtaccgtaacgtaggacgtaactaacgaacgtacgtcggtacgtcgtcgacctactacg

SEQ ID NO: 158050 - DNA, 900 bp, Homo sapiens
  misc_feature: GYAE6OF02GWQSS.24.78.H01.1.454.CMB.1.raw
tcagactactatgtcacgaccggtgctcgatttagtgtgagtagtttgggtttggggagaggagcccagcactagaagtcggcggtgtttccattcggtgatcagcactgaacacagagactcaccatggagtttggctgagcttgggttttcctcgtcgcttcttttaagaggtgtccagtgtcgaggggcagctggtggagtcgtgggggccggcgtggtacccaaccgtgggacggtccctggacgtacctccttccgtggtcggccggtacccttcccgtaatttcctaacccctttcaaactttacctttagtcgggacctaagttcgacgtaccggttcggggtcccgacccgtaaggggtcccttacccggaaggggacccggtaaacggggggtcccttagggggaaccgggtttcggggggtaccggtaccccggttacgtttaacgttccgtttttaaggttttaggaaacgtttaacggggtaaaactttaaacgttaccttaaaatttaacgttttaacgtcggtaacgtaaacggtaccttaccggggtaacgggaaacggggtttccccggttaacacccgtaacttccgtaaccgaacggtaacgtaaccttaaacgttaacccaaacgtaaaccttaaccgttacgtttaccggttttacctaacggttaaacctaaacgtttacgtaaaccgtttacgacccgtttacggtacgttacggtaccgttacggaaccggtaccgtaaccggttcttacggttaacttacgttacgttacggtacgtaaccggtaacggttcccgttacccccggtacctttacggttaacgttacgtttaccgggttaccgggttcccgaccccgttaagtccgtacggtaccgg

SEQ ID NO: 158051 - DNA, 698 bp, Homo sapiens
  misc_feature: GYAE6OF02JVOEI.24.78.H01.1.454.CMB.1.raw
  modified_base (280)..(280): a, c, t, g, unknown or other
  misc_feature (280)..(280): n is a, c, g, or t
  modified_base (298)..(298): a, c, t, g, unknown or other
  misc_feature (298)..(298): n is a, c, g, or t
  modified_base (387)..(387): a, c, t, g, unknown or other
  misc_feature (387)..(387): n is a, c, g, or t
tcagactactatgtcacgaccggtgctcgatttagtgtgagtagtttgggtttggggagaggagcccagcactagaagtcggcggtgtttccattcggtgatcagcactgaacacagaggactcaccatggagtttgggctgagctgggttttcctcgtcgcttctttaagaggtgtccagtgtcaggggcagctggtggagtcgtgggggcgcgtggtccaaccgtgggaggtccctgagactctcctgtgcggcctccgattcaccttcaatacttanggcatgcacgtgggtccncaggcctcgaggcgaaggggctgggagtgggtcggacccgctattccgtttagtttgagtaggtaaagtaactcgtaaattatttaagngacgtaacgtaccgttaccggttaggaaacggggtccccggtttaacaacccgtagttacccgtaccgaacggtacgtaaacctaaacgttaccctaaacgtaaacttaccttacgttacgtttactcgtaactaatacgtaactacgtccgtacgacgtacttcgtaggtaacggaccgtacggtccttacgtacttaacgttacgtcggtacgtaccgtaaacgtcccgttaccccggttccttaccgtttaacgtacgtttaacggttccgggtaccggtcccccttaagtacggtacggtaacccgg

SEQ ID NO: 158052 - DNA, 711 bp, Homo sapiens
  misc_feature: GYAE6OF02JLINT.24.78.H01.1.454.CMB.1.raw
  modified_base (172)..(172): a, c, t, g, unknown or other
  misc_feature (172)..(172): n is a, c, g, or t
  modified_base (346)..(346): a, c, t, g, unknown or other
  misc_feature (346)..(346): n is a, c, g, or t
tcagactactatgtcacgaccggtgctcgatttagtgtgagtagtttgggtttggggagaggagcccagcactagaagtcggcggtgtttccattcggtgatcagcactgaacacagaggactcaccatggagtttgggctgagctgggttttcctcgtcgctcttttaagnggtgtccagtgtcaggggcagcgtggtggagtcgtgggggcgtcggtcggacccaaccgtgggacggtccctgacgactcctcctgtgccggcctccgattccacttcaatactatggcatgacacgtgggtccgccaggctccgaggcgaagggctgggagtgggtcgccgtnttactcgttatttcggaattgggaaacgtaatctaaagtttacttagtgacaacggtactccggtaaggaacgggggtcccgtttaccaccgtatccgtaccgaaggtaccgtaaactaaccgttaacccaaactaaaccttacgttacgtttacgtttacttacgaacttaaacgtcgtaacgttaacgcctaggcgtacgtcgtacggaacggtaccgaccggtacgttacggtacttaacgttactcggtacgaccgtaaacggtacccgtttaccccggtaccctttaacgttacccgttaagtttacgggtttaccggggtacccggtaccccctttaacgtacggttacggtaaccggg

SEQ ID NO: 158053 - DNA, 650 bp, Homo sapiens
  misc_feature: GYAE6OF02IB2Q6.24.78.H01.1.454.CMB.1.raw
  modified_base (314)..(314): a, c, t, g, unknown or other
  misc_feature (314)..(314): n is a, c, g, or t
  modified_base (644)..(644): a, c, t, g, unknown or other
  misc_feature (644)..(644): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggctcccagccatcaccggaggtaattgtgttgacgcagtctccacgcacccttgtctttcgtcctccgagggagagacgcccaccctcctcctcgcgacgggccagtccgagagttgtagcagcagctacgtgcctaggtaccngaccaagaaccgtcggccgtcggacctccgacggtcctccgtactatctagttcggtccgtccgtaccgaaccgtacggtccacggttcggccgtacgccggacgtacggtccgtagggtcggtacgtaggtcggttcggttacgggacgtaccgttacttacgtacgttcctacgacgtcacgtaccgaccgtagtaccggtagaccgtacgtagttacttgtacgttgttagttaccgttacgcttacgtcgtccgtttgttcccgttcccttcttcccgttctaacgttccgttacgttacgttcggaccggttacgtccggtacgngtaccg

SEQ ID NO: 158054 - DNA, 705 bp, Homo sapiens
  misc_feature: GYAE6OF02IJXX9.24.78.H01.1.454.CMB.1.raw
  modified_base (240)..(240): a, c, t, g, unknown or other
  misc_feature (240)..(240): n is a, c, g, or t
  modified_base (264)..(264): a, c, t, g, unknown or other
  misc_feature (264)..(264): n is a, c, g, or t
  modified_base (270)..(270): a, c, t, g, unknown or other
  misc_feature (270)..(270): n is a, c, g, or t
  modified_base (273)..(273): a, c, t, g, unknown or other
  misc_feature (273)..(273): n is a, c, g, or t
  modified_base (277)..(277): a, c, t, g, unknown or other
  misc_feature (277)..(277): n is a, c, g, or t
  modified_base (286)..(286): a, c, t, g, unknown or other
  misc_feature (286)..(286): n is a, c, g, or t
  modified_base (292)..(292): a, c, t, g, unknown or other
  misc_feature (292)..(292): n is a, c, g, or t
  modified_base (307)..(307): a, c, t, g, unknown or other
  misc_feature (307)..(307): n is a, c, g, or t
tcagactactatgtcacgaccggtgctcgatttagtgtgagtagtttgggtttggggagaggagcccagcactagaagtcggcggtgtttccattcggtgatcagcactgaacacagaggactcaccatggagtttgggctgagctgggttttcctcgtcgctctttttaagaggtgtccagtgtcgaggggcagctggtggagtcgtgggggcgcgtggtccaacgtgggagtccctgngctctctgtgcgcctcgatcactnatctangcntgcncgtcggccncaggcncgagcgagggctggngtggtcggccgtctattctttattgagtaggaaattactactaattattagtgacacgtacgtcggtagggtaacgggtccgttaccaaccgtctacctaccgagaacgaacctaaacttaccaaactaacttaccttcttacgttttcagtaactaaagttcgaaccgttacgccgttaggacgtaacttcgaacggtaccggaccgttacgggtacctttacggttaaccttttaaccgttagttacgggttacgaaacccggttaaccggttaccccggtttacccccccggttaccttttaaacccggtttacgtttaaaccggtttttccggggttccggggttttaccccccgtacccccggtttaagttaccggggttacccggtaccggg

SEQ ID NO: 158055 - DNA, 792 bp, Homo sapiens
  misc_feature: GYAE6OF02GKQVN.24.78.H01.1.454.CMB.1.raw
  modified_base (201)..(201): a, c, t, g, unknown or other
  misc_feature (201)..(201): n is a, c, g, or t
tcagactactatgtcacgaccggtgctcgatttagtgtgagtagtttggggtttgggggagagctgctcagttaggacccagagggaaccatggaaaccccagcgcagcttctcttcctcctgctactctggctccagccatcaccggaggaattgtgttgacgcagtctccaggcaccctgtctttgtctccgagggganagacgcccaccctctcctgcagggccagtcagagtgtagcagcagctactagcctggtaccagcagaaccgtggcctcggcctcccgaggtcctcctctatcgtgtcggtcgccgtacccgaccgacgggccctacgtcgggccgtaccggccggacgtacggttccgaaggtcggcgtaggtcgggtcgtttacgggactacggtacctttacgaccttcctccgtacttccgaacgttccgaaccgtaaggaccggttacgggaaccgggtaaccccggtaaaggtttacggtttacggaccgttaacggtttaacggtttaacgtttaccggtttacggtaccgttaacggtttccggttttaccgggtttttcccgggttaccccttttccccgtttaccccgttttaaccccgtttacggttttacccgtttaacccgttttacccggtttttacgggtaccccgggtttacggggttacccggttaccgggtcggttacggggtaacggtaaccgttaccggtaacggccggttaacggttcgggttacgggtcccttacggacccggttaccgtaacgtttccg

SEQ ID NO: 158056 - DNA, 645 bp, Homo sapiens
  misc_feature: GYAE6OF02HMCV5.24.78.H01.1.454.CMB.1.raw
  modified_base (193)..(193): a, c, t, g, unknown or other
  misc_feature (193)..(193): n is a, c, g, or t
  modified_base (285)..(285): a, c, t, g, unknown or other
  misc_feature (285)..(285): n is a, c, g, or t
  modified_base (452)..(452): a, c, t, g, unknown or other
  misc_feature (452)..(452): n is a, c, g, or t
tcagactactatgtcacgaccggtgctcgatttagtgtgagtagtttgggtttggggagagctgctcagttaggacccagagggaaccatggaaaccccagcgcagcttctcttcctcctgctactctgctccagccatcaccggagattgtgtgacgcagtctccaggcaccctgtctttgtctccaggggnagagcccaaccctctacctgcgagggccagtcagagtgttagcagcagtctacttagcctggtaccagcaagaaacctggcctggcctaccncggctccctcgtatcctaagttcggtcgccgtccacgacgggtacccagtcggccgtcggcggaaccgaggttcgaagtcggctagtcggtctttaggggactacgtactacctactctcgtatcatacgacacgtacgtacggacgtaccgtaaacgttagtttanaccgtagttcgtaatttaccgttgtacctggtacttcgttttacggtcccctttgttccctacgttaacgtttcgttaaccgttaacgttttcgaacccggttaggttacccggtagtaccggttacggtaagtacgttaaccgaagttaaccggtaacgttggtaggtcccgaggtctaccgttacttaccg

SEQ ID NO: 158057 - DNA, 659 bp, Homo sapiens
  misc_feature: GYAE6OF02HJ0IF.24.78.H01.1.454.CMB.1.raw
  modified_base (301)..(301): a, c, t, g, unknown or other
  misc_feature (301)..(301): n is a, c, g, or t
  modified_base (529)..(529): a, c, t, g, unknown or other
  misc_feature (529)..(529): n is a, c, g, or t
  modified_base (534)..(534): a, c, t, g, unknown or other
  misc_feature (534)..(534): n is a, c, g, or t
  modified_base (546)..(546): a, c, t, g, unknown or other
  misc_feature (546)..(546): n is a, c, g, or t
  modified_base (562)..(562): a, c, t, g, unknown or other
  misc_feature (562)..(562): n is a, c, g, or t
tcagactactatgtcacgaccggtgctcgatttagtgtgagtagtttgggtttggggagagagcccagcactagaagtcggcggtgtttccattcggtgatcagcactgaacacagaggactcaccatggagtttgggctgagctgggttttcctcgtcgctcttttaagaggtgtccagtgtcaggggcagctggtggagtcgtgggggcggcgtcggtccaaccgtgggaggtccctgacgctctcctgtgccgcctccgattcacctcaatattactggctatcgcacgttcgggccnccgtaggcctcccgagggaccgaagggggtccgtgggtaggtcggggtcggaccgtctagttccgtttagtttcgaagttaggaaagtaattacctaaagttattaactggacctaacgtaccgttacggtaaggtaaaccggtcccggtttaccaaccgtacttccaccgaagaacgaactaaaccgtacaaacctataaccttgttatttcgacgtactaaacgtnacgtncctagctacgtntacgacgactacggtntctcttatacgtgaccgtaagaacgttcccgtccccgttacccgttacgtactagtttacggttccgggtccgtaacccctagtccgtaggtaccgg

SEQ ID NO: 158058 - DNA, 742 bp, Homo sapiens
  misc_feature: GYAE6OF02GM9M4.24.78.H01.1.454.CMB.1.raw
  modified_base (252)..(252): a, c, t, g, unknown or other
  misc_feature (252)..(252): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctcggctccccacgccactccaccggagtaattgtgttgacgcagtcctccaggccacccttgttctttgtcctccgaggggganaggaccgcccaccctctcctgcgacgggccagtcagtggtagttagcgacgcagtaccttacgtacgcccgtcggtaacccaggacaacggtaaaccgtcggccgtacggccctcccgacggtcccttacctactacgttcttaacgtcggtccgcccgtacccgaccggtaccgggtaccctacggtccgggccggtccgggaccggtacgttacgggtacgtaccgggtcggtacgtcgggttaccggttcggttttacgggaaccgtcgtaccgtttacgtaccttacgtactacgttacgtacgaccgaacgttacgcgggtacggtaacccgaaccggtaagtttacgtttacgagttacgttacgtttattcgtagtctacggttcgtttacggttacccgttcccttaccgttcccttacgtttacgttacggttacctttcggtttaccggtaccgttacgggttcctacgggtcttaacgg

SEQ ID NO: 158059 - DNA, 775 bp, Homo sapiens
  misc_feature: GYAE6OF02FY03M.24.78.H01.1.454.CMB.1.raw
tcagactactatgtcacgaccggtgctcgatttagtgtgagtagtttgggtttggcacgaccggtgctcgatttagtgtgagtagtttgggtttgggagagctgctcagttaggacccagagggaaccacggaaaccccagcgcagcttctcttcctcctgctactctggcctccagccatcaccggaggtaattgtgttgacgctagtctccgaggcacctgttctttgtcctccgaggggagagacgcccaccctctccgtgccgaggccagtcgagtagtgtacgcgagtcagtcttacgttacgccttaggaccagacaacggtaaacctcggacccttcggccgttcccgacggtcccttcccgtacgtacttaccgttagtcgggtaccgtcccggttacccgaaccggccgggtaccctaaccggtcgggtacccggttacggaccggtaccgttacggttaccggacggttcggaccgtagggtcggtttaccggttacggggtaacctacggttaacccgttccgtacccgttccgttaccgtacgttaccgtacgttaccgaccgttacggacggtacggaccggtacccgttaagttacgttcgacgtacgtttagtaactttacgtcgtacgtacggttctttacgggtttccgtcccgtttaccgttcccgtttaccgttacgtttaaccgttaccgttttaccggtttaccggtacccggtttccggttaaccggtcccggttacggtacggttaacccgg

SEQ ID NO: 158060 - DNA, 611 bp, Homo sapiens
  misc_feature: GYAE6OF02ILM41.24.78.H01.1.454.CMB.1.raw
  modified_base (239)..(239): a, c, t, g, unknown or other
  misc_feature (239)..(239): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtcttgtctccagggganagagccaccctctcctgcgacgggccagtcagagtgttagcagcagctacttagcctggaccagcaagaacctggcctggcctcccgagcctctcatctatggtgccgtccacgacgggcccacgtggcgtcgcggacagggttcacggtcggcagtggtcgtttgggacgtagtaccttcactcctctacgtctatccgacacgacgtcggacgtcccggtaagttacgttttgacgtagttacgttacgtttattcgtacgtacgtccgtttggttttccggttccccgttccttccgttccttacgttaccgttaacgtttaccgttttacggcccgttacggggtttacccgtagggtccgtaacggg

SEQ ID NO: 158061 - DNA, 717 bp, Homo sapiens
  misc_feature: GYAE6OF02JEKUA.24.78.H01.1.454.CMB.1.raw
tcagactactatgtcacgaccggtgctcgatttagtgtgagtagtttgggtttggcacaaccggtgctcgatttagtgtgagtagtttgggtttggggagagctgctcagttaggacccagagggaaccatcggaaaccccagcgcagcttctcttcctcctgctactctggcctcccagccatccaccggaggtaattgtgttgacgcagtctccaggccacccgtgttcctttgccttccgaggggtagacgacgcccaccccttctcctgcgaggggcccagtcagtaggtgttagacacgcacgtctacgtagcctggtaccagcaacgaacctggcctcggctcccgaggtcctacctacacgtctaggtcggtcgtcccgtaccgaccgacggacctaccgtgggtcccgtcggaccggtacgtacgggttccaagggtcggagtcggttacgggtcggtttaacgggacctaggtaacctttcgtaccgttacctaccgtactacctaacgtccgaaacgtcggtaccgtacggtacgaacccgttagttacgtttcgacgtaggttacttaattacggtacgtacgtacgttaccgtttacggtttccgtccccgtttaccgttacccgttacttacggttaaccgttacccgttttaccgttttaccgggccccggttaaggtttccccggtagggtacttaacgggg

SEQ ID NO: 158062 - DNA, 787 bp, Homo sapiens
  misc_feature: GYAE6OF02HVI9Q.24.78.H01.1.454.CMB.1.raw
  modified_base (233)..(233): a, c, t, g, unknown or other
  misc_feature (233)..(233): n is a, c, g, or t
  modified_base (280)..(280): a, c, t, g, unknown or other
  misc_feature (280)..(280): n is a, c, g, or t
  modified_base (330)..(330): a, c, t, g, unknown or other
  misc_feature (330)..(330): n is a, c, g, or t
  modified_base (339)..(339): a, c, t, g, unknown or other
  misc_feature (339)..(339): n is a, c, g, or t
  modified_base (349)..(349): a, c, t, g, unknown or other
  misc_feature (349)..(349): n is a, c, g, or t
tcagactactatgtcacgaccggtgctcgatttagtgtgagtagtttgggtttggcacgaccggtgcccattagttgtgagtagtttgggtttgggggtaggagctgctcagttaggacccgagagggaaccactggaacccacgcgcagcttctccttcctcctgctactctggctcccagccatcaccggaggaattgtgtgacgcagtctccaggcacctgtctttgtcnccagggggagagacgccaccctctctgcacgggccagtcagaggttnttagcagcacgctaacttagccgtggtaccagacacgaaaccgtggcccngccacccgngtcctcctangttactagtggcgtccgtaccccaacgacggggaccctaggtcggaccggtccggacggtaacctacgggggtttcacggggtcggtcgaaggtttcgggtaccggttttacggggaaaccggtacgttaccgttaccgtaccgttactacctacgttacgtaccgtaaccgtacgtaacgtaaccggttacggaaccgggttaacccggtaaaggtttacggttttacggtaccggtagtttaacggttaacgtttaacgttcggtaccttaacggttccggtttaccggttttacccgggtttccccgttacccgtttaccctttaacccggttttaacttaccgggtttaaaccccggttttttacgggtttaccggttaaccccgggtttaccgggttaacccgggttacccgggtaacggttcgggtaaaccg

SEQ ID NO: 158063 - DNA, 704 bp, Homo sapiens
  misc_feature: GYAE6OF02H2LS6.24.78.H01.1.454.CMB.1.raw
  modified_base (224)..(224): a, c, t, g, unknown or other
  misc_feature (224)..(224): n is a, c, g, or t
  modified_base (679)..(679): a, c, t, g, unknown or other
  misc_feature (679)..(679): n is a, c, g, or t
  modified_base (697)..(697): a, c, t, g, unknown or other
  misc_feature (697)..(697): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaacgcccagctcagcttctccttcctcctgctactctcggctcccagacgaccgccggagaaggtgtgtgtcgcacgtcccaggcaccgtntcgtgtctcgaggggacacagcactcctctcctgcgaggccagtcacgtcctcgtctacctaaccccttacgcctcggttaccaaaacgaaaaacgtccgtcggaccacgtccctaccaaccggacctcgtactactactatagtaactaactaactaaccgaaaacgggcctacgtacggaccgttacccgaccgtaccggtacggttccgcggttcggacggtacgggtcggttaccgggttacggggaacctaacgggtaccctttcggtaaccccgttaccgttacccaacggtaaccttaccgaagtacccgtaaggttacggttaacgtaccggtaccgttagtaaacgttagttttcgtacgtttaaacggttttactaactcgtacgactacgtacccgtagaacctaagtccgaccgttcgtaccggccgtacgtacacggttacngactcgaccaacggtacngcgtacg

SEQ ID NO: 158064 - DNA, 601 bp, Homo sapiens
  misc_feature: GYAE6OF02FKPHW.24.78.H01.1.454.CMB.1.raw
  modified_base (302)..(302): a, c, t, g, unknown or other
  misc_feature (302)..(302): n is a, c, g, or t
  modified_base (371)..(371): a, c, t, g, unknown or other
  misc_feature (371)..(371): n is a, c, g, or t
  modified_base (401)..(401): a, c, t, g, unknown or other
  misc_feature (401)..(401): n is a, c, g, or t
  modified_base (424)..(424): a, c, t, g, unknown or other
  misc_feature (424)..(424): n is a, c, g, or t
tcagactactatgtcacgaccggtgctcgatttagtgtgagtagtttgggtttggggagaggagcccagcactagaagtcggcggtgtttccattcggtgatcagcactgaacacagaggactcaccatggagtttgggctgagctgggttttcctcgtcgctcttttaagaggtgtccagtgtcagggggcagctggtggagtctgggggcggcgtggtccaacctggggaggtccctgagactctcctgtgcggcctcccgattccaccttcaatacttatcggcatcgcactgggtccnccaggctccaggcaaggggctggagtggggtgccgctatcttatttgattggaataatcaatattatgnagactccgagaacgggtccgttcaaccgtntctccagacgacaacttccaaanaactactctgtttctgactaaatgtaactagccttgacgtatcgttagacgggtacaacgggtctcttacttaacttacttggttacgacgaaaggttaccttcccccggaccctttcgttaacggtagtttacgtttcgggggtaccgtacccccttacgtacggtcggtaaccgg

SEQ ID NO: 158065 - DNA, 697 bp, Homo sapiens
  misc_feature: GYAE6OF02IQ4ON.24.78.H01.1.454.CMB.1.raw
  modified_base (237)..(237): a, c, t, g, unknown or other
  misc_feature (237)..(237): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggctcccagccatcaccggaggattgtgttgacgcagtctccaggcacctgtctttgtctccgagggnagacgccaccctctcctgcgaggccagtcgaagatgttggcagactaacgttgcctggtaccagccaagaaacctggaccaggccctaccgaggtccttccgtacacgttctagtgatcgtacctacgaacgtacggtccacgtcggccgtccccgcgtacggttccacggtcggccgtagggttcggggttaccgaggggaacctacggtacctttccgaaccttccgtaccgtacccggttcacgtaccgtaaccgtcccgtaaggaccgttcccgtaagtaacggtttacgttttcggtaccgttttaacgcgttcggtactacgtcgtacgttcccggttccgccgttcgggtacccgttaccgtttaaccgggtttccgggggaaccgggggttcccgtaagggggttacggacggtaacggggtacggtaccggttaacggtcggtacggtccg

SEQ ID NO: 158066 - DNA, 888 bp, Homo sapiens
  misc_feature: GYAE6OF02FOAA2.24.78.H01.1.454.CMB.1.raw
  modified_base (204)..(204): a, c, t, g, unknown or other
  misc_feature (204)..(204): n is a, c, g, or t
  modified_base (242)..(242): a, c, t, g, unknown or other
  misc_feature (242)..(242): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggcctccagccatcaccggagtaattgtgttgacncgtagtctcgaggcacctgttcttgtcctcggaggganagacgcccacctctccgtagcgacgggcctagtcaagtcgttggtacgcgagcgagtccttacgtacgcccgtacggtaccacggtacaacggtaacctcgggccttacggggcctaccccggaggtccccttcccgtactaacgtttccgttaaggtccggtgtaccccgggttaacccgaacccggttaaccgggccccgtaacgggttcccgggtaccggttaccggggtaaccccgggtaacggttacggggtttacccgtaacgggggtttcgacccggtagggtttacggggttccggttttaaaccgggggacggttaaacccgtttacccggttacccgttaacgttcccgttaacggtacccttaaggttaacccgtaccgggtaaacccgtaacgggttaccgttaacgggggacccgttaacccgggttaaaggtttcgttttaaccggaccggttttaaaggtccgttttaaacgttccgtttaacgggtaacgtcgtttcggttttaccggtttaccggttccccgtttaaccgtttcccgttaaccttaacggttttacccgttaccgttttaccgggtttacggttaccccgggttaacggggtttcccgacgggtttacccgtaacgggg

SEQ ID NO: 158067 - DNA, 769 bp, Homo sapiens
  misc_feature: GYAE6OF02JX168.24.78.H01.1.454.CMB.1.raw
  modified_base (151)..(151): a, c, t, g, unknown or other
  misc_feature (151)..(151): n is a, c, g, or t
  modified_base (254)..(254): a, c, t, g, unknown or other
  misc_feature (254)..(254): n is a, c, g, or t
tcagactactatgtcacgaccggtgctcgatttagtgtgagtagtttgggtttggtcgacgaccggtgctcgatttagtgtgagtagtttgggtttggggagagctgctcagttaggacccagaggaaccagtacggaaaccccagccganagtcttcctcttcctcctgctactctgcctacccagccatcgacggagtattgtgtgacgctagtctccaggccaccttgtcttttagcctaccggagggganaacggtaccgcccctaacccgttcctcccggtagaccggtaccggggacctacggtacgaaggtacggttaggttacgcgaggtaccgagtaccgttaacgtttcggacccgttacggtaacccaggaccaacggtaaacccgtcggaccgttaccgggccctacccgacggtcctaacccgtacctacgtaccgttaacggttcggaccgtacccgtacccggaaccgcgggtaccctacggcggtcccggtacggcggtaaccgtgggtttaccgaggtcggtacgtaggtcggtcggttagggacgtacgttaccgtctaacctcgtactactactacggtaccaacgcggtactaccggacggtaccgttaagttacgttacgtacggtagtttaacggtacgtttccgtagtaccggttagtccggtttcgttcggttaccctcgtttaccgttcgtcgtttaacgtcgtttacgttcgtaccgttaacggttcgtacggtacttacggg

SEQ ID NO: 158068 - DNA, 772 bp, Homo sapiens
  misc_feature: GYAE6OF02HDUW8.24.78.H01.1.454.CMB.1.raw
  modified_base (115)..(115): a, c, t, g, unknown or other
  misc_feature (115)..(115): n is a, c, g, or t
  modified_base (158)..(158): a, c, t, g, unknown or other
  misc_feature (158)..(158): n is a, c, g, or t
  modified_base (178)..(178): a, c, t, g, unknown or other
  misc_feature (178)..(178): n is a, c, g, or t
  modified_base (352)..(352): a, c, t, g, unknown or other
  misc_feature (352)..(352): n is a, c, g, or t
tcagactactatgtcacgaccggtgctcgatttagtgtgagtagtttgggtttggggagaggagcccagcactagaagtcggcggtgtttccattcggtgatcagcactgaacanagaggactcaccatggagtttggctgagtcgttgggttttccncgtcgtcttacttttaaggngtgtccagtgtcgagggcagctggtgagtcgtggggcgcgtggtccaacgtgggacgtcctgacgtctctctagcgtcgcctccgattcaccttacgatacttacgtggctagtcgctacgtcggtccgacaggcctcgaggtcgaacgggcgtggaggtcgggtcggcccgtnttacgtctttagttgagtacggtaaagttacttactaaagtttacgttagtgaccgtagtacttcccgggtaagggtaacggggtcccggtttaaccaaccgtaccgttccgtaccgaacgtacgaaaccgtaacgttaaccaaaacgtaacttaaccgttctttacgtttacgtagttaaccgtaaacgttacgaccgttaaccgttccgtacggtccgtaacgttcgttacgggaaccgtaccggaccggttaccgttcgttaaccgttacgtttaacgttagggttaccggtaaacggtaaaccggttccccggttaccccccgtttacccggtttaacctttaccggttacggtttaccgggttaccggggttacccggtcccccggtttaaacgtaccggtcggttaacccgggg

SEQ ID NO: 158069 - DNA, 802 bp, Homo sapiens
  misc_feature: GYAE6OF02GMOOX.24.78.H01.1.454.CMB.1.raw
tcagactactatgtcacgaccggtgctcgatttagtgtgagtagtttgggtttgggcacgaccggtgctcgatttagtgtgagtagtttgggttggggagagctgctcagttaggacccagagggaaccatggaaacccccagcgcagcttctcttcctccttgctactctggtctccagccatcaccggagaattgtgtgacgcagtctccaggcacctgtctttgtctccgaggggagagacgccaccctctcctgcacgggccaggtcagtagtgtagacagcagcttactacgcctaggtaccagacaacgaaccgtcggaccgtggaccgtcccgacggtcctcctactagtctagtggtacgtcccgtaccgaccgacgggtaccctaacggtacgggtccgtaccgggccggtaaccgtacgggtttaccgacgggttacgggaccggtaggggttaccgggttacgggttttacggggaaaccgtaacgggtacccgttttaccgaaaccgtttacccgtaccgtaaaccgttccgtaaaccgtttaccggaaaccgtaacggttaaccgtaacggggtacccggttaacccgttaaaggtttacgttttaacgggaccgttaagggtttaccgtttaaacgttttaacggttcggttaacccgtacggtttaccgtttcggttttacccgggttacccctttcgttaccccggttcttaacggtttacgtttaacccgtttaccgggtttacgtacccggttaccgggtttcgtacggggtcgttaaccgggg

SEQ ID NO: 158070 - DNA, 649 bp, Homo sapiens
  misc_feature: GYAE6OF02FN6HH.24.78.H01.1.454.CMB.1.raw
  modified_base (255)..(255): a, c, t, g, unknown or other
  misc_feature (255)..(255): n is a, c, g, or t
  modified_base (287)..(287): a, c, t, g, unknown or other
  misc_feature (287)..(287): n is a, c, g, or t
  modified_base (293)..(293): a, c, t, g, unknown or other
  misc_feature (293)..(293): n is a, c, g, or t
  modified_base (298)..(298): a, c, t, g, unknown or other
  misc_feature (298)..(298): n is a, c, g, or t
  modified_base (305)..(305): a, c, t, g, unknown or other
  misc_feature (305)..(305): n is a, c, g, or t
  modified_base (339)..(339): a, c, t, g, unknown or other
  misc_feature (339)..(339): n is a, c, g, or t
  modified_base (367)..(367): a, c, t, g, unknown or other
  misc_feature (367)..(367): n is a, c, g, or t
  modified_base (373)..(373): a, c, t, g, unknown or other
  misc_feature (373)..(373): n is a, c, g, or t
tcagactactatgtcacgaccggtgctcgatttagtgtgagtagtttgggtttggggagaggagcccagcactagaagtcggcggtgtttccattcggtgatcagcactgaacacagaggactcaccatggagtttgggctgagcttgggttttcctcgtcgctctttttaagaggtgtccagtgtcaggggcagctggtggagtctcgggggcggcgtgggtccaaccgtgggacggtccctggagactctccngtagcgggcctcggatacgccgtcaatacgtntcgacntcacngtcggcnccaagctccgagcgaggcgtagagcggtcgccgntactgtaattgacgtgaaatagacattntacgtnacagtcacgtaggacgtcggttacactagtccatacgaactctaactacaaccgaactacgtacttaggttacctaggtactaaacgttcaacgtacgtcgttaacgcgtagtaccgtacggagttaacccgagggttccctaagtacttaacgttaccttagggttaccgaaacggaacctttaaccgggttacccctccccttttaacgaacgtttaaacgtcggtttacgggggtacccctaacccggtttaacctagggttcggtaacccgg

SEQ ID NO: 158071 - DNA, 790 bp, Homo sapiens
  misc_feature: GYAE6OF02HRXC6.24.78.H01.1.454.CMB.1.raw
  modified_base (178)..(178): a, c, t, g, unknown or other
  misc_feature (178)..(178): n is a, c, g, or t
  modified_base (245)..(245): a, c, t, g, unknown or other
  misc_feature (245)..(245): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggctcccanactaccacgtggaagaaatgtgatgacgcagtctcagccacctgtctgtgtcctacgaagggaaacncgccctacctcgtctgacgacggcctagtcaagtagtaataaagacgactaacttaacgtacgccgttaggtaactaaccgaaacgacggtaaaaccgtggacccaggacctcccgaaggtcccttaccgtctaattccgtaagtacggtaactacgccgtaacgccggtaacggacctacgttcggtaccgtacccggaagtcccggtaaggttaccgagggtaccggtaacgtaagggtttcgggacggttaacgggtaacgtaacggttaccgttaccgaccgttacccgtaacccgtaaccgtaacgttaccgaaccgtacgtaaaccggttcacggttaccgtaacggttcggtaaaggttaaacgtttacgttttaccgtacgttttaacgtttttaacgtaaccggtccgtaaccgtacgggtacctaacggttaccgaaagggtacccgtttaaggaacccgttaccgggttccctaccggttaccggttaacccggttcgggggaaaccgggttaccgggtaccggttaaacgggg

SEQ ID NO: 158072 - DNA, 590 bp, Homo sapiens
  misc_feature: GYAE6OF02I6749.24.78.H01.1.454.CMB.1.raw
  modified_base (200)..(200): a, c, t, g, unknown or other
  misc_feature (200)..(200): n is a, c, g, or t
  modified_base (284)..(284): a, c, t, g, unknown or other
  misc_feature (284)..(284): n is a, c, g, or t
tcagactactatgtcacgaccggtgctcgatttagtgtgagtagtttgggtttgggggagagctgctcagttaggacccagagggaaccatggaaaccccagcgcagcttctcttcctcctgctactctgctcccagccatcaccggaggaattgtgttgacgcagtctccaggcaccctgtctttgtctccgagggganagacgccaccctctcctgcagggccagtcagagtgtagcagcagctactagcctggtaccagcagaacctgctgctccagctcnatctatggtgcgtccaccacgggccacgtgggccgtcggacggacgtggttcaggttcgggctaggtcggtctttggggactaggtcttcactctgactcatcgaacagcgtgggacgacccgtaagtactttcgctaggttgttatttctgttcacgtcttcgttcgtccttaccttcctaccgttacgttcgttaaccttcgttttcggaccgttacgggtttccgtaggtcgtcggtaacgttacgtaccgtaagtaccggtaacgttcggttcggtaccttcggtccgtacctcgttaccgg

SEQ ID NO: 158073 - DNA, 692 bp, Homo sapiens
  misc_feature: GYAE6OF02JJN9B.24.78.H01.1.454.CMB.1.raw
  modified_base (234)..(234): a, c, t, g, unknown or other
  misc_feature (234)..(234): n is a, c, g, or t
  modified_base (247)..(247): a, c, t, g, unknown or other
  misc_feature (247)..(247): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggctcccagccatcaccggagattgtgtgacgcagtcacaggccacctgttcttgctcgagggangagccacctctcngcaaggcagtcagtagtgttagcgacgcacgtcttactacgcctggtaccagacaacgaaccgtcggcctacggcctacccgaggtccttaccctagtactctacgttcggtcgacccgtaccgaaccggacggccgtaacgtcggccggtacggaccggtacgttaacgggtccgtaacgggtcggtccgtaaggttccgggttacggtttacgggaacctacgggttaaccctttaccgaacgttaccgtacgtaccgtacgtaacgtaccgaacgtacggaaccgttacgggaccggtaacccgtaagttaccgtttcggacgtagttaacgttagttacgtcgtaccgtagtccgttacggtttccgtccgttcttaacccgttctaacgttacgttaacttacgtttcggacccgttgggtaccctgggttactaacggg

SEQ ID NO: 158074 - DNA, 603 bp, Homo sapiens
  misc_feature: GYAE6OF02HAX3B.24.78.H01.1.454.CMB.1.raw
  modified_base (200)..(200): a, c, t, g, unknown or other
  misc_feature (200)..(200): n is a, c, g, or t
  modified_base (338)..(338): a, c, t, g, unknown or other
  misc_feature (338)..(338): n is a, c, g, or t
tcagactactatgtcacgaccggtgctcgatttagtgtgagtagtttgggtttggggagagctgctcagttaggacccagagggaaccatggaaaccccagcgcagcttctcttcctcctgctactctggctcccagccatcaccggaggaattgtgttgacgcagtctccaggcaccctgtctttgtctccgagggganagagcccaccctctcctgcacgggccagtcagagtgttagcagcagctactagcctgaccagcagaacctgcctggctccaggcctcctcactctagtcggtgccgtccaccgagggccacgtcggcgtcgcggacgnggttcgagtcggcaggttcggtcgtttagggaacaggtacttcgactctcatccgaatcgacacgacgtaggacgacccgtaagtacgtttacgacgtagttcgttattacgttgtacgtagtcttggttcgttcccttccttcccttccgttacttcgttaccttacgttttcgggtaccgttacggtccgtacggtcgtaggtaacgtagttaccgtaagaccgtaagttcggtacggtccgtcggtacctaccgtattaccg

SEQ ID NO: 158075 - DNA, 662 bp, Homo sapiens
  misc_feature: GYAE6OF02FLVV8.24.78.H01.1.454.CMB.1.raw
  modified_base (242)..(242): a, c, t, g, unknown or other
  misc_feature (242)..(242): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaacccccagcgcagcttctcttcctcctgctactctggctcccagccatcaccggaggaattgtgttgacgcagtctccaggcaccctgtctttgtctccgagggganagagcccaccctctcctgcgacgggccagtcagagtgttagctagcagcctacgttagcctaggtaccagcaagaaacctggacctggcctcccaggcctcctcactctagtcggtcgtaccgtaccaccgcgggaccctacgtcggcgtcggccggaacgtagggttcagggtcggacgacggttggtacgtttgggactacggtaccttcaccgttctacactacgtataccgacacgacgttcggaacgtaccgtaagttacgtttcgaacgttacgtagtttaacttacgttcgtacgtacgtcgtttcggtttaccgttccccgttcttaccccgtttaccttacgttacgtttaacccgttaccggttttccgggtacccgtttacggggtccccgtagggtaccgttaacggg

SEQ ID NO: 158076 - DNA, 641 bp, Homo sapiens
  misc_feature: GYAE6OF02G52RR.24.78.H01.1.454.CMB.1.raw
  modified_base (156)..(156): a, c, t, g, unknown or other
  misc_feature (156)..(156): n is a, c, g, or t
  modified_base (176)..(176): a, c, t, g, unknown or other
  misc_feature (176)..(176): n is a, c, g, or t
  modified_base (245)..(245): a, c, t, g, unknown or other
  misc_feature (245)..(245): n is a, c, g, or t
  modified_base (297)..(297): a, c, t, g, unknown or other
  misc_feature (297)..(297): n is a, c, g, or t
tcagactactatgtcacgaccggtgctcgatttagtgtgagtagtttgggtttggggagaggagcccagcactagaagtcggcggtgtttccattcggtgatcagcactgaacacagaggactcaccatggagtttgggctgagctgggttttccncgtcgctcttttaagaggtntccagtgtcaggggcagctggtggagtcgtgggggcgcgtggtccaaccgtgggagtccctgagactcncctgtgccgcctccgattccaccttcatacttatggcatgcactgggtcccncgagctccgaggcgagggctggagtgggtgccgctatcttattcgatggaatatcgaaatattagtgacagtccgtacgtagaacggggtccggttaccaaccgtattccgtacccgaaggacgtaacctaaacttacccgtaaaacaaacgttaccttacgtttacgttttctacgtaacctaaattacgacgtaccgacttacggcgtactcgtaggtacggaaccgacgggttctgttactactttacgagttacgacgtaagtcccgttccccggtctttaaccgttaccgtatttacggttccggggtaccgtaccccgtactacggtggtaacccggg

SEQ ID NO: 158077 - DNA, 819 bp, Homo sapiens
  misc_feature: GYAE6OF02I3NKQ.24.78.H01.1.454.CMB.1.raw
  modified_base (581)..(581): a, c, t, g, unknown or other
  misc_feature (581)..(581): n is a, c, g, or t
  modified_base (738)..(738): a, c, t, g, unknown or other
  misc_feature (738)..(738): n is a, c, g, or t
  modified_base (755)..(755): a, c, t, g, unknown or other
  misc_feature (755)..(755): n is a, c, g, or t
  modified_base (796)..(796): a, c, t, g, unknown or other
  misc_feature (796)..(796): n is a, c, g, or t
tcagactactatgtcacgaccggtgctcgatttagtgtgagtagtttgggttggcacgaccggtgctcgatttagtgtgagtagtttgggttgggagagctgctcagttacggacccaggacgggaaaccagtcgggaaacccccagcgcacgtcctttccttccttaccctccgttacggccttacgttccgtcggtaccttcccagtacctacccaccgttgggaaagtaaacgtaggtagtaacgttcggaaccggtcctaacggttcccttaccgaaccgccccgttaaccccgtgggtttactcggttacgtccgtaacccgggaaagggggtaaacacccgtcccccttaaccgttccgttaaccgcggaacgtaaccgggggcctacgtaaccgtaacggtaaggttaaacttaccggaaacgtcctaaaacgttccggttaacgccgtttaggtaacctaacaaacggtaacggaacccgtacggtacccggtactacccgttaaccgacggttaccctacctacggtacttaccgtaagtcgtaaactcgtaccgtaaaccgagtccggtanaccggtccgtaaccccgtcgggtaaccttacgggacgttacggtacgggtaactcggggtcggtacgtacgtaacgtaaccgtcttagtacctccggtacacgttccaggtactaccgtcgaacgtcgtatacggtagtgtaccgtagtcttaacgngtactcggacttaccgngtctacgtccgtacgtcggtaccggtcgggaccgtggaggngtacggagagtaccgcggtgtcg

SEQ ID NO: 158078 - DNA, 735 bp, Homo sapiens
  misc_feature: GYAE6OF02JAWZF.24.78.H01.1.454.CMB.1.raw
  modified_base (345)..(345): a, c, t, g, unknown or other
  misc_feature (345)..(345): n is a, c, g, or t
  modified_base (407)..(407): a, c, t, g, unknown or other
  misc_feature (407)..(407): n is a, c, g, or t
tcagactactatgtcacgaccggtgctcgatttagtgtgagtagtttgggtttggggagaggagcccagcactagaagtcggcggtgtttccattcggtgatcagcactgaacacagaggactcaccatggagtttgggctgagctgggttttcctcgtcgctcttttaagaggtgtccagtgtcaggggcagctggtggagtcgtagggggcggacgtggtaccaaccgtggggacggtcccgtgacgactctcctagtggccggcctccgattccaccttcaattactagtggcagtgcacgtgggtccgccaggcctcgaggcaaggggctgggagtcgggnggccgtctagttcctttagttacggagttcggaaagttaagtacctaaaatttacgtttaancgggtaacaggtaaccgttccggtagggaaacggtcccgggtttaacaaccgtaacgttcctaccgaaggaacgaactaaaccgttaccaaactaactacttcgttcggtttctacggtaactaaaacgttcgtaaccgtaacgtaccgtacgcgtaaacttcgtacggtaagggaccgacgggtaaccttggttaccttaaagtttaccgtagtacgaacgtaaaccggttaccctttacccccggtacctttaaccgtttacggttaacgttttacggtttaccgggttacccgtaaccccgtaacgttaccgtacgggtacccgg

SEQ ID NO: 158079 - DNA, 839 bp, Homo sapiens
  misc_feature: GYAE6OF02I7QKG.24.78.H01.1.454.CMB.1.raw
  modified_base (234)..(234): a, c, t, g, unknown or other
  misc_feature (234)..(234): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaacccagcgcagcttctcttcctcctgctactctggctccagccatcaccggagaattgtgttgacgcagtctcaggccacctgtcttgtctcgaggganagacgccacctctcgtcgcgacggccagtcaggtagtgttagcagcgacgtacttacgttacgccttacgggaccaacgacgaaacggtaaccgtcgggccttacggccgtacccgaggtccttcccgtacaacgttctaggtcggtaccgtccgtacccaaccggtacgggccctaaggtcggacggttccggacggtaacgttacgggttaccgagggttcggacgttacgggggttaggtccggtaacggggtaacctacggtttaaccgttaccgttaaccgttcccgttaaccgtaaccccggttacgaaacggtaccggtaacggttaccccgaaagggtcccgtaccggttaaaaggttaaaccggttttacggtttttaccgggttcccggttttttaaacgttacgggtttaccgaacggttaccgtaaccgggtttaaccggttccccggtttccgtacccgggtttccggggaacccgttttaacccgggttaccggggggtttcccgggggaaccggggggttaaccggttaacggggggtaacgggtaaacgggtaccgggtaaaaccggttacggtaaccgggtttcgggg

SEQ ID NO: 158080 - DNA, 798 bp, Homo sapiens
  misc_feature: GYAE6OF02HGPBM.24.78.H01.1.454.CMB.1.raw
tcagactactatgtcacgaccggtgctcgatttagtgtgagtagtttgggtttggggagaggagcccagcactagaagtcggcggtgtttccattcggtgatcagcactgaacacagaggactcaccatggagtttgggctgagctgggttttcctcgtcgctcttttaagaggttgtccagtgtcgaggggcagctgggtggagtcgtgggggcggcgtggtccaaccgtgggacggtccctgagactctcctgtcgccggcctcccgtattcctaccttactaattacttagtcggactatcgcctacgtcggggtcccgaccgacggtctacccggaggacggtaaggggccgtggggacgggttcggggtccggcccggtacttagttccttttaagttggtaagtaagggtaaagttaaactacgtaaaatttagttaagtcgaactaacggtaccgttaccgggtaaggaaccgggggtcccgtttaccgaacctacgttacccgtaaccgaacggtaacggtaacctaaacttaacccgaaaacttaaacgtttaccttacgtttacggtttacctacgtaaacgtaaacgttacggtaaccttacgtccgtacggtacgtacgttaccggtaggaaccggtacgtacgggtacttccgttacttacgttacgtacggtacggtaaccgtaacggttccccggttaccccggttaccgtttaaccgttaacggttacgtttacgggttccgggtaacccgttacccctaggttaccggtcgggtacccggg

SEQ ID NO: 158081 - DNA, 654 bp, Homo sapiens
  misc_feature: GYAE6OF02JXQ33.24.78.H01.1.454.CMB.1.raw
  modified_base (159)..(159): a, c, t, g, unknown or other
  misc_feature (159)..(159): n is a, c, g, or t
  modified_base (246)..(246): a, c, t, g, unknown or other
  misc_feature (246)..(246): n is a, c, g, or t
  modified_base (265)..(265): a, c, t, g, unknown or other
  misc_feature (265)..(265): n is a, c, g, or t
  modified_base (328)..(328): a, c, t, g, unknown or other
  misc_feature (328)..(328): n is a, c, g, or t
  modified_base (358)..(358): a, c, t, g, unknown or other
  misc_feature (358)..(358): n is a, c, g, or t
  modified_base (426)..(426): a, c, t, g, unknown or other
  misc_feature (426)..(426): n is a, c, g, or t
  modified_base (511)..(511): a, c, t, g, unknown or other
  misc_feature (511)..(511): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatcggaaaccccagcgcagcttctcttccnccgtgctactcgtggcctcccagccatcaccggaggaattgtgttgacgcagtcctccgaggccacctgtctttgtctcgaaggggnagacgcccacccttctccngcgaggtccagtcagagtgttagcacgctagcttacgtacgcctaggtaccagctagaaccgnggacctcggccttccgaggccttaccgtanattcctagttcggcgtacctacccgacgacgggcctacgcgggtcctcggacggtaactcgggttacnggtcgcgtaggtcgtcgttaggctagtacttcgacttcgctatcgtaactcgacgactaggtgaccggtacgaagttctttacgngtacgttagttacttagtccgtcgtaagttccgttggttaccgttcccgttaccctttccgttaccgttaacgtttcccgtagttttaacccggtttaccgggacccggttaccggtttaaccgtccgggttaacgttacggg

SEQ ID NO: 158082 - DNA, 666 bp, Homo sapiens
  misc_feature: GYAE6OF02GDMZ5.24.78.H01.1.454.CMB.1.raw
  modified_base (201)..(201): a, c, t, g, unknown or other
  misc_feature (201)..(201): n is a, c, g, or t
  modified_base (229)..(229): a, c, t, g, unknown or other
  misc_feature (229)..(229): n is a, c, g, or t
  modified_base (254)..(254): a, c, t, g, unknown or other
  misc_feature (254)..(254): n is a, c, g, or t
  modified_base (306)..(306): a, c, t, g, unknown or other
  misc_feature (306)..(306): n is a, c, g, or t
tcagactactatgtcacgaccggtgctcgatttagtgtgagtagtttgggtttggggagagctgctcagttaggacccagagggaaccatggaaaccccagcgcagcttctcttcctcctgctactctggctcccagataccactggagaagtagtcatgacgcagtctccagccaccctgtctgtgtctccgaggggaancgccaccctctcctgcagggccagtganatgtggcagcaactgcctggtaccngacaagaacctggaccaggcctacccgaggccttccctcctctatcgccttntccgtccgaccgacgggtcccctggtccgtcccacgtccgtacggtttcggttcggcgggttcgggtcgtaggggacctaggttactttccacgttctaccgaactctacgacggcccgtacctccgtacgtacgtagtaagttacttttggtaccttacttttagtttacgtcgtactaacttacgtgttacgtacggtacctcggtaccttaccggttactttaccgtttacgggacccgtaacgggtaaccctaaacggtcggacgttaacaacgtaaacgtacgtcggacggtctacggtaccctaacgtacgtccgttacttccgttacttacccgttacctacccgagttaccg

SEQ ID NO: 158083 - DNA, 882 bp, Homo sapiens
  misc_feature: GYAE6OF02ID7JL.24.78.H01.1.454.CMB.1.raw
  modified_base (157)..(157): a, c, t, g, unknown or other
  misc_feature (157)..(157): n is a, c, g, or t
  modified_base (307)..(307): a, c, t, g, unknown or other
  misc_feature (307)..(307): n is a, c, g, or t
  modified_base (377)..(377): a, c, t, g, unknown or other
  misc_feature (377)..(377): n is a, c, g, or t
tcagactactatgtcacgaccggtgctcgatttagtgtgagtagtttgggtttggggagaggagcccagcactagaagtcggcggtgttccattcggtgatcagcactgaacacagagactcaccatggagtttgggctgagtcgttgggttttccncgtcgtcttcttttaaggaggtgtccagtgtacgaggggcagcgtaggtggagtcggtgggggcgcgtggtaccaaccgtggggacgtccctggatacctcgtcgtgtcgccggacctccgtattcctacctttacgaacttaacgttanacggactagtcgacctacggttccgggtacccgccgtaaggtccgtaccgtagggaccggaacgggggtntacgggtaaggggttcgggaccggggccctacgtttaacgtttcttttaagtttacgaaggttacgggtaaaattaaccgtcttaaagttacttaagtcggactaacggtaccgtcgggtaaggaaacccgggttccccggttaacaaccgattacccgttaaccgaaggtaaaccgtaaccttaaacttaaacccgaaacttaaacttaccttcgttttacggtttacctacggtaaacctaaaagttcggaaacccttacggtacctggtaaccgtaacgttacggtacggaaaccggtagtaacccggggtatttaaccggtacttttaacggttaccgttaggtaaccgggtaaacgttaacccggtttaacccccggtttaccccccggtttaccgtttaacccgttttaaacgggaacggttttttaccggggtcccgggggttacccccgttaaccccccttaaggggttaccgttacccgggggtttaaaccccggg

SEQ ID NO: 158084 - DNA, 755 bp, Homo sapiens
  misc_feature: GYAE6OF02IYGL3.24.78.H01.1.454.CMB.1.raw
  modified_base (156)..(156): a, c, t, g, unknown or other
  misc_feature (156)..(156): n is a, c, g, or t
  modified_base (314)..(314): a, c, t, g, unknown or other
  misc_feature (314)..(314): n is a, c, g, or t
tcagactactatgtcacgaccggtgctcgatttagtgtgagtagtttgggtttggggagaggagcccagcactagaagtcggcggtgtttccattcggtgatcagcactgaacacagaggactcaccatggagtttgggctgagctgggttttccncgtcgctcttttaagaggtgtccagtgtcgaggggcagcgtggtggagtcgtgggggcgcgtggtccaaccgtgggacgtccctgagactccgtccgtgtcgccggtcctcccgattccaccttacaattacttatggccatcgcacgttcgggtccnccgagtcctccgaggggacgtaaggggcgtagggaggttcgggggcgccgtactagttccgtttaagttgtaggtaggtaaaagtttaagtaccgtaaatttaggttactacggacttaaacggtaccgttacccggtaggaacccgggggttcccgtttacccaaccgtacttccgtaccgaagtacgacctaaacttacccaaactaaacttaccgttacgtttacgtttaccgtcgtaaactaacgtacgttaccggtaccgtccggtacgaccgttagtaccggtaggacggtaaccgtaccggtcgttaccgttcgttaacttacgttacggtacggaaccgttaaccggtcccgttaccccgttacccttttaccgttaacgttacgtttacgggttcggttacccggtaccccttagtccggttacggtaccgg

SEQ ID NO: 158085 - DNA, 763 bp, Homo sapiens
  misc_feature: GYAE6OF02GY7NR.24.78.H01.1.454.CMB.1.raw
  modified_base (150)..(150): a, c, t, g, unknown or other
  misc_feature (150)..(150): n is a, c, g, or t
  modified_base (236)..(236): a, c, t, g, unknown or other
  misc_feature (236)..(236): n is a, c, g, or t
  modified_base (500)..(500): a, c, t, g, unknown or other
  misc_feature (500)..(500): n is a, c, g, or t
tcagactactatgtcacgaccggtgctcgatttagtgtgagtagtttgggtttggcacgaccggtgctcgatttacgtgtgagtagtttgggtttgggagagctgctcagttaggacccagaggaaccatggaaacccagcgcagcttcncttcctcctgctactcgtggctccagagaccgcggagaaggtgtgtgtcgcgacgtcccgaggcaccgtgtcgttgctcagggacncacgccatcctctcctgtccgacggtccagtacacgtcctacgtccgtacctaacccgttcgtccgtcgttaaccaacgaaacgtccgtacgaccgaacggccgtaccgacgtaccgtccgtactactcgttagtcgtatacgagtaaccgaacgggaccgtcgtacggaccgttaccgacgaccgtacggttcgtcgtacggcgtacggtcggtacgtcgggtaactacggtaccttccaacgttcaccgtacgtacgtacgngtaccgtaccggtactaaggaacggttagtacgtaactttagtttaccgaacgttacgtttaacgttacgtttaccgtaggttaccgacgggaacgttacggtccggttaaagtacccgttaaacccgtcgggtaacccctttacggtaccttttaaaaccgttacccgtttaacccggggtttacccgtaaaccccggggttacggtaaaacccggttacggtaaccggttttacccgtaaacggtacctttaaccccgggg

SEQ ID NO: 158086 - DNA, 734 bp, Homo sapiens
  misc_feature: GYAE6OF02HITC1.24.78.H01.1.454.CMB.1.raw
  modified_base (242)..(242): a, c, t, g, unknown or other
  misc_feature (242)..(242): n is a, c, g, or t
tcagactactatgtcacgaccggtgctcgatttagtgtgagtagtttgggtttggcgacgaccggtgctcgatttagtgtgagtagtttgggttggggagagctgctcagttaggacccagagggaaccatggaaaccccagcgcagcttctcttcctcctgctactcgtggctcccagccatcaccggaggaattcgtgttgacgcagtctccgaggcaccctgtcttgtctccgaggganagacgcccacctctcctgcgaggccagtcagagtgttacgcacgcgacgtctacgttacgccgttacggtaaccagacgaacgtaaaccgttcggaccttcggccctcccgaggtcccttaccgtacacgttccgtaggtcggtaccgtccgtacctaccggaacgggccctacggtcggtccggtcgaccggtacgtacgggttcgtaagtcggacgtaggttcgggttacgtttacggggaacctacggttacctttaccgtacgttaccgtacgtaacgttacgttacgttaccgaacgttacgacgttacggaccgtaacccggtagttaacgtttcgacgtagttacgttaacgtttacgtacgtaccgtacggttccgtttcgggtttacccgttccccgttcgttaccccgttacttaaccgtttacgttaccctttaccggtttccggacggtttacccgggttaccgtcggtaccgttaacgg

SEQ ID NO: 158087 - DNA, 847 bp, Homo sapiens
  misc_feature: GYAE6OF02GJXSN.24.78.H01.1.454.CMB.1.raw
tcagactactatgtcacgaccggtgctcgatttagtgtgagtagtttgggtttggggagaggagcccagcactagaagtcggcggtgtttccattcggtgatcagcactgaacacagaggactcaccatggagtttgggctgagctgggttttcctcgtcgcttcttttaagaggtgtccagtgtcgaggggcagcgtggtggagtcgtgggggcggcgtggtaccgaaccgtgggacggtccctgacgactctcctgtcggccgccctcccgtattccaccttacaatacttagtggctatgcacgtcgggtcccgccgacggcctccgacgggacggaaggggcgtgggagggttcggggtcgggcccgtacgttactttcgtttagtttaggtaacgttagggaaagtttaactaacgtaaatttattagtacgtactaacgtaccgttaccgggtaaggtaaccggggtcccggtttaaccacccgttacttacccgtaccaaggtaaccgtaacctaaccgtttaacccaaacgttaaaccttacctttacgtttacgtttaccgtacgtaactaaacgttacgtaaccgtaccgtccgtacggtaccgtagttaccggtaacggtaacgggtacccgtaaccgggttccttacggtttacttaacgtttacgtacggttacggtaacccggttaaacccggttcccccgttttacccccccgggtttacccttttaacccggttttaaccggtttacggttttaaccgggtttacccggggggttaccccccgttaacccccccgtttaacggttaccgggttacccggggttaacccggg

SEQ ID NO: 158088 - DNA, 782 bp, Homo sapiens
  misc_feature: GYAE6OF02FPF6Z.24.78.H01.1.454.CMB.1.raw
tcagactactatgtcacgaccggtgctcgatttagtgtgagtagtttgggtttggcacgaccggtgctcgatttagtgtgagtagttttgggtttggggagagctgctcagttaggacccagagggaaccatggaaaccccagcgcagcttctcttcctcctgctactctggctcccagccatcaccggaggaattgtgttgacgcagtctccaggcacctgtcttgtctccgagggagagacgccacctctctcgcgacgggccaagtcagcgttgttagccagcagtctaacttagccgtaggtacccagtacaaggtaaaccctggaccgtgggaccctcccacgggtcctccctcgtacttcctaggttggtcgtaccgtccccgtaacggaccggggaccctacggttcgggcccggttacgggccggaaccggttaacggggttctacgggttagggaccgtacggtcggttacggtttcgggtacgtaacggtaccgttaccgtacccgttccgtaccgacgttcctaaccgtcgtaaccgtacgtaaccgtcgggtaccggtaccccgtaaaggttaacggtttttccgaaccgttaaggtttaccgttacggtttaaccgttacgggttacgtacggttcgttttaccggtttccggtttaccccgtttcccgttacccctttaccggtttaccttaccggtttaaccgtttacccggtttccgggttacccggttacccgggtttccgggtaccgggttacggttaccgggg

SEQ ID NO: 158089 - DNA, 755 bp, Homo sapiens
  misc_feature: GYAE6OF02HTYB2.24.78.H01.1.454.CMB.1.raw
tcagactactatgtcacgaccggtgctcgatttagtgtgagtagtttgggtttggcacgaccggtggctcgatttagtgtgagtagtttgggttttggggaggagctgctcagttaggacccagaggaaccgatggaaacccgacgcgcagcttctcttcctcctcgctacctcgtcggcctcccgacgccatccgaccggaaggtacttgttgttgacgccgagtccgtaccgacgccgaccctcgtttctttcgtccgtaccggtacggggagacggacgcccaaccccgttcctcccgtcgccgtacgggtaccgtacgtacgaggtacggtagttacgacgacgtacgaacgtacgttacgttaccgtccgtacggtaccgtacgacgtaaccgaccggtaccggtccgtccgtcccgtacccgtacgtaccgttcctaccgtaccgttcgtacgtcggtaccgtccgtaccgaccgtccggaccgtcggtcgacggtccggacgacgtacggtacgtacggtcgtacggtcggtcggtacggttacggtacgtacgtacgtacgtactcgtacgacgtacgtacgtacgacgacgacgtacggtacgacgtacgttacgttagtacgtagttacgttacgttacgtcgtacgtcgttacgtttccgttaccgttccgttccttccgttacgttccgttacgttacgtttaccgttaccggttaccggttccggttaccgtcgtaggtacg

SEQ ID NO: 158090 - DNA, 716 bp, Homo sapiens
  misc_feature: GYAE6OF02GCK0G.24.78.H01.1.454.CMB.1.raw
  modified_base (242)..(242): a, c, t, g, unknown or other
  misc_feature (242)..(242): n is a, c, g, or t
tcagactactatgtcacgaccggtgctcgatttagtgtgagtagtttgggtttggcacgaccggtgctcgatttagtgtgagtagtttgggtttgggagagctgctcagttaggacccagagggaaccatcggaaaccccagcgcagcttctcttcctcctgctactctggctcccagccatcaccggaggaattgtgttgacgcagtctccaggccaccctgtctttgtctccgaggggtnagacgcccaccttctccgtgccgacgggccagtcaggtagttgttacgcagctagacttacgttacgccgtacggtaccagaccaacgaaaccgtcggaccgtcggcctcccgacggtcctccgtactactctacgtcggtacgccgtaccaccgacggcctacgtcggtaccgtacggaccgtacgtacggttacgacggtcggacgtcggtcgggtcgttacgggaacgtacggtaccttacgtaccgttcctactactcgtacgtacgtacgtagtaccgtacgggaccggtaccgtaagttaccgtttaggtacgttacggttacgttaactttcgtcgttaaccgtcgtttcgtttacgttttccggtacccttcgtttaccccgttacgttaacgtttaccgttaccggtttaacgttttccgggtacccggtttaaccgggtacccgttagggttccggttaaacgg

SEQ ID NO: 158091 - DNA, 910 bp, Homo sapiens
  misc_feature: GYAE6OF02GBI4O.24.78.H01.1.454.CMB.1.raw
tcagactactatgtcacgaccggtgctcgatttagtgtgagtagtttgggtttggggagaggagcccagcactagaagtcggcggtgtttccattcggtgatcagcactgaacacagaggactcaccatggagtttgggctgagcttgggttttcctcgtcgcttcttttaagaggtgtccgagtgtcaggggcagctggtggagtgtggggcgcgtggtccaaccgtgggaggtccctggagacctctccgtgtgccggccctcccggattccaccttcaacgttacttatcggtcatcggcctacgttcggggttccccgaccgtaggccgttacccgaagggccggtaaaacggggggtccgttaggggacggggttcgggggtccggggtccccgtacgtttacttccgtttttagttttaggaggttaagggtaaaacggtttaaccgtactaaaacgttttaagtttaacgttcggaacgtaacggtacccgttccggggttaaggggtaaaccggggttccccgggttttaacacccctaacgtttacctaccccggaagtaaccgtaaaccgtaacttaacccctaaaagtaaacctttaaccgttaccgttttcggttttactaccgggttaaactaaacgttacggtaaaccgttacggtacccgtttacggtaccggtacgtttaccggttaagggaaccgggtaaccggtaccgggtttcttaaccggtttacgtttaaccgttaacgttacggtacggtaaaccggttaaaccggttaccccggttttacccccggtaccctttttaaccggttaacggttttacgtttaacggggtttacccgggggttacccttaccccccggttaaggttaccggtaccgggtttaacccgggg

SEQ ID NO: 158092 - DNA, 804 bp, Homo sapiens
  misc_feature: GYAE6OF02JU5C1.24.78.H01.1.454.CMB.1.raw
  modified_base (254)..(254): a, c, t, g, unknown or other
  misc_feature (254)..(254): n is a, c, g, or t
tcagactactatgtcacgaccggtgctcgatttagtgtgagtagtttgggtttggcacgaccggtgctcgatttagtgtgagtagtttgggtttggggagagctgctcagttaggacccaggagggaaccatggaagccccagctcagcttctcttcctcctgctactctcggcctcccagacgacccgaccggaagtaaattggtgttgacacgagtctccgaggcctaccctgtctttgtcctccgaggganagacgccaccctctaccgtgccgacgggcccgacggccggtaagttcggttaacggttaacgttaccgttacggccgttacggtaacccctaaacgtaacggtaaacccgttcgggaacccgtacgggtcccctacccggtaccggtaccctttacccgtcctaacggttccttaacggtcgttaacgttccggttacccgtacccgaaacggttacggggtcctaaccggtccggtaccccggtcccccgtacgtaacgggtttacacgggttacggtaccgtacgggttcgggtacgtacgggactacgtaccttcgtaacctccgtaccgtacgtcgacgaccgtacgccgtacgccgttaccgtagtacgttacgtttcggtacgtttacgacgttcgtacgacgtcgtaccgttacgtccgtaaccgtccggtaccgttacggttaccgggttccggggaccgggttaacgcggggtaggtaaccggtcgggaacgtaccgggtaacgttcgggtaccggtacggtacccgtacgtcccttacgg

SEQ ID NO: 158093 - DNA, 750 bp, Homo sapiens
  misc_feature: GYAE6OF02G8OGB.24.78.H01.1.454.CMB.1.raw
  modified_base (202)..(202): a, c, t, g, unknown or other
  misc_feature (202)..(202): n is a, c, g, or t
tcagactactatgtcacgaccggtgctcgatttagtgtgagtagtttgggtttggggagagctgctcagttaggacccagagggaaccatggaagccccagcgcagcttctcttcctcctgctactctggctcccagataccactggagaagtagtcatgacgcagtctccagccaccctgtctgtgtctccgaggggaaanacgccacctctcctgcgagggccagtgagaatggttggcagcaactgcctggtaccagcagaactggccaggctcccaggcctcctcctctatgtcctgtcctacccaccgacgggtcccctggtccggtccccaggtcccgtacgggttttcggttcggggccgggttcggggttcgttacgggggacctagggttacgttttaccaccggtttcctacccgtaaccgtactaccgacgggtcccgtccctaccgtaacgttccgtacggtaacgttacgttttcggacctttacgttttactttcgttacttacctaacgtacctttagtacgggttcaacggttcggtcccgttacccggttaccttccgttttacgggacccgtaacgggggtaaccctaaaccgggtggaacgttaaccgttaaccgtaaacccggtaacgtttacgggtcgggttaaccctagggtaaccctaacccgttacggtttaccttacggttttcccttacccgtttaacccgtttcccgttcccccggtaacccg

SEQ ID NO: 158094 - DNA, 851 bp, Homo sapiens
  misc_feature: GYAE6OF02IV1U3.24.78.H01.1.454.CMB.1.raw
  modified_base (156)..(156): a, c, t, g, unknown or other
  misc_feature (156)..(156): n is a, c, g, or t
  modified_base (288)..(288): a, c, t, g, unknown or other
  misc_feature (288)..(288): n is a, c, g, or t
  modified_base (312)..(312): a, c, t, g, unknown or other
  misc_feature (312)..(312): n is a, c, g, or t
tcagactactatgtcacgaccggtgctcgatttagtgtgagtagtttgggtttggggagaggagcccagcactagaagtcggcggtgtttccattcggtgatcagcactgaacacagaggactcaccatggagtttgggctgagcgtggttttccncgtcgcttcttttaaggaggtgtccagtgtcaggggcagcgtggtggagtcgtgggggcgacgtggtcccaacgtgggacgtccctgagcctctcgtgtcgccggccctccgattcaccttcaattacttancggactagtgactcgtcgggtccnccgaggtcctacccgagggtaccgaacgggggtcctagggggtacggtttcgggggcggtaccccggtgtttaaaccgtttccgttttaaaggttttcggtaaagttttaagggggtaaaactttaaacgtttacccgtaaaagtttaacgttttaagaccgtaaccgtaacgtaccggttccggtaacgggtaaccgggggttccggtttaacccaccggtactaccgtacccgaagtaacgtaacctaaacgttaacccgtaaactaaacgttaccttacgtttcgtttacttacgtaactaaacgttacgaaaccgttaccgacctacggaccgtaccgttacgtacggtaaccggaaccggtaccgtaccgttacgttacgtttaacgttaccgttacggtaccggtaacgtaaaccggttacccggtttccccccggttaaccgtttttacccgtaaccgtttaccggttttacgggttaccggggttaaccccgttaccccccggtagttaccggttaccgggttaacccggg

SEQ ID NO: 158095 - DNA, 637 bp, Homo sapiens
  misc_feature: GYAE6OF02FM2XU.24.78.H01.1.454.CMB.1.raw
  modified_base (200)..(200): a, c, t, g, unknown or other
  misc_feature (200)..(200): n is a, c, g, or t
  modified_base (235)..(235): a, c, t, g, unknown or other
  misc_feature (235)..(235): n is a, c, g, or t
  modified_base (406)..(406): a, c, t, g, unknown or other
  misc_feature (406)..(406): n is a, c, g, or t
  modified_base (498)..(498): a, c, t, g, unknown or other
  misc_feature (498)..(498): n is a, c, g, or t
tcagactactatgtcacgaccggtgctcgatttagtgtgagtagtttgggtttggggagagctgctcagttaggacccagagggaaccatggaaaccccagcgcagcttctcttcctcctgctactctggcctccagccatcaccggaggaattgtgttgacgcagtctccaggccacctgtctttgtctccgagggganagagccctacctctcctgcgacgggccagtcaggngtgttagcgagcagtcttacttacgccgtgtaccagacaacgaaaccgtcggccgtcggccctaccgacggtcctacctctactcttagtcggtcgccgtaccgaccgaggccacggtcggcggcggccggacgtcggttcgaggttggcgtaggtcggtgtttcgggacncgttaccttcacttcatactcatacgactaggtaaccgtggaaccgtaccggaatttacgtttcgaccgtagttacgttcgtactcggtacngttcgtttcggtttcggtcccttcttcccgttgtacgtttcgttaaccgttctttacggaccggttacgttccgtaggtcggtagaacggtactacggacgtacgtaacggtcgtcggtctcgaaccgtcgtagttccg

SEQ ID NO: 158096 - DNA, 745 bp, Homo sapiens
  misc_feature: GYAE6OF02JYN05.24.78.H01.1.454.CMB.1.raw
  modified_base (197)..(197): a, c, t, g, unknown or other
  misc_feature (197)..(197): n is a, c, g, or t
tcagactactatgtcacgaccggtgctcgatttagtgtgagtagtttgggtttggggagagctgctcagttaggacccagagggaaccatggaaaccccagcgcagcttctcttcctcctgctacctctggcctcccagccatcaccggagattgtgttgacgcagtctcagccaccttgtctttgctccgaggganagacgcccaccgtctccgtgacgacgggacctagttccgaaggtagttagttaacgcgaagaccaagtccgttacttacgtccgttaggtaccaagtaccgaacgtaaaccgttcggacccgtcggtccttacccgacggtcccttaccgtctacgtacgttacgtcggtcgtccgtaacccgtacgaccgggtccctacggtcggtccggtccggaacccggtacgtacggttacgacggttcgggaccttagggtcggttaccggtttacggaacgtacgttacgtttccgaaccgttccgtagtactacgtaccgtacgacgtacgtacgggtcgaacggaccgtaaagttccgtttacgacggtagttcgttaatttacgtacgttacgtagttcgtttacgtttccgtaccgttccttaccgttacttgttaacttacgtttaccggttacgggtaccgtacgttacccgtagtcgtacgggtactaaccggttgaaccggtagtaccggtgtccggtactaccgacgtaccgttggttaccg

SEQ ID NO: 158097 - DNA, 899 bp, Homo sapiens
  misc_feature: GYAE6OF02H7W8K.24.78.H01.1.454.CMB.1.raw
  modified_base (206)..(206): a, c, t, g, unknown or other
  misc_feature (206)..(206): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggcctcccagccatccaccggaggattgtgttgacgnagtcctccgaggccacccttgttctttgtcctccgaaggggagagacgcccaccctctcctgcgacgggccagtcaagagttagtacgctagcaggtaccttacgttacgcccgttaggtaaccccgagaccgtaacggtaaaacccggtcgggacccgtacggccccgtaccccggtaaccgggttccctccccgttactaacgttcgtaacgttcggggtccgacccgttacccgacccgtacgggacccggtaaccggttcgggaccggttccgggaccggtaacggtaccggggtttacgaagggttccgggacgttacggggttcggggtttacccggtttacggggtaacctaacggttaccccgtttacgtaacccgttacccgttacgtaacgtaccgttaacgttaacggaaccgttaacgggacccgtttaacggggaacccgtaacccgggttaaagtttaccgtttttcggaacgttaaggtttaggttttaccgtttaaccggttcggttaacgttaccggttccggtttttttaccgggttttacccggttaccccgtttcccgttttacccccgtttaaccgtttaacgttttaaccggtttaacccgtttttacgggttttcccgggtaacccggtttaccgggggtttacccgtaccgggggttacgttaacgggg

SEQ ID NO: 158098 - DNA, 792 bp, Homo sapiens
  misc_feature: GYAE6OF02GPHTY.24.78.H01.1.454.CMB.1.raw
  modified_base (147)..(147): a, c, t, g, unknown or other
  misc_feature (147)..(147): n is a, c, g, or t
  modified_base (188)..(188): a, c, t, g, unknown or other
  misc_feature (188)..(188): n is a, c, g, or t
  modified_base (246)..(246): a, c, t, g, unknown or other
  misc_feature (246)..(246): n is a, c, g, or t
  modified_base (329)..(329): a, c, t, g, unknown or other
  misc_feature (329)..(329): n is a, c, g, or t
tcagactactatgtcacgaccggtgctcgatttagtgtgagtagtttgggtttgggcaccgaccggtgctcgatttagtgtggagtagtttggggtttggggacgagctgcgtcagttaggacccagagggaaccatggaaaccccngcgcagcttctcttcctcctgctactctggcctcccagccntcacggagacttgtgtgacgcagtctccgaggcaccctgtcttgtcctccgagggganagacgtccctacctcgtcctaggactacgggccagtccgaaggtgtgttacgcacgcagcttagttacgccgttacggaaccnggaccgaagaaccgtcggcctcggccctcccgaggccctccgttacacgttcgtaacgtcgggtgcccgtaccgaccggacgggtacctacggtcggtctaccgggccgtaacgtacggtaccgtagggtcgacgtacggttcggacgtttacgggacgtaacggttacgttacctaccgttaccgttaccgtaaccgtccttacgtacgtaaccgtacggtaaacggtaccgggtaaccggtacccggtaaccggtttacggtttttaccggaccggtttaacgggtacgtttaacggtttacctaacggtttaccgtaccggttacggtttaccgttttacccgggttaccccgtttccggttacccgtttaccgttaccgttaaccgtttacccggtttaccgttttccgggttaacccggtttaccggtttaccgggtaccgtacccggtttaacgggg

SEQ ID NO: 158099 - DNA, 836 bp, Homo sapiens
  misc_feature: GYAE6OF02ICLGL.24.78.H01.1.454.CMB.1.raw
  modified_base (156)..(156): a, c, t, g, unknown or other
  misc_feature (156)..(156): n is a, c, g, or t
  modified_base (197)..(197): a, c, t, g, unknown or other
  misc_feature (197)..(197): n is a, c, g, or t
  modified_base (707)..(707): a, c, t, g, unknown or other
  misc_feature (707)..(707): n is a, c, g, or t
  modified_base (813)..(813): a, c, t, g, unknown or other
  misc_feature (813)..(813): n is a, c, g, or t
tcagactactatgtcacgaccggtgctcgatttagtgtgagtagtttgggtttgggagaggagcccagcactagaagtcggcgtgtttccattcggtgatcagcactgaacacgagaggactcaccagtggagtttggctgagcttgggttttccncggtcgtcttcttttaaggagtcgtcagtgtcgaggggacngtcgtaggtggtagtcgtggggcggcggttggtaccctaaccggtagggacgtacccgtgacgaccttccgtccgtggtccggccgggtaccctaccggtcttacctaaccctttacaaactttaacgttagttcggacctaagtccgtaccgtacgtcggggcccaccggtgtacctcccggaaggtacggacggggtcgtagggtaggttcggggtcgccggtacttattacgttttaagttggaagttaacggtaagtaacgtagaaatttcgtagacgtacacggtacgtccgggtaaagtacgggtcccgtacaacgttaccctaccgtaccgtacgtaactaaaccgtaacgttaaaccctaaacgtaacttaaccgttctttcgttttaacgacgttaaacctaagtaaccgttaacgtaacggtacctacgggtacttaagtccgtaaggaaaccgttccgtaacccggttaagtttcgttaacgtttaacgttacggtttntacccggtaaacgttaaccggttccccggtttaaacccggttccccttttaaacggttccgttaaggttttccgggttaaccggtaccccggttaccccgtttaanaccggggttaccgttaaccgggg

SEQ ID NO: 158100 - DNA, 840 bp, Homo sapiens
  misc_feature: GYAE6OF02IQ5O5.24.78.H01.1.454.CMB.1.raw
  modified_base (203)..(203): a, c, t, g, unknown or other
  misc_feature (203)..(203): n is a, c, g, or t
tcagactactatgtcacgaccggtgctcgatttagtgtgagtagtttgggtttgggggaggagctgctcagttaggacccagagggaaccatggaaaccccagcgccagcttctcttcctcctgctactctggctcccagataccactggagaagtagtcatgacgcagtctcagccacctgtctgtgtctccgaggggaaangcccaccctctccgtgcacgggccagtgagtaagttggtggcagcaacgttacgcctcggtacctacgacgtaacgaaaccgtcggacccacggtacctccccgacgggtccttccccgttcccttcttacgttcgtccgtttacgttccttaccccgacccgtaaccggggtcccccgttgggttacccggtacccccgtacgtccccgtaacggggtttccgggtttcgggtccggggttcgggttcggttacggggaccggtaacggttacgttttaccgtaccgttaccttaccgtaacctacgtaccgacggtccccggtacccgttacccggtacggttccgtaaggtaaacggtttaacgttttcggttacccttaacgtttttaactttacgtttaccgtacctaaaccgttaaccgtttaattcgggttacgtaccgttccggtacccgttaccggttaaccgtttacgttttaccgggaacccggtaaccggggtaaccctaaaaccggggtacggtacgtaacgtaaccgaaaccggtacgttacggtaccggtcgttaaccgccgtaacccgtacgttcttaccggttccttaccgttactccccgttacccgtacttaacccgg

SEQ ID NO: 158101 - DNA, 723 bp, Homo sapiens
  misc_feature: GYAE6OF02G9TT7.24.78.H01.1.454.CMB.1.raw
  modified_base (242)..(242): a, c, t, g, unknown or other
  misc_feature (242)..(242): n is a, c, g, or t
  modified_base (337)..(337): a, c, t, g, unknown or other
  misc_feature (337)..(337): n is a, c, g, or t
  modified_base (352)..(352): a, c, t, g, unknown or other
  misc_feature (352)..(352): n is a, c, g, or t
tcagactactatgtcacgaccggtgctcgatttagtgtgagtagtttgggtttggcacgaccggtgctcgatttagtgtgagtagtttggggtttgggggagagctgctcagttaggacccagaggaaccatggaaaccccagcgcagcttctcttcctcctgctactctggctcccagccatcaccggagaattgtgttgacgcagtctccaggccaccctgtctttgtctccgagggganagacgcccaccctctacctcgcgacgggccagtcaggagtgttacgcagcagtctacgttacgccgtacggtaccagcaacggaaacctgggccnggcctccgagcctcncacttactagtggtcgccgtccaccggacggcctacgtcggccgtacggcgggactacggttacgacggtggcgtaggtcggtcggtttcgggactagtaccgttcaccgttcctacgtactaccgtactaccgacgtagaacgtcggaaccgtacccggtaaggttacgttttcgaacgtttacggttagttaacgttttaccgtcggtttaaccgtagttccgttttacgggtttccggttaccccgttttacccgttacccggtttaaccgttaaccgtttacccgtttaaccgtttaccgggtttttacccgggttaacccgtttaccgggggttttaccggtaccggggtttaccggttaaccggg

SEQ ID NO: 158102 - DNA, 899 bp, Homo sapiens
  misc_feature: GYAE6OF02I13OR.24.78.H01.1.454.CMB.1.raw
tcagactactatgtcacgaccggtgctcgatttagtgtgagtagtttgggtttggggagagctgctcagttaggacccagagggaaccatggaaaccccagcgcagcttctcttcctcctgctactctggcctcccagccatcaccggaggaattgtgttgacgcagtctccgaggcacctgtctttgtcctccgagggagagacgcccacccttctcctcggcacgggccagtcagtagttgttacgcgaagcgacgttacctacgttacgcccgttacggttaccaagccgaaaccggtaaacccgttcgggtcccgttacgggccccttaccccggtaagggtccccttaccctaccgtaacgtttaccgttaaacggtttccgggttcggacccggttaccccgtacccgggaaccggggaccccctaaccgggttacgggtaccccgggtacccgggtacccggggtaccggttaaccggggtttaccgtaacggggttaccggggtaacccggttaacggggttcgggttaacccggggtttttacggggggaaaccttaacccggttaaaccgtttacccgtacccgttcccgttaacgtaaccttttacggtaaccggtaccggttaaaccgtaacggtaaccgggtacgggaaccccgttaccggtaaagttcggtttaccgaacgtacgtttacgttacgtttacgtacgttacgtcggttacgtttccgttttaccgcccttaccgttccgttaccttgttacgttaaccttcggtttcggaccggttacgggttcctcgggtaacgttacgggtaacgttaaccgtacggtaaacgtaccggtttaggtaccgtgggttaccacggtaccctaacgtccgtttaacg

SEQ ID NO: 158103 - DNA, 832 bp, Homo sapiens
  misc_feature: GYAE6OF02H3GRD.24.78.H01.1.454.CMB.1.raw
tcagactactatgtcacgaccggtgctcgatttagtgtgagtagtttgggtttgggagagctgctcagttaggacccagagggaaccatcggaaaccccagcgcagcttctcttcctcctgctactctggcctcccagccatcgaccggaggaatttgtgttgacgcagtcctcgaggcctacctgttctttcgtctccgagggagagacgcccaccctctcctgcgacgggtccagtcaaggtgttcggtagcagtacaggtccttacgtacgccggttacgtaccgagacgtaacgaaaccttgggacctacgggtccctacccgtacggtccttacccttaccacgttaccgttaacgttcgggtcaacccggtcccaccggtaccgggccctacgggttcgggccggttccggacggtaaccgtacgggttctaacgggtccggggtaccgtaaggggttcgggttaccggtttacgggaacgtccggttaactttccgtacccttcgtactatttaccaacgttaccgacgaacggtacgtaccgggtaaccgaacccggttaagtttacggttaggtaccgttaggtttccgttaaatttaccgtacgttaccggtagttccggtttaggttttccccgttacccttcccttacccgtttacgtttaagtttaccgtttaaccgttttccgggtttaaccggtacccggttcgggtttaaaccccgtgggttcggtaacgggtcgtaaccggttaaccgtaaccggtacgtttaaggtaccgggttacgtcccggttactaaccccgtacgttaaccggtttccgg

SEQ ID NO: 158104 - DNA, 800 bp, Homo sapiens
  misc_feature: GYAE6OF02F90WT.24.78.H01.1.454.CMB.1.raw
tcagactactatgtcacgaccggtgctcgatttagtgtgagtagtttgggtttggggagaggagcccagcactagaagtcggcggtgtttccattcggtgatcagcactgaacacagaggactcaccatggtagtttgggctggagtcgttgggttttcctcgtcgcttcttttaaggaggtgtccagtgtcgaggggcagcgtggtggagtcgtgggggcgcgtcggtccaaccgtgggacggtcctgacgactcctcgtggtcgccggtcctccgtattccaccttacaattacttagcggactatcgctacgtcgggtcccaccgagggcctacggacgggacggacggggtcgtagggacgggtggggtccgccgtacttatttcgttttaagttggaagtaggtaaacgttaacgtactaaagtttactttaagcggaccgtaacgtacccggttaccgggtagggtaaacccgggggtccctttaccgacccgttagttacccgtaccgacggtaaaccgtaaaccttaaacccttacccgtaaaacgtacctttaaccgtttcctttacgtttacgtacgtaactaaacgttcgtaaccgttaaccgtcctacggtacttacgtacgtacgggaacgtaccgtaccgggtactttacgttcttaacgttcggttacgtacggtaacggtaccgttccccggtttaccccggtttaccttaaccgtttaacggttaaccgtttcggggttacccggggtacccgtaccccgttagtaccgggtacggttaccgg

SEQ ID NO: 158105 - DNA, 764 bp, Homo sapiens
  misc_feature: GYAE6OF02F0HM7.24.78.H01.1.454.CMB.1.raw
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactcgtggcctcccagccatccgaccggaggaattggtgttcgacgctagtcctccgaggcctacctgttcttgtcctccggaggggatacgacgccctacccgttctccgtagccgtacggggcctaggtcctaaggtaggttaggttaggacctaaggccgaggttacccttaacgttacggtcccgttacggtacccgaggtaccaaacgggtaaccgtccggtcccgttcgggaccccgtaccccggaacgggttcccttaccccgtacgtacttcgtaacggttcggttcgtacccgggttacccaaccccggtacgggtcccgtaacgtccgggtaccgtccgggaccgtacgtacgggttcgaacgggtcggagtaggtcgggtcgttgggacgtagtccttacgtacctcgtacctatcgtaacgtcgacgacggtacgtcggaccgaccgtaagttacgtttcgacgttagtcgttacgttctacgtacgtacgttcgttcgtttccggtcccttccgttcccttacgttaccgttacgttaacgtttccggttaccggtaccggttacggttaccgtcgttacgttacgg

SEQ ID NO: 158106 - DNA, 692 bp, Homo sapiens
  misc_feature: GYAE6OF02JB479.24.78.H01.1.454.CMB.1.raw
tcagactactatgtcacgaccggtgctcgatttagtgtgagtagtttgggtttgggggagaggagcccagcactagaagtcggcggtgtttccattcggtgatcagcactgaacacagaggactcaccatggagtttgggctgagctgggttttcctcgtcgctcttttaagaggtgtccagtgtcaggggcagctgggtggagtctggggggcggcgtggtccaacctgggaggtccctggagactctcctgtgccggcctcccgattcaccttcaatacttatggcatgcacgtgggtccgccaggcctccgaggcgaagggggctgggaggtggggtcggccgcttattctttatttggagttaggaaagtaatactaaattaatttatcgtacaacgtaccgttccgggtaggtaacgggggtcccggtttaccaccctacgttcccgtacccgaaggaaccgtaacctaaactttacccaaaaccgtaaattaccttcgttacgttttctacggtaactaaagttcgtaacgtacgtcctcggaccgtatccgtgaacggtaaccgacggtcttacgtacttattaccgtggtacgacggaaacgttccggtttccccgtccctttacgttacgttaacgtttacggttcggggtcccgttaccccgtacgtacgttcgggtaccgg

SEQ ID NO: 158107 - DNA, 798 bp, Homo sapiens
  misc_feature: GYAE6OF02FW9LL.24.78.H01.1.454.CMB.1.raw
  modified_base (245)..(245): a, c, t, g, unknown or other
  misc_feature (245)..(245): n is a, c, g, or t
tcagactactatgtcacgaccggtgctcgatttagtgtgagtagtttgggtttggggagagctgctcagttaggacccagagggaaccatggaaaccccagcgcagcttctcttcctcctgctactctggctcccagccatcaccggaggattgtgttgacgcagtctccaggcacctgtctttgtctccgaggggagagacgcccaccgtctcctgcacgggccagtccgagtaagttggttanacgagtacacggtactaacgttacgccgtaggtaccagacgtaaacgaacctcggtccctggacccctccggtaacgtcccgttacctcgtaccttctacggtcggtccggtacccgtacccgaaccggtaacgggccctaacggttcgggtccgcccggtacgggtaaccgtgggtttcacggttcgacggtacggttcggtcgggtttacggacgttaacggtcctttaccgaacgttcctgttaactacgtacgtaccgtaacgtaacgtacgttacgggaacgtaccggtaacgttacggttacgtacgtagttaaccgttagtttaacgtcgttaaccggtcgttaccggttttcgggtttaccccttccccggtttccttacccggtttaccttacggttaaccgtttacccgttttcgttttaaccgggttcccggttacgggtttaccgtaccggtacggttaccggtaattaaccggaacgggtaaaccgttacggttacgggtttacgtcccggtcggttaccgacccgttacttacgttccg

SEQ ID NO: 158108 - DNA, 906 bp, Homo sapiens
  misc_feature: GYAE6OF02GDF1J.24.78.H01.1.454.CMB.1.raw
tcagactactatgtcacgaccggtgctcgatttagtgtgagtagtttgggtttggcacgaccggtgctcgatttagtgtgagtagtttggggtttggggagagctgctcaggttaggacccaggaggaaccatacggaaaccccagcgcagcttctcttcctcctgctactcgtggcctcccgacgccatcgaccggaggtaattgtgttgacgctacgtcctccgacggcctaccgtgttcgtttcgtccgtccggagggggagacgaccgccctaccctcgtccgtcggacgtacggtccacggtacgtaggtacgttggtacgcgacgaccgtacgtaccttacgttacgccggttacggaaccgacgtaaccgaacggtaacccgtcggtccgtaccggtacctacccggcggtccctccgtacgtaccttacggttcggtacggtaccgtacccgtacccgtaaccggtaccggtaccgtccgggtacggtccggtacgggtaacggtacccggttacggtaacgggtcggttaccgggtacggttcgggttaccggtttacgggttaacgggaacccgtttaacgttacccgtttaccgtacgttaccgttaacccgtaacggtttcctaacgggtacccgtaaaccggttaaccgggacgggtaaccgggtaacccgggtttaacccgttaaaggttttccggtttaacggccgttttaaggggtttaccgtttaacgtttcccggtttaaccggtcgttacccgttttaccgggtttccgtttaccccggttcccgtttacccggttaccgttttaacgttaacggtttccccggtttaaggtttcccggtttcgggttaaacccggtcgggttacccgttacggtccggttaacggg

SEQ ID NO: 158109 - DNA, 671 bp, Homo sapiens
  misc_feature: GYAE6OF02JSBSU.24.78.H01.1.454.CMB.1.raw
  modified_base (464)..(464): a, c, t, g, unknown or other
  misc_feature (464)..(464): n is a, c, g, or t
  modified_base (482)..(482): a, c, t, g, unknown or other
  misc_feature (482)..(482): n is a, c, g, or t
  modified_base (531)..(531): a, c, t, g, unknown or other
  misc_feature (531)..(531): n is a, c, g, or t
tcagactactatgtcacgaccggtgctcgatttagtgtgagtagtttgggtttggcacgaccggtgctcgatttagtgtgagtagtttgggtttgggagagctgctcagttaggacccagagggaaccatcggaaaccccagcgcagcttctcttcctcctgctactcgtggcctcccgagccatccgaccggaggaacttgtgttgacgctacgtcgtccgacgcctacccgttcggttcctttcgtccgtccggaggggagacgaccgtcccacccgttcctaccgtggccgacgggtccacgtacgaggacgttcgtagcgtagacgacgtacttaccgttcgtacccgtcggaacccgagaacccgaacggtaacccgtcggtccgtcggtccctcccggacggtcctaccgtctacttcgtgtacggtcgaccgtccgacgccgccgacgtcggtacgnggtccgacgtaggtccgnggtcgagtcggtgtacggttcggcgtacgtcgtctacgtctaccgtacncgtactaccgactacgtacgcggaccgttacgacgttagtacgtcgtagtacgttaacgtcgtctacgtcgtacgttcgttacgtcgtccgttcttacgtcttacgtactttcgtcggtccttggtcgtacgtactacgg

SEQ ID NO: 158110 - DNA, 907 bp, Homo sapiens
  misc_feature: GYAE6OF02GV1YL.24.78.H01.1.454.CMB.1.raw
tcagactactatgtcacgaccggtgctcgatttagtgtgagtagtttgggtttgggcacgaccggtgctcgatttagtgtgagtagtttggggtttggggagagcgtgctcagttaggacccaggagggaaccagtgggaagccccagcgcacgcttctcttcctctgtctactctacggcctcccgagactaccctacgtagggaacgtaaggttagtaccgtaagttcggaaccgtactacggttcctacccgacggtacccctacccgttaggttccgttaggttcgtacccgttaccgggaaaggggggtaaaacgtaccggccccctacccgttcctacccggtaggacccggacggggtacctaaggtccgtaagggtacgttacggttaacggacgacggtacgaacggtaccttaacgtttaccggacccgttagggttaccccaggaccgttaaacggaaaccgttcgggaccttacgggtaccccttaccggacggttacccgttacccacgttaaacgtccgtttaacggttcggggtaccggtccccgttaaccgtaaccgggtaaccgggttcccgtacgggttaccgggtaccggtacccgggtacccgggtaaggttaccgggtttacgtcgggtaacggtcgtacgggttcgggtttcgttaacgggtacgtaaccgtaaccgtttccgaacgttcctagttaaccgtccgtaacgtaccgttaaacggtccgtaacgggtaccggaaccgggttaacccgttaagtttaccgttagtacccttaaggtttaacgtaccgttacgtcgtacgtattcggtttacgtcccgttaccgttcctacgttccgtagttccgtacgtttcggaccgttacggttacgcggttacgg

SEQ ID NO: 158111 - DNA, 824 bp, Homo sapiens
  misc_feature: GYAE6OF02GJBZD.24.78.H01.1.454.CMB.1.raw
tcagactactatgtcacgaccggtgctcgatttagtgtgagtagtttgggtttggggagaggagcccagcactagaagtcggcggtgtttccattcggtgatcagcactgaacacagaggactcaccatggagtttgggctgagtctgggttttcctcggtcgcttcttttaaaggaggtcgtccagtggtcgaggggcagctggtggagtcgtggggcggcgtggtccaaccgtgggacggtccctgagctctccgtgcgccgcctccgattccaccttcaacttacttacgcggtactacgtgctaccggtcgggtcccgccgtaggtccctaccggacgggaccggaagggggccgtaggggtagggttcggggtccgggtcccgtcttaactttcgtttagtttaggaggtagtaaacggttataaccgtaaatttagttaagtcgagtaacgttaaccgtaccgggtaaggtaccggggttacccggttaccaaccgtacttacccgtacgaagtaaccgtaactaacccgtttaaccaaaacttaactaccttacggtttaactttcgtaacgtaacccgtaaagttcgtaaccgttaacgtcccgtaacggtcgttaacttccggtacggaacgggtacccgtaaccgggtttcgttacgtacctttaagtttacggttacgtaaccggtaacgttaacccggttaccccggtttacccccggtttaccctttaaccggttaacgtttacgggttttaccgggttccgggggtaacccccttaaccggtacccggttagttaccggggttacccggg

SEQ ID NO: 158112 - DNA, 708 bp, Homo sapiens
  misc_feature: GYAE6OF02HHAQT.24.78.H01.1.454.CMB.1.raw
  modified_base (164)..(164): a, c, t, g, unknown or other
  misc_feature (164)..(164): n is a, c, g, or t
  modified_base (189)..(189): a, c, t, g, unknown or other
  misc_feature (189)..(189): n is a, c, g, or t
  modified_base (202)..(202): a, c, t, g, unknown or other
  misc_feature (202)..(202): n is a, c, g, or t
  modified_base (331)..(331): a, c, t, g, unknown or other
  misc_feature (331)..(331): n is a, c, g, or t
  modified_base (687)..(687): a, c, t, g, unknown or other
  misc_feature (687)..(687): n is a, c, g, or t
tcagactactatgtcacgaccggtgctcgatttagtgtgagtagtttgggtttggggagagctgctcagttaggacccagagggaaccatggaaaccccagcgcagcttctcttcctcctgcttactcgtggcctccagccatcacggagtattgtgttgacgntagtctcgaggcaccgtgtctttcncgtccgagggganagcgtaccctaccctctccgtagcgagggaccctaaggtcgaaggtaagttgttacacaggtcagtcttaaccgtacgcctagtaccagacaagtaaccgtgtccgtacgcctcccgaggtcctccttnacttcgtagtcggcgtaccgacctaaccgcgggtacccgtacgtggaccgtacgggaccgtaaacgttcggttacggaggttcgaccgtaggtcggtacgtttacgggaactggtaccttgtacccgtatacccgattaaccgtcgacgtccgtccctagtacgtacgtacgtacgtttacgttactactttacgtttacggttctaagttaccctaatacgtagtacggtcgtaacggttccgtaccctccgggttaacttccgggtttacgggaaccgttacgggaaaccgtaagtacggtactaacgtaacgaacggttacgtcggtacgttacgacggtacctacggttacnccggtttacgttcaccgttcg

SEQ ID NO: 158113 - DNA, 621 bp, Homo sapiens
  misc_feature: GYAE6OF02GL0V4.24.78.H01.1.454.CMB.1.raw
tcagactactatgtcacgaccggtgctcgatttagtgtgagtagtttgggtttggggagagctgctcagttaggacccagagggaaccatggaaaccccagcgcagcttctcttcctcctgctactctggctcccagccatcaccggaggattgtgttgacgcagtctccaggcaccctgtctttgctccaggggaacgagccaccgtctccgtgacagggccagtcagagttgtagcagtcagctactagcctggtacagcagaaacctggcctggctcccgaggtctccgtcatctagtcggtgtccgtccacgagggcctacgtggcgtcgacggacgtcgttacgagttcggcaagttggcgttttgggactacggactttcaacgttctcactcgattccggactagacgtcgacgccgtaaagtatttcgactagttagttaacttacgtagttacgtagtacgtttcggtttacggtcccttacttcccgtttacgtagttacgttacgttacgtttttcggacgttaccggttccgtacgttacggtacggtaacggtacttcgaaccggtacgtaagttcggttcgtacgtcgaccgtaccgtattacccgg

SEQ ID NO: 158114 - DNA, 981 bp, Homo sapiens
  misc_feature: GYAE6OF02HA2UN.24.78.H01.1.454.CMB.1.raw
tcagactactatgtcacgaccggtgctcgatttagtgtgagtagtttgggtttggcacgaccggtgctcgatttagtgtgagtagtttgggtttggggagagctgctcagttaggacccagacggaaccatggaagccccagcgcagcttctcttcctcctgctactctggctcccagataccactggagaagtagtcatgacgcagtctccagccaccctgtctgtgtcctaccgaaggggaaaagacgcccaacccttctaccctggaccgaaggggcccaaggttacggaaggtaaattacggtttacgggacgtaacggaacctaaacgtttaaccggacccgtttaggggttaaccccgaacggaccgtaaaacggtaaaaaccccggttacggggaccccgaaacgggggtcccctaacccccggtaacggggtccccttaccccgtttacccgttacccgttaacgttaccggtacccgtttcggttacccccgttaccccgaaaccccggtacccggggggttacccccccgtttagggttacccgttacccccggaacggtacccccggttaaacggggttttccgggtttacgggggtcccggggtttcgggggttccggtacggggggtactaaacggtttacgttttacccgtaacccgttaccgtaccgtaacccgttacgttaccgaacggtacccgggtacccttacccgtaacggttccgttaagttaaacggttagtttttaccgtaccgtttaaaccgttttttattttaccgttaggttaacctaaaccgttacgttaacggttacggttaccgttaacgttacccgggtaacccgtttaacccggttaccgtttaaaccggtttttccgggaaccccggttaaccggggtaacccgttaaaaccggtacgggttaaaccgtaaaccgttaaaccgttaaaccggtaaaccgtttaccgggg

SEQ ID NO: 158115 - DNA, 744 bp, Homo sapiens
  misc_feature: GYAE6OF02F8F6K.24.78.H01.1.454.CMB.1.raw
  modified_base (209)..(209): a, c, t, g, unknown or other
  misc_feature (209)..(209): n is a, c, g, or t
  modified_base (215)..(215): a, c, t, g, unknown or other
  misc_feature (215)..(215): n is a, c, g, or t
  modified_base (252)..(252): a, c, t, g, unknown or other
  misc_feature (252)..(252): n is a, c, g, or t
  modified_base (508)..(508): a, c, t, g, unknown or other
  misc_feature (508)..(508): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaagccccagcgcagcttctcttcctcctgctactctggcctacccgagactaccacgtggagaagtagtcatgacncagtcnccgagccacccgtgtctgtcgtctaccggaagggaangccccacctcgtcctaggccacgggccaggtgaacgtaagttcggttaggacgaaggtacctaaacgtttcggccgttaccgggtaccgacgacgaaccgtaaacccgttcggacccgacggccctacccgacggtccttcccgtaccttcgtactcgaccttcgttccctacccgacccgtaccggggtcccctcggtccggtaccgaccgtacccggtacggtttcgggttcggggtacgggttcgggttcggngggtaccgtaggtacttccgtactcctactaccgtacgtcgtacggtcccgcctaccggtattaccgtacgtaagtttacgttttcgacgtttacgtttttacgttttacgttacgttaccaacttaccgttagttcgtacggttctccggtacccttacggtaccgttaccggtttacggaccggtaaccggtaccgtaacggtcggtaagtacgtaacggtaaccgagttcggg

SEQ ID NO: 158116 - DNA, 864 bp, Homo sapiens
  misc_feature: GYAE6OF02FXPQO.24.78.H01.1.454.CMB.1.raw
tcagactactatgtcacgaccggtgctcgatttagtgtgagtagtttgggtttgggggaggagcccagcactagaagtcggcggtgtttccattcggtgatcagcactgaacacagaggactcaccatggagtttgggctgagctgggttttcctcgtcgtcttcttttaagaggtgtccagtgtcgaggggcagctggtggagtcgtggggcggcgtcgtccgaacgtgggacggtccctgacgactctcctggtcgccgcctcccgtacttcctaccttacaattacttgtcggactatcgaccaggtccgggtcccggccaggtccttaccgagggtaccggaagggggtcgtagggtagggtcgggggacggtcccgtacgttaacgtttaccgttttaagtttcggaagtttaagggtaaaacgttaaactcgttaaaaatttagtttaaacgtcggaacctaacgggtaccttacccgggttaaggggtaaaccgggggttccccggttaaccaccgttaaccgttccgtaacccgtaagggaaccgtaaccttaaaccgtttaacgaaaccttaaaccgttaccgtttacgtttacggttaccacgttactaaaacgttaccgtaacgtaccgtccgtgtaccggtacgtacgtagggtaaccgaccggtaacggtccgtttacgttaaccgttaactttaccggtacggtacgtaacccgggtaaaccgttccccggttttaacccccggttacccgtttaaccgttttaacggtaaccgtttttaaccggggttcccggggtaaccccgttaccccgttaaggttccgggtttaaccggtcccgggttaacgggg

SEQ ID NO: 158117 - DNA, 923 bp, Homo sapiens
  misc_feature: GYAE6OF02F1EIZ.24.78.H01.1.454.CMB.1.raw
  modified_base (156)..(156): a, c, t, g, unknown or other
  misc_feature (156)..(156): n is a, c, g, or t
  modified_base (167)..(167): a, c, t, g, unknown or other
  misc_feature (167)..(167): n is a, c, g, or t
tcagactactatgtcacgaccggtgctcgatttagtgtgagtagtttgggtttggcacgaccggtgctcgatttagtgtgagtagtttgggtttgggagagctgctcagttaggacccagaggaaccatggaaaccccagcgcagcttctcttccncctgctactcnggcctcccgagccatccgaccggaggtaattggtgttacgacgcagtcctcgaggccacccttgttcgtttcgtacctccggagggtacgagacgcccaccctctccgtcgaccgacgggcctaggtcgaaggtacggtagttacgacgagtccgaacgtaccgttacgttaccggtccgttacggtaaccgacggaacctaaacggtaaaaccccggttgggtacccgtaccggtccccgtacccgaccgggttacccttacccgtacgtaccgtttaccgttacggtaccggttaccggttcccgtaacccggtaaccccggaccgggtacccggtaacgttcgggtccgtacggtccgggtaaccgttacgggttaccgagggttccggtacgggttacgggttacggggtttaccgttacggggtaacgtaacggtttaccttccgttaaccgtccgttaaccgacgttaccaacgttccgaaaccgtaccggttaacgggtaccgaacccggttaaacccgggtaacgtttaacgttttaccgggaaccgttttaacgggtttaacgttttacccgttaaagggttaccgtttaacccgtaacgggtttcgtttttacccgggttacccgtttaccccgtttccggtaccccttttaacggttaaccgtttacccgtttaaaccggtttacccggttttacggtaacccgtttacgggggttaacccctacggggtaccgttaaaccgggg

SEQ ID NO: 158118 - DNA, 837 bp, Homo sapiens
  misc_feature: GYAE6OF02FOQDY.24.78.H01.1.454.CMB.1.raw
  modified_base (288)..(288): a, c, t, g, unknown or other
  misc_feature (288)..(288): n is a, c, g, or t
  modified_base (308)..(308): a, c, t, g, unknown or other
  misc_feature (308)..(308): n is a, c, g, or t
tcagactactatgtcacgaccggtgctcgatttagtgtgagtagtttgggtttgggggagaggagcccagcactagaagtcggcggtgtttccattcggtgatcagcactgaacacagaggactcaccatggagtttgggctgagcttgggttttcctcgtcgctcttttaagaggtgtccagtgtcgaggggcagcgtggtggagtcgtgggggcgcgtggtccaaccgtgggacgtccctgacactctctgtcgcggcctcccgattccaccttcaattacttagngcatcgctacgtcgggtccncgagcctccgaggtcgaaggggtctgggaggtggggtcgccgtagttacttctttagttagtagtacggtaaagttactactaaagtttaattacgtacggacgtaaacggtaccgttacggtaacggggtaaacccggggtacccggtttacccaaaccgggtttacctcccttaaaccgaaggtaacgttaaacctaacccgtaaccctaaaacgtaaacccgtttaccgtaccgtttacgtttacccgttagtaaaccgttaaacgttcggtaaaccgttacgtaacccgttacgtaacggtcgttaaccgtacgggtaaccgggtaacccgtacggttccgttacggttaagtttaacgttaacgtacgggtacggttaacggaaaacccgggtttccccggtttccccccggttaaccctttaacgggtttaaccggttaaaccggtttttaccggggttcccgggggtaacccccgttaaccccccgggtacggttaacccgggttagggttaacccccgggg

SEQ ID NO: 158119 - DNA, 641 bp, Homo sapiens
  misc_feature: GYAE6OF02GKHSZ.24.78.H01.1.454.CMB.1.raw
  modified_base (460)..(460): a, c, t, g, unknown or other
  misc_feature (460)..(460): n is a, c, g, or t
  modified_base (496)..(496): a, c, t, g, unknown or other
  misc_feature (496)..(496): n is a, c, g, or t
  modified_base (518)..(518): a, c, t, g, unknown or other
  misc_feature (518)..(518): n is a, c, g, or t
  modified_base (629)..(629): a, c, t, g, unknown or other
  misc_feature (629)..(629): n is a, c, g, or t
tcagactactatgtcacgaccggtgctcgatttagtgtgagtagtttgggtttggcacaaccggtgctcgatttagtgtgagtagtttgggtttggggagagctgctcagttaggacccagagggaaccatggaaacccccagcgcagcttctcttcctcctgctactctggctcccagccatcgaccggaggaattgtgttgacgcagtctccgcgccaccctgttctttcgtctccgaggggacagacgccaccctctccgtgcacgggccagtccgagtacgtgttagacagcgtagtaccttacgttacgtccgttacgtaccgacgtccaacgtaaaccgtggaccgtcggccgtacccgagtcccttcctcctacttcgtagttcggtcgacccgtcccgaaccggcggtccgacgtcgggaccgtcggtaccgacgtacggttcgacgtcggngtaggtcgtacgtggaccgagtccttcaccgttacnctagactacgtcgaacacggtntcggaacctaccgtaagttcgttacgcgttatcgttaactctcggtctacgtgttcgttccgtcctcttcccttagtcgttccttacgtccgttacggtccgtcggttacnggtaccgtacgg

SEQ ID NO: 158120 - DNA, 716 bp, Homo sapiens
  misc_feature: GYAE6OF02JBLZZ.24.78.H01.1.454.CMB.1.raw
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctcctgctactctggctcccagccatccaccggagtaattgtgttgacgcagtctccaggccacccgtgtctttgcctcgaggggacacgacgcccaccctctccgtcgcgacgggccagtcgagtagtgtagcgagcacgctacgtacgcctaggtaccagacctaacgaaaccgtcggacctcggcctacccgacggtcccttccgtacacttcgtagttcggtcgccgtcccgaccgaccgggcctacggtcggaccgtcggaccggaacgttacgggtcacgggtcgacgtagggtcggtacgtttagggaaccgtacgtaccttccgtacttcctacgactactacgtcgtaccgtacgaacgtcggaccggtacccgtaagtaccgtttagacgttagttacgttaacgttaacgtaggtaccgtaacgttccgttacggttttcccgttacccgttccgttccccgttaccttaacggttaccgtttaaccgtttaaccggttttccggggtaccccgtttaccggggtacccggtacggtccggttaacggg

SEQ ID NO: 158121 - DNA, 841 bp, Homo sapiens
  misc_feature: GYAE6OF02HPIET.24.78.H01.1.454.CMB.1.raw
tcagactactatgtcacgaccggtgctcgatttagtgtgagtagtttgggtttggcacgaccggtgcttcgatttagtgtgagtagtttgggtttggggagagctgctcagttaggcccaggagggaaccatcggaaaccccagcgacagctttctccttcctcctgctactcgtggcctcccagtccatccgaccgggtagtacttggtcgttagacgctacgtctaccgaaggtccacccgttcgttacgtttcgtaccgttccggaaaggggtacgaaccggaaccggcccctaaccccgtctttcccggtaacggccgggtaaacggggccctaacggttaccgtaaggtacggtttacggtacaccgtaacgtacgaacttacgttaagttaaccggtcgttaaccggtaccctacgtacgtaaacggtaaaccgttcgggaccgttcggtaccctaccggtacgtcctaccctaggtaaccttcgtttaagtcggttccgtaaccggtaccctacgggacggttaccaacggtacggtccgtaccggtaacggtacgttaacggttacggagtcccggtagttcgggtacggttcgttacgggactaacggtaccttacgtacttcgtaactcgaacttacgacggtactacggtagtacggaaccgtaccgtagtttacgttcgaacgttggtacgttaacttcgtacgtagtcgttaccggttacttcccggttacccttaaccgtttccgtaccgttactttaacccggtttacgttttacccggtttcgggtaacccggtttaccggttaaccgtacggttaccggtaagg

SEQ ID NO: 158122 - DNA, 707 bp, Homo sapiens
  misc_feature: GYAE6OF02G6F77.24.78.H01.1.454.CMB.1.raw
  modified_base (156)..(156): a, c, t, g, unknown or other
  misc_feature (156)..(156): n is a, c, g, or t
  modified_base (172)..(172): a, c, t, g, unknown or other
  misc_feature (172)..(172): n is a, c, g, or t
  modified_base (317)..(317): a, c, t, g, unknown or other
  misc_feature (317)..(317): n is a, c, g, or t
  modified_base (601)..(601): a, c, t, g, unknown or other
  misc_feature (601)..(601): n is a, c, g, or t
tcagactactatgtcacgaccggtgctcgatttagtgtgagtagtttgggtttggggagaggagcccagcactagaagtcggcggtgtttccattcggtgatcagcactgaacacagaggactcaccatggagtttgggctgagctgggttttccncgtcgctcttttaagnggtgtccagtgtcaggggcagctggtgagtcgtgggggcggcgtcggtccaaccgtgggacgtccctgagaccttctcctgtcgccggcctacccgattccacctttcaattacttagtggactactgcctacgtcggggtcccnccgtaacggcctccgaggacgtaagggggcctgggacggtggggtcggacccgtctaattcctttagttacgagttagggaaacgttaatctaaagttcttagacgtacacgtacctcgggtaagaacggggtccctacaccgtatccgtacagacgtaactaactacccgaaataactaccgttatttcgtttacgcgtaactaaacgttcgtaaccgtcgtccgtagtacgtacgttacgtaggacggaaccaggttaccttggttaccttaacgttaccgngttcgtaacggtaaccgttcccggttccccccggttactttacccgtacgttacgtttacggtttacccggggtacccgtaccccttagtacggccggttaccggg

SEQ ID NO: 158123 - DNA, 777 bp, Homo sapiens
  misc_feature: GYAE6OF02F609J.24.78.H01.1.454.CMB.1.raw
  modified_base (274)..(274): a, c, t, g, unknown or other
  misc_feature (274)..(274): n is a, c, g, or t
  modified_base (669)..(669): a, c, t, g, unknown or other
  misc_feature (669)..(669): n is a, c, g, or t
  modified_base (697)..(697): a, c, t, g, unknown or other
  misc_feature (697)..(697): n is a, c, g, or t
  modified_base (705)..(705): a, c, t, g, unknown or other
  misc_feature (705)..(705): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaaccccagcgcagcttctcttcctctgctactctggcctccagataccactggaagaaatgtagatagacgcagtcctccagtcccaccgtgtcgtagttcgtccgtacgaaggggaaacacgcctacccctacttccgnggaccgacgggtcctaacgtaccgaaggaagttaaacgaaacggaaacgtaaccgtaaaccgttaacgttaaccgtaccgttaggtaaccttaacggaaaaccgtaaccggaaaaaccgttcggaaccgtaaccggaccgttaacccggacggtaccctaccctacacgttacttaacgtacggttaataccgtaccgacggaccgtacgggtaccctacgttacggtaccgttacccggacgtacccgtaacggttaccgtagggtaccgtacggtaacggggttcggttacggtacggggaacgtacggtacgttaccggtaccttaccgtaccgtaaaccagttacccgaacgtccgtagttccgacgtacgtacgtctaagttaacgtttnttaacgtctttaagtacttaagccctanaccggtancggtaacgtacgagttacggcgttacgccggttactcggttacccggtagggaccggtacggtagtaacggg

SEQ ID NO: 158124 - DNA, 682 bp, Homo sapiens
  misc_feature: GYAE6OF02FHHC5.24.78.H01.1.454.CMB.1.raw
  modified_base (133)..(133): a, c, t, g, unknown or other
  misc_feature (133)..(133): n is a, c, g, or t
  modified_base (259)..(259): a, c, t, g, unknown or other
  misc_feature (259)..(259): n is a, c, g, or t
  modified_base (269)..(269): a, c, t, g, unknown or other
  misc_feature (269)..(269): n is a, c, g, or t
  modified_base (437)..(437): a, c, t, g, unknown or other
  misc_feature (437)..(437): n is a, c, g, or t
  modified_base (462)..(462): a, c, t, g, unknown or other
  misc_feature (462)..(462): n is a, c, g, or t
  modified_base (471)..(471): a, c, t, g, unknown or other
  misc_feature (471)..(471): n is a, c, g, or t
  modified_base (485)..(485): a, c, t, g, unknown or other
  misc_feature (485)..(485): n is a, c, g, or t
  modified_base (581)..(581): a, c, t, g, unknown or other
  misc_feature (581)..(581): n is a, c, g, or t
tcagactactatgtcacgaccggtgctcgatttagtgtgagtagtttgggtttggcacgaccagtgctcgatttagtgtgagtagtttcgggtttggggacgagctgctcagttaggacccagacgggaaccntggaaaccccagcgcagcttctcttcctcctgctactctggcctcccagactacccacgtaggagaaagttagtgaagtcgacgcagtctccacgcccacctgttctgtcgtcctccggaaggggnacgcgacccnccctctccgtgcgacgggacccagtacgaggaacggttgttacggcacggacacgtaccttacgttacgccgttacgaccgagaccgaacgtaaccgtcgtccgtcggtacctcccgaggtccctacctctacttcgtagttcggtaccgtccaccgacgacggaccncgtacggtcgcgcggacgtggtacnggtcgtcgnggtcggtgtacggntacgtactctacgtactcgactcgtataccgacgtacgacgttccggaacggttacgtaggttacttcggaacgttagttcttaacttccgggttntaccggtacgtttcgttttaccgggttcccttaccctttcctacccgtttcttaacgtccgtttaaaccgtttcggtccggttacgggttccggttaccgg

SEQ ID NO: 158125 - DNA, 742 bp, Homo sapiens
  misc_feature: GYAE6OF02FUIRP.24.78.H01.1.454.CMB.1.raw
  modified_base (243)..(243): a, c, t, g, unknown or other
  misc_feature (243)..(243): n is a, c, g, or t
  modified_base (282)..(282): a, c, t, g, unknown or other
  misc_feature (282)..(282): n is a, c, g, or t
tcagactactatgtcacgaccggtgctcgatttagtgtgagtagtttgggtttggcacgaccggtgctcgatttagtgtgagtagtttgggtttggggagagctgctcagttaggacccagagggaaccatggaaacccccagcgcacgcttctcttccgtcctgctactctggctcccagtccgatcaccggaggaagttgtgttgacgcagtctccaggcacctgtcttgtcctcgagggnaggacgccaccctctacctggccagggctagtcagagtnttacgcacgcgtacgcttacgtacgcgtcggtaccacgcaacggaacctggcctggaccctaccgacggtcctacccgtctacgtcgtagtacggtcgtacgtaccgcccgaacgggtccctaacggtcggggaccgttcgggaccggtaaccgttagggttacccgacgggtacggtcgtaggttccggtacggtttcgggtacgtacggtaccttacgtaccttctacgtactaccggttaactccgaacgtacggtacgtcgggtacgacccgggtaaggttaccgttttacgggacgtttagggtcgtttaattaacgttcgttacgttaccggttacgtttggttttacccggttccgtttaccgttcccgttaccgttcggttaacgtttaccggttaaccggtttttcccggaccggttttacccggtaccgtaccgggttacccgtaacggg

SEQ ID NO: 158126 - DNA, 802 bp, Homo sapiens
  misc_feature: GYAE6OF02H2HHT.24.78.H01.1.454.CMB.1.raw
  modified_base (216)..(216): a, c, t, g, unknown or other
  misc_feature (216)..(216): n is a, c, g, or t
tcagactactatgtcacgaccggtgctcgatttagtgtgagtagtttgggtttggggagagctgctcagttaggacccagagggaaccatcggaaaccccagcgcagcttctcttcctctgctatctggctcccagccatccaccggaggtaattgtgtagacgcagttctaccaggcctacccgtgttcctttgcctccgagggggatacggacnccctaacctcctcctgaccgtagggcctagtccaggtacgttgtacgacaaggcagacttaaccgttagcccgttaggtaacccaggtaccaacggaaaccctgggtacctacgggtacccttaccccgaagggtccttaacccgtactaacttcctaaggttaccgggttacgtcccggtacccaaaccggtaccggggacctacccggttcggggccccgtttacggtaccggggaacccgttaagggtttccgaaggtttaccgggacggttaagggttcggggtttaccgttttacggggaaatttaaccggtacccgttttccgaaacctttacccgtactaaaccgtcccgtttaaacaccggtaacgaacgggtaacggttaacgggaaccgtaccggtaaagttacgtttacgtacgtagttaacgttaacgtttaccgtgtttaccggaagttcgttaaccggtttcgtaccccttcgtaccctacttaagtccgtacttacgttcgtaccggtacggttccaggcttaggaactaacgacgtaagcgtacgcggtagacctagcctaacgtctacg

SEQ ID NO: 158127 - DNA, 837 bp, Homo sapiens
  misc_feature: GYAE6OF02JAU79.24.78.H01.1.454.CMB.1.raw
tcagactactatgtcacgaccggtgctcgatttagtgtgagtagtttgggtttggggagagctgctcagttaggacccagagggaaccatcggaaaccccagcgcagcttctcttcctctgctactctggcctcccagccatccaccggaggtattgtgttgacgcagttcctcaggccaccctgttctttgcctccgtaggggagacgacgccctacccgtcttcctaggccgaacggggccctaagtccgaaggtacgtttaggttaccggactagggcccaggttaccgttaaccttacggtcccgtacggtaaccgaagtaccgtaaacggaaaacccgttgggaccccgttcggacccgtaccccggtaacgggccctttcccctacgtaccgttacttacggttcgggttccgacccggttacccaaccgggaacggccccgttaaccgggtcccggtcccggttaaccgggtacccgggtaaccgtttaccgggttaccgtacgggtacccgggtaacggtacggttcccggggttaaccgttttacggggaaccctaccggttaaacccgtttccgtaaccctttaccgtacgtacccgtttactaacccggtttacgaaccgtttaaccggacggttacggaacccgtaccgtaaacggtttacgttcgacgtacgttagttacctttagcgttagcgttcgttcgtacgtccttccgtaccttcgtacgtcgtttaccgttgttcccgtaacgttcggttacctacgggtctaaggtctaacgtctacgtacgtaccgttggtacctccgtagtaccctagtctacg

SEQ ID NO: 158128 - DNA, 802 bp, Homo sapiens
  misc_feature: GYAE6OF02HKD1M.24.78.H01.1.454.CMB.1.raw
  modified_base (479)..(479): a, c, t, g, unknown or other
  misc_feature (479)..(479): n is a, c, g, or t
  modified_base (683)..(683): a, c, t, g, unknown or other
  misc_feature (683)..(683): n is a, c, g, or t
tcagactactatgtcacgaccggtgctcgatttagtgtgagtagtttgggtttggggagaggagcccagcactagaagtcggcggtgtttccattcggtgatcgagcactgaacacagaggactcacatggtaggtttgggctgagtcgttgggtttttcctcgtcgtcttacgttttaaggaggttcgtcagttcgtcgaggggcagtcgtgggtcggacgttcggtagggggccggtcgtcgggtaccaacggtcgggtacggttccctggtacgtactccgtccgtggtacggcccggcccgttaccgtaattccttaacccttaacgtaacttaactttaggtacggactagttacgacgtacgtcgggtcccgaacgtggcctacggaggtacaggggacgtggacggttgggcggccctagtttagtctttaacggttgtaagtacgggtaattaaacgtacgtaaaactttnttacgtagcgttaacgtaccgtcgttaacgggaacggtcgtttaccacgttactccgtacgtacggagtaaaccgtaacgtactaaaccgaactttacgttacgtttcgttaacgtcgaaacgttaaccgacgttacacggttctaacgacgtacgtacgtacggaacggtacgtacggtcgttaacgttacgttagtttaacnccggtagttaaccggtaaaccggtttcccgtttaaccccggtacctttaacgttaaccgttacggttacggttaccgggttccggtaacccctttaacggaacggttcggttaaccggg

SEQ ID NO: 158129 - DNA, 756 bp, Homo sapiens
  misc_feature: GYAE6OF02FSN7L.24.78.H01.1.454.CMB.1.raw
  modified_base (601)..(601): a, c, t, g, unknown or other
  misc_feature (601)..(601): n is a, c, g, or t
tcagactactatgtcacgaccggtgctcgatttagtgtgagtagtttgggtttggcacgaccggtgctcgatttagtgtgagtagtttgggtttgggagagctgctcagttaggacccagagggaaccatggaaaccccagcgcagcttctcttcctcctgctactctggctccagccatcaccggaggaattgtgttgacactagtctcgagcctacccttgtctttgtacctccgaaggggtaaacgacgcccaacccttcctccgttagaccgtagggtcctaggtcgaggtagttgttagcgtacgctaggtccttaacgttacgcccttaggtacccaggtccaaacgtaacccgtggcccttggtacccttaccccgaggtcccttcccgttactaacttccgttacgttcgggtcgccgtaccccgacggacgggtccccacggttcgggccgttaccggacgggtaacttacgggtttccgaagggttacggcgtaggttcgttacggttggactaacgtccgttacacgttctacggactacacggtccgaacgtacggtcgtacggaccaaccgttaagtttgttaccggnttaaggttcttaacgttccgttggtcgtaacggtttacgtttcggtttcccgtacccttacgttacccgtttacgtaacggtttcccgtttaacgttacccggttttcgggacccggtttaacgggttcccgtacgggttcggtaaccggtaacg

SEQ ID NO: 158130 - DNA, 691 bp, Homo sapiens
  misc_feature: GYAE6OF02F92M1.24.78.H01.1.454.CMB.1.raw
  modified_base (174)..(174): a, c, t, g, unknown or other
  misc_feature (174)..(174): n is a, c, g, or t
  modified_base (241)..(241): a, c, t, g, unknown or other
  misc_feature (241)..(241): n is a, c, g, or t
  modified_base (270)..(270): a, c, t, g, unknown or other
  misc_feature (270)..(270): n is a, c, g, or t
  modified_base (312)..(312): a, c, t, g, unknown or other
  misc_feature (312)..(312): n is a, c, g, or t
  modified_base (338)..(338): a, c, t, g, unknown or other
  misc_feature (338)..(338): n is a, c, g, or t
  modified_base (394)..(394): a, c, t, g, unknown or other
  misc_feature (394)..(394): n is a, c, g, or t
  modified_base (540)..(540): a, c, t, g, unknown or other
  misc_feature (540)..(540): n is a, c, g, or t
tcagactactatgtcacgaccggtgctcgatttagtgtgagtagtttgggtttggggagaggagcccagcactagaagtcggcggtgtttccattcggtgatcagcactgaacacagaggactcaccatggagtttgggctgagcttgggttttcctcgtcgcttcttttaagnggttgtccagtgtcaggggcagctggtgagtcgtgggggcgcgtggtccaacgtgggacgtcctganactctctgtgcggcctccgattcaccttnaatacttatggcatcgcacgtggtccgctaggcctcgacggngaagggctggaggtgggtcggccgtnttacgttcgttttagtttagacgttagggtaaagttaactctaaagttagtttacnggactaaggtaccgttccggtaagggaaacggggtccccggtttacaaccgtagtcccttacgaacgtaacgacctaaacttaccaaactaacttaaccgttactttagtttcgtacgtaactaaagttcgtaactacgtctacgngttacgtgtaacggtagaaccgtacgtacttcgtacttattacgtacggtagtaacggtaacggtacccgttacccggttaccttaccgtttaacgttacggtttacggttcggggtacccggttaccccgttagtacgtcggtaaccggg

SEQ ID NO: 158131 - DNA, 758 bp, Homo sapiens
  misc_feature: GYAE6OF02GQJET.24.78.H01.1.454.CMB.1.raw
  modified_base (260)..(260): a, c, t, g, unknown or other
  misc_feature (260)..(260): n is a, c, g, or t
  modified_base (347)..(347): a, c, t, g, unknown or other
  misc_feature (347)..(347): n is a, c, g, or t
  modified_base (381)..(381): a, c, t, g, unknown or other
  misc_feature (381)..(381): n is a, c, g, or t
  modified_base (603)..(603): a, c, t, g, unknown or other
  misc_feature (603)..(603): n is a, c, g, or t
tcagactactatgtcacgaccggtgctcgatttagtgtgagtagtttgggtttggggagaggagcccagcactagaagtcggcggtgttccattcggtgatcagcactgaacacagaggactcaccagtggtagtttggctgagtcgttgggttttcctcgtacgtcttacgttttaaggaggttcgtccgagtggtcgaggggcagcgtgggtggagtcggtgggggcgtcggtcgtacccaaccggtgggacgtcccnggacgtactcctccgtgtcggccggtcctaccgtattaccgaccttataaactaccttagcggctagtgcctacggtcgggtacccncgaggtcctccgagggacgaaggggtcctagggnggtcgggtcggtcccgtcttattcgtttagtttcggaagttacgggtaaataacgttaccgtaaatttacgtttacgacgacacggtccgttacggtacgggtaacgggtcccgttacacctacgtaccctcggaagtacgtaacctaacgttaacccaaacgttaacttaccgttacgtttcttaccgtagaacccgtaaattccggaattcccgacggtncggtacttaggtaccggacgtacgtacgtagttcttacgtacgtttagcgttaacggacctaaaccggttcccgttaccccggtttacttaacggttacgtacgttttacgggtccccgggttaaccctacccgagttaccgggcgttaaccggg

SEQ ID NO: 158132 - DNA, 915 bp, Homo sapiens
  misc_feature: GYAE6OF02FYF85.24.78.H01.1.454.CMB.1.raw
  modified_base (206)..(206): a, c, t, g, unknown or other
  misc_feature (206)..(206): n is a, c, g, or t
tcagactactatgtcacgaccggtgctcgatttagtgtgagtagtttgggtttggggagagctgctcagttaggacccagagggaaccatggaaaccccagcgcagcttctcttcctcctgctactctggctcccagccatcgaccggaggtaattgtgttgacgcagtctccaggcctaccctgttcctttgtctccgagggganagacgacccacccgtctccgtggcgacgggccaaggttcgaagtaacttggttacggactacgtaacctaacgttacggccgttaggtaaccacgacgaaaacgtaaaccgttcgggacccgtaacgggtcctaccccggacggttacccttcccttacccttacgttaagtccggtcttacgtacccttacccgaaccggtcccggggtaccccgttgggtaccctaccccgagtccgttaacgggtttccggtacgggtccgggtttacgggtacgtacggggaactacggttacctttccgaacgttcccgtacgtaaaccgtacgttcgtaaacccgggtcccgtacccgttaccggtaaacggttaccgttaacgggtaaacgttttcggttttacgttaaccgttttaactttttaaccgtttacgttaccgttaaacccgttaaaccgttaacgtttacgggttaacccggttacggttaccgtacccggtttaccgtttaaccgtttaccggtttaaccggtttaccgggtaacccggtaaacgggtaaacctaaaccgggttgaaaaccgttaacgtaaacccgtaaaccgttacggtagttccggtaccgttacggacccttaaacgtaaccggttccgtttaaacgttccgttaaccttaccccgttacccgtacccccgttagtaaccgttaaccgg

SEQ ID NO: 158133 - DNA, 759 bp, Homo sapiens
  misc_feature: GYAE6OF02GTFQA.24.78.H01.1.454.CMB.1.raw
  modified_base (176)..(176): a, c, t, g, unknown or other
  misc_feature (176)..(176): n is a, c, g, or t
  modified_base (332)..(332): a, c, t, g, unknown or other
  misc_feature (332)..(332): n is a, c, g, or t
tcagactactatgtcacgaccggtgctcgatttagtgtgagtagtttgggtttggggagaggagcccagcactagaagtcggcggtgtttccattcggtgatcagcactgaacacagaggactcaccatggagtttggctgagcttgggttttcctcgtcgctcttttaagaggtntccagtgtcgaggggcagctggtggagtcgtggggcgcgtggtccaacgtgggacgtccctgacgactctccgtgtcgccggcctcccgtattcctaccttacaaacttacctttagtacgggtacctagtgtacctaccggttcggggtaacccncccgtaaggcccttacccggaacgggtaccggaacgggggtccgtaggggaacggtcgggggtcggtccccggtacgttaacgttctttaacggttttggaagttaacggggtaaaagttaaactacgtaaaagtttacgtttaagcggtaacgaagttacccgttacccggtagggtaaacccggggtcccgttaacaaccgtacttcccgtaccgaaggtaccgaaactaaacttaccaaactaaacttccgtcgttacttacgacgtaaactaagtacgtaacgttcgccttaggctacgtacgagtacgacggtacgtcttacgtaccttagttacgtgtagtacgtaacgtcccgttcccgtcttaagtaccgttagttacgggttccggtaccggtacccctaggtacgttcggtaaccgg

SEQ ID NO: 158134 - DNA, 881 bp, Homo sapiens
  misc_feature: GYAE6OF02G3NE6.24.78.H01.1.454.CMB.1.raw
  modified_base (301)..(301): a, c, t, g, unknown or other
  misc_feature (301)..(301): n is a, c, g, or t
tcagactactatgtcacgaccggtgctcgatttagtgtgagtagtttgggtttggggagaggagcccagcactagaagtcggcggtgtttccattcggtgatcagcactgaacacagaggactcaccatggagtttgggctgagccgtgggttttcctcgtcgcttcgttttaagaggtgtccagttgtcaggggcagtcgtggtggagtcgtgggggcggtcggtggtccaaccgtgggacggtccctggagcttctcctgcggcggccttcccgattccaccttacgaattaccgttancgggactacgtcggctacgttcggggtccccgacgtaaggccttcccgaaggggccgtaaacggggggtctagggggtaacgggtcgggggttccgggtcccgtaacttttaacgttcccgttttaaggttttacggacggtttacggaaaacggtttaaacgttaaccggttaaattttaaccggtttaacgtacggttaaccgtaaaccgggttaaccggttccggggtaaacgggtaaacccggggggttacccgggtttaccaaaccccgttaagttcccgtttaccgaaacggtaaacggtaaaccgttaaaccttaacccgtaaaaccgtaaacgtttaacccgtttacgttacgttttaccgttacgtaactaaacgttacgtaacgtaccgtaccgtacggtacgtacgttaccgtaggtacggtaccgtacggtaccgttacgtacttaacgtttacgtcgtacggtacgtaaccgttacccggtccccgttaccgtttaaccgttacgttacggttttaacggttccggggttaccgttacccccgtaacgtaccgttaccggtaaccgg

SEQ ID NO: 158135 - DNA, 703 bp, Homo sapiens
  misc_feature: GYAE6OF02G95KJ.24.78.H01.1.454.CMB.1.raw
  modified_base (244)..(244): a, c, t, g, unknown or other
  misc_feature (244)..(244): n is a, c, g, or t
tcagactactatgtcacgaccggtgctcgatttagtgtgagtagtttgggtttggcacgaccggtgctcgatttagtgtgagtagtttgggtttgggggagagctgctcagttaggacccagagggaaccatggaaaccccagcgcagcttctcttcctcctgctactctggcctccagccatcaccggaggaattgtgttgacgcagtctccgaggccacctgtctttgctccgagggggtanagacgccaccctctcctcggcgtacgggcccagtccaggtaggtgttacgcagcagctacttacggcgtcggtaccagcaacgaaccgtggccgtggcctccgagccttcctctactcgtagtcgggtacgtcccgtaccgaccgggacgggtcccacggttacgggccgtacggaccgggtacgtacgggtcgaggtcgggcgtagggtcggttcgttcgggaacgtcgtaccttcgacctcgtcctagtcacgttaccggaacacggtaacgtggaacccgaccggttaagttctttcggacttaacggtttacttaagtttccttcggtaacctcggtttacgtttcggttttacccggttcccgttccgttacccttaccgttcgtttacggtttaccctttacgggtttaccgggttaccggttacgggtttcgggacgggttacggtaccggg

SEQ ID NO: 158136 - DNA, 290 bp, Homo sapiens
  misc_feature: GYAE6OF01DA3CU.13.10.A10.1.454.CMB.1.raw
  modified_base (286)..(290): a, c, t, g, unknown or other
  misc_feature (286)..(290): n is a, c, g, or t
tcagtcacgtactacacgaccggtgctcgatttagcgtcgatctcagggatccctgagcgattctctggctccaactctgggaacacagccactctgaccatcagcgggacccagcctatggatgaggctgactattactgtcaggcgtgggacagcagcactgcccgctatgtcttcggaactgggaccaaggtcaccgtcctaagtcagcccaaggccaacccactgtcactctgttcccgcctcctctagtacgtgactgagcgggctggcaaggcgcatagnnnnn

SEQ ID NO: 158137 - DNA, 247 bp, Homo sapiens
  misc_feature: GYAE6OF01CP92C.13.10.A10.1.454.CMB.1.raw
  modified_base (244)..(247): a, c, t, g, unknown or other
  misc_feature (244)..(247): n is a, c, g, or t
tcagtcacgtactacacgaccggtgctcgatttagcgtcgatctcagggtcttcgtggctcacgtccaccaccacgcatgtgacctcaggggtccgggagatcatgagggtgtccttgggttttgggggaagaggaagactgacggtcccccaggagttcaggtgctgggcacagcggccctgggctgcctggtcaaggactacttcctagtacgtgactgagcgggctggcaaggcgcatagnnnn

SEQ ID NO: 158138 - DNA, 205 bp, Homo sapiens
  misc_feature: GYAE6OF01CR27K.13.10.A10.1.454.CMB.1.raw
  modified_base (202)..(205): a, c, t, g, unknown or other
  misc_feature (202)..(205): n is a, c, g, or t
tcagtcacgtactacacgaccggtgctcgatttagcgtcgatctcaggggtccgggagatcatgagggtgtccttgggttttgggggaagaggaagactgacggtcccccaggagttcaggtgctgggcacagcggccctgggctgcctggtcaaggactacttcctagtacgtgactgagcgggctggcaaggcgcatagnnnn

SEQ ID NO: 158139 - DNA, 247 bp, Homo sapiens; identical to SEQ ID NO: 158137
  misc_feature: GYAE6OF01BESMG.13.10.A10.1.454.CMB.1.raw
  modified_base (244)..(247): a, c, t, g, unknown or other
  misc_feature (244)..(247): n is a, c, g, or t

SEQ ID NO: 158140 - DNA, 246 bp, Homo sapiens
  misc_feature: GYAE6OF01EKOD5.13.10.A10.1.454.CMB.1.raw
  modified_base (244)..(246): a, c, t, g, unknown or other
  misc_feature (244)..(246): n is a, c, g, or t
tcagtcacgtactacacgaccggtgctcgatttagcgtcgatctcagggtcttcgtggctcacgtccaccaccacgcatgtgacctcaggggtccgggagatcatgagggtgtccttgggttttgggggaagaggaagactgacggtcccccaggagttcaggtgctgggcacagcggccctgggctgcctggtcaaggactacttcctagtacgtgactgagcgggctggcaaggcgcatagnnn

SEQ ID NO: 158141 - DNA, 203 bp, Homo sapiens
  misc_feature: GYAE6OF01BIRZV.13.10.A10.1.454.CMB.1.raw
  modified_base (201)..(203): a, c, t, g, unknown or other
  misc_feature (201)..(203): n is a, c, g, or t
tcagtcacgtactacacgaccggtgctcgatttagcgtcgatctcaggggtccgggagatcatgagggtgtccttgggtttgggggaagaggaagactgacggtcccccaggagttcaggtgctgggcacagcggccctgggctgcctggtcaaggactacttcctagtacgtgactgagcgggctggcaaggcgcatagnnn

SEQ ID NO: 158142 - DNA, 288 bp, Homo sapiens
  misc_feature: GYAE6OF01C1HBW.13.10.A10.1.454.CMB.1.raw
  modified_base (284)..(288): a, c, t, g, unknown or other
  misc_feature (284)..(288): n is a, c, g, or t
tcagtcacgtactacacgaccggtgctcgatttagcgtcgatctcagggatccctgagcgattctctggcgccaactctgggaacacagccactctgaccatcagcggacccagcctatggatgaggctgactattactgtcatacatgggacaacgatattggatggctgttcggcggagggaccaaactgaccgtcctaggtcagcccaaggctgccccctggtcactctgttccccgccctcctctagtacgtgactgagcgggctggcaaggcgcatagnnnnn

SEQ ID NO: 158143 - DNA, 204 bp, Homo sapiens
  misc_feature: GYAE6OF01DRHPF.13.10.A10.1.454.CMB.1.raw
  modified_base (201)..(204): a, c, t, g, unknown or other
  misc_feature (201)..(204): n is a, c, g, or t
tcagtcacgtactacacgaccggtgctcgatttagcgtcgatctcagggtccgggagatcatgagggtgtccttgggttttgggggaagaggaagactgacggtcccccaggagttcaggtgctgggcacagcggccctgggctgcctggtcaaggactacttcctagtacgtgactgagcgggctggcaaggcgcatagnnnn

SEQ ID NO: 158144 - DNA, 292 bp, Homo sapiens
  misc_feature: GYAE6OF01D7W0F.13.10.A10.1.454.CMB.1.raw
  modified_base (285)..(292): a, c, t, g, unknown or other
  misc_feature (285)..(292): n is a, c, g, or t
tcagtcacgtactacacgaccggtgctcgatttagcgtcgatctcagggatccctgagcgattctctggctccaactctgggaacacagccactctgaccatcagcgggacccagcctatggatgaggctgactattactgtcatacatgggacaacgatattggatggctgttcggcggagggaccaaactgaccgtcctaggtcagcccaaggctcgcccctcggtcactctgttccccacctcctctagtacgtgactgagcgggctggcaaggcgcatagnnnnnnnn

SEQ ID NO: 158145 - DNA, 202 bp, Homo sapiens
  misc_feature: GYAE6OF01EG1T9.13.10.A10.1.454.CMB.1.raw
  modified_base (201)..(202): a, c, t, g, unknown or other
  misc_feature (201)..(202): n is a, c, g, or t
tcagtcacgtactacacgaccggtgctcgatttagcgtcgatctcagggtccgggagatcatgagggtgtccttgggttttgggggaagaggaagactgacggtcccccaggagttcaggtgctgggcacagcggccctgggctgcctggtcaaggactacttcctagtacgtgactgagcgggctggcaaggcgcatagnn

SEQ ID NO: 158146 - DNA, 292 bp, Homo sapiens
  misc_feature: GYAE6OF01C0UWL.13.10.A10.1.454.CMB.1.raw
  modified_base (290)..(292): a, c, t, g, unknown or other
  misc_feature (290)..(292): n is a, c, g, or t
tcagtcacgtactacacgaccggtgctcgatttagcgtcgatctcagggatccctgagcgattctctggctccaactctgggaacacggccactctgaccatcagtagggtcgaagccggggatgaggccgactattactgtcaggtgtgggatagtagtcgtgagcatgtggtattcggcggagggaccaaactgaccgtcctaggtcagcccaaggctcgccccctcggtcactctgttccccaccctcctctagtacgtgactgagcgggctggcaaggcgcatagnnn

SEQ ID NO: 158147 - DNA, 287 bp, Homo sapiens
  misc_feature: GYAE6OF01EF95U.13.10.A10.1.454.CMB.1.raw
  modified_base (277)..(277): a, c, t, g, unknown or other
  misc_feature (277)..(277): n is a, c, g, or t
  modified_base (283)..(287): a, c, t, g, unknown or other
  misc_feature (283)..(287): n is a, c, g, or t
tcagtcacgtactacacgaccggtgctcgatttagcgtcgatctcagggatccctgagcgattctctggctccaactctgggaacacagccactctgaccatcagcggacccagcctatggatgaggctgactattactgtcatacatgggacaacgatattggatggctgttcggcggagggaccaaactgaccgtcctaggtcagcccaaggctgccccctcggtcactctgttcccgcctcctctagtacgtgactgagcgggctggcaaggcncatagnnnnn

SEQ ID NO: 158148 - DNA, 202 bp, Homo sapiens
  misc_feature: GYAE6OF01DO32M.13.10.A10.1.454.CMB.1.raw
  modified_base (201)..(202): a, c, t, g, unknown or other
  misc_feature (201)..(202): n is a, c, g, or t
tcagtcacgtactacacgaccggtgctcgatttagcgtcgatctcaggggtccgggagatcatgagggtgtccttgggtttgggggaagaggaagactgacggtcccccaggagttcaggtgctgggcacagcgaccctgggctgcctggtcaaggactacttcctagtacgtgactgagcgggctggcaaggcgcatagnn

SEQ ID NO: 158149 - DNA, 289 bp, Homo sapiens
  misc_feature: GYAE6OF01D2YIG.13.10.A10.1.454.CMB.1.raw
  modified_base (286)..(289): a, c, t, g, unknown or other
  misc_feature (286)..(289): n is a, c, g, or t
tcagtcacgtactacacgaccggtgctcgatttagcgtcgatctcagggatccctgagcgattctctggctccaactctgggaacacagccactctgaccatcagcgggacccagcctatggatgaggctgactattactgtcatacatgggacaacgatattggatggctgttcggcggagggaccaaactgaccgtcctaggtcagcccaaggctcgccccctggtcactctcgttcccgccctcctctagtacgtgactgagcgggctggcaaggcgcatagnnnn

SEQ ID NO: 158150 - DNA, 287 bp, Homo sapiens
  misc_feature: GYAE6OF01AQ0MI.13.10.A10.1.454.CMB.1.raw
  modified_base (281)..(287): a, c, t, g, unknown or other
  misc_feature (281)..(287): n is a, c, g, or t
tcagtcacgtactacacgaccggtgctcgatttagcgtcgatctcagggatccctgagcgattctctggctccaactctgggaacacagccactctgaccatcagcgggacccaggctatggatgaggctgactattactgtcaggcgtgggacaacaacactgcgattttcggcggagggaccaagctgaccgtcctaggtcagcccaaggctgccccctcggtcactctgttcccgcctcctctagtacgtgactgagcgggctggcaaggcgcatagnnnnnnn

SEQ ID NO: 158151 - DNA, 205 bp, Homo sapiens; identical to SEQ ID NO: 158138
  misc_feature: GYAE6OF01CN6VV.13.10.A10.1.454.CMB.1.raw
  modified_base (202)..(205): a, c, t, g, unknown or other
  misc_feature (202)..(205): n is a, c, g, or t

SEQ ID NO: 158152 - DNA, 540 bp, Homo sapiens
  misc_feature: GYAE6OF01CVLCA.13.10.A10.1.454.CMB.1.raw
  modified_base (323)..(323): a, c, t, g, unknown or other
  misc_feature (323)..(323): n is a, c, g, or t
tcagtcacgtactacacgaccggtgctcgatttagcgtcgatctcaggggggaagcctgggaacacttagccttcatgagtgtccccaccatggcctggatgatgcttctcctcggactccttgcttatggatcaggagtggattctcagactgtggtgacccaggagccatcgttctcagtgtctcctggagggacagtcacactcacttgtggcttgagatacggctcagtctctagtagttactaccccagctggtaccaacagaccccaggccaggctccgcgcacgctcatctacaacacaaaacactacgctcttcnggggtccctcatcgcttctctggctcatccttggacaaagctgcccttatcatcacggggcccaggcagaagatagaatctgtattattactgtgttctttatagttgggtagtgtcctatttctgtctgttgttcgggagggacggccgacccggctggacccggttcccgtccgggtcacggccccgaaggcctcggcccccgtagttccccggg

SEQ ID NO: 158153 - DNA, 290 bp, Homo sapiens
  misc_feature: GYAE6OF01BFQG3.13.10.A10.1.454.CMB.1.raw
  modified_base (284)..(290): a, c, t, g, unknown or other
  misc_feature (284)..(290): n is a, c, g, or t
tcagtcacgtactacacgaccggtgctcgatttagcgtcgatctcagggatccctgagcgattctctggctccaactctgggaacacagccactctgaccatcagcgggacccagcctatggatgaggctgactattactgtcatacatgggacaacgatattggatggctgttcggcggagggaccaaactgaccgtcctaggtcagcccaaggctgccccctggtcactctcgttcccacctcctctagtacgtgactgagcgggctggcaaggcgcatagnnnnnnn

SEQ ID NO: 158154 - DNA, 292 bp, Homo sapiens
  misc_feature: GYAE6OF01ECOP1.13.10.A10.1.454.CMB.1.raw
  modified_base (288)..(292): a, c, t, g, unknown or other
  misc_feature (288)..(292): n is a, c, g, or t
tcagtcacgtactacacgaccggtgctcgatttagcgtcgatctcagggatccctgagcgattctctggctccaactctgggaacacagccactctgaccatcagcgggacccagcctatggatgaggctgactattactgtcatacatgggacaacgatattggatggctgttcggcggagggaccaaactgaccgtcctaggtcagcccaaggctcgccccctcggtcactctcgttccccgccctcctctagtacgtgactgagcgggctggcaaggcgcatagnnnnn

SEQ ID NO: 158155 - DNA, 291 bp, Homo sapiens
  misc_feature: GYAE6OF01AIAWV.13.10.A10.1.454.CMB.1.raw
  modified_base (282)..(291): a, c, t, g, unknown or other
  misc_feature (282)..(291): n is a, c, g, or t
tcagtcacgtactacacgaccggtgctcgatttagcgtcgatctcagggatccctgagcgattctctggctccaactctgggaacacagccactctgaccatcagcgggacccagcctatggatgaggctgactattactgtcatacatgggacaacgatattggatggctgttcggcggagggaccaaactgaccgtctaggtcagcccaaggctcgcccctggtcactctcgttcccacctcctctagtacgtgactgagcggctggcaaggcgcatagnnnnnnnnnn

SEQ ID NO: 158156 - DNA, 289 bp, Homo sapiens
  misc_feature: GYAE6OF01AM5HA.13.10.A10.1.454.CMB.1.raw
  modified_base (276)..(276): a, c, t, g, unknown or other
  misc_feature (276)..(276): n is a, c, g, or t
  modified_base (282)..(289): a, c, t, g, unknown or other
  misc_feature (282)..(289): n is a, c, g, or t
tcagtcacgtactacacgaccggtgctcgatttagcgtcgatctcagggatccctgagcgattctctggctccaactctgggaacacagccactctgaccatcagcgggacccagcctatggatgaggctgactattactgtcatacatgggacaacgatattggatggctgttcggcggagggaccaaactgaccgtcctaggtcagcccaaggctgcccctggtcactctgttcccgcctcctctagtacgtgactgagcgggctggcaaggcncatagnnnnnnnn

SEQ ID NO: 158157 - DNA, 245 bp, Homo sapiens
  misc_feature: GYAE6OF01D9VV5.13.10.A10.1.454.CMB.1.raw
  modified_base (245)..(245): a, c, t, g, unknown or other
  misc_feature (245)..(245): n is a, c, g, or t
tcagtcacgtactacacgaccggtgctcgatttagcgtcgatctcagggtcttcgtggctcacgtccaccaccacgcatgtgacctcaggggtccgggagatcatgagggtgtccttgggttttggggggaagaggaagactgacggtcccccaggagttcaggtgctgggcacagcggccctgggctgcctggtcaaggactacttcctagtacgtgactgagcgggctggcaaggcgcatagn

SEQ ID NO: 158158 - DNA, 540 bp, Homo sapiens
  misc_feature: GYAE6OF01COGOG.13.10.A10.1.454.CMB.1.raw
tcagtcacgtactacacgaccggtgctcgatttagcgtcgatctcagggggggaagcctgggaacacttagccttcatgagtgtccccaccatggcctggatgatgcttctcctcggactccttgcttatggatcaggagtggattctcagactgtggtgacccaggagccatcgttctcagtgtctcctggagggacagtcacactcacttgtggcttgagatacggctcagtctctagtagttactaccccagctggtaccaacagaccccaggccaggctccgcgcacgctcatctacaacacaaacactcgctctctggggtccctcactcgcttctctggctccatccttgggaacaaagctgcccttatcatcgacggggcccagcagaagatagatctgtattattactgttgtttctttatatgggtatgactatttctgtctgtgttcggaggacggcgacccggcgtcgacccggttccgttccggtccacggtaccccgaacgggtcctccggtcccccagttacccgg

SEQ ID NO: 158159 - DNA, 287 bp, Homo sapiens
  misc_feature: GYAE6OF01CJ4UF.13.10.A10.1.454.CMB.1.raw
  modified_base (282)..(287): a, c, t, g, unknown or other
  misc_feature (282)..(287): n is a, c, g, or t
tcagtcacgtactacacgaccggtgctcgatttagcgtcgatctcagggatccctgagcgattctctggctccaactctgggaacacagccactctgaccatcagcgggacccagcctatggatgaggctgactattactgtcatacatgggacaacgatattggatggctgttcggcggagggaccaaactgaccgtcctaggtcagcccaaggctcgccccctggtcactctcgttcccgcctcctctagtacgtgactgagcggctggcaagcgcatgnnnnnn

SEQ ID NO: 158160 - DNA, 542 bp, Homo sapiens
  misc_feature: GYAE6OF01DY6IG.13.10.A10.1.454.CMB.1.raw
tcagtcacgtactacacgaccggtgctcgatttagcgtcgatctcagggggggaagcctgggaacacttagccttcatgagtgtccccaccatggcctggatgatgcttctcctcggactccttgcttatggatcaggagtggattctcagactgtggtgacccaggagccatcgttctcagtgtctcctggagggacagtcacactcacttgtggcttgagatacggctcagtctctagtagttactaccccagctggtaccaacacgaccccaggccaggctccgcgcacgctcatctacaacacaaacactcgctcttctcgggtccctcatcgcttctctggctcactccttggacaagctgcccttatcactcgacggggcccaggcagagatgaatctagtattattacttgttgttctttatagttggtagtcgtctatttctgtctgttcgttgggaggacggccgacccggctcggacccgttccgtccggtccgaccgtacccgaacggccgtccggtccccgtgtccccgg

SEQ ID NO: 158161 - DNA, 213 bp, Homo sapiens
  misc_feature: GYAE6OF01AEW9V.13.10.A10.1.454.CMB.1.raw
  modified_base (203)..(213): a, c, t, g, unknown or other
  misc_feature (203)..(213): n is a, c, g, or t
tcagtcacgtactacacgaccggtgctcgatttagcgtcgatctcaggggtccgggagatcatgagggtgtccttgggttttgggggaagaggaagactgaccggtcccccaggagttcaggtgctgggcacagcggccctgggctgcctggtcaaggactacttcctagtacgtgactgagcgggctggcaaggcgcatagnnnnnnnnnnn

SEQ ID NO: 158162 - DNA, 204 bp, Homo sapiens
  misc_feature: GYAE6OF01BE71I.13.10.A10.1.454.CMB.1.raw
  modified_base (202)..(204): a, c, t, g, unknown or other
  misc_feature (202)..(204): n is a, c, g, or t
tcagtcacgtactacacgaccggtgctcgatttagcgtcgatctcaggggtccgggagatcatgagggtgtccttgggttttgggggaagaggaagactgacggtcccccaggagttcaggtgctgggcacagcggccctgggctgcctggtcaaggactacttcctagtacgtgactgagcgggctggcaaggcgcatagnnn

SEQ ID NO: 158163 - DNA, 506 bp, Homo sapiens
  misc_feature: GYAE6OF01EE8GT.13.10.A10.1.454.CMB.1.raw
tcagtcacgtactacacgaccggtgctcgatttagcgtcgatctcaggggggaagcctgggaacacttagccttcatgagtgtccccaccatggcctggatgatgcttctcctcggactccttgcttatggatcaggagtggattctcagactgtggtgacccaggagccatcgttctcagtgtctcctggagggacagtcacactcacttgtggcttgagatacggctcagtctctagtagttactaccccagctggtaccaacagaccccaggccaggctccgcgcacgctcatctacaacacaaacactcgctcttctgggtccctcatcgcttctctgctccatccttgggaacaaagctgcccttatcatcacggggccaggcagaagatgaatctgattattactgtgttctttatatggtagtgctatttctgtctgtgttcggaggcggcgacccggctgaccgtcctcggtcacgcccaaggctcgccccatcccgg

SEQ ID NO: 158164 - DNA, 524 bp, Homo sapiens
  misc_feature: GYAE6OF01BR5XP.13.10.A10.1.454.CMB.1.raw
  modified_base (517)..(517): a, c, t, g, unknown or other
  misc_feature (517)..(517): n is a, c, g, or t
tcagtcacgtactacacgaccggtgctcgatttagcgtcgatctcaggggggaagcctgggaacacttagccttcatgagtgtccccaccatggcctggatgatgcttctcctcggactccttgcttatggatcaggagtggattctcagactgtggtgacccaggagccatcgttctcagtgtctcctggagggacagtcacactcacttgtggcttgagatacggctcagtctctagtagttacctaccccagctggtaccaacagaccccaggccaggctccgcgcacgctcatctacaacacaaacactcgctcttctggggtccctcatcgcttctctggctccatccttggaacaaagctgcccttatcatcgacggggcccaggcagaagatgaatctgtattattactgtgtttctttatagttgggtaagtgtccgtatttctgtcttgtgttcggaggtaggccacccggctcgaccgtcctcggtcacgtccaaggcctcgccccngtcccgg

SEQ ID NO: 158165 - DNA, 521 bp, Homo sapiens
  misc_feature: GYAE6OF01AXPAW.13.10.A10.1.454.CMB.1.raw
  modified_base (466)..(466): a, c, t, g, unknown or other
  misc_feature (466)..(466): n is a, c, g, or t
tcagtcacgtactacacgaccggtgctcgatttagcgtcgatctcagggggggaagcctgggaacacttagccttcatgagtgtccccaccatggcctggatgatgcttctcctcggactccttgcttatggatcaggagtggattctcagactgtggtgacccaggagccatcgttctcagtgtctcctggagggacagtcacactcacttgtggcttgagatacggctcagtctctagtagttactaccccagctggtaccaacagaccccaggccaggctccgcgcacgctcatctacaacacaaacactcgctcttctggggtccctcatcgcttctctggctccatccttgggaacaaagctgcccttatcatcgacggggcccaggcagaagatgaatctgtattattactgtgtttctttatattgggtagtgtcctatttctgtctgtgttcggaggnggcgacccggctgacccggtcctcggtcacgcccgaggctcgcccctagtcccgg

SEQ ID NO: 158166 - DNA, 514 bp, Homo sapiens
  misc_feature: GYAE6OF01CFDVX.13.10.A10.1.454.CMB.1.raw
  modified_base (422)..(422): a, c, t, g, unknown or other
  misc_feature (422)..(422): n is a, c, g, or t
  modified_base (458)..(458): a, c, t, g, unknown or other
  misc_feature (458)..(458): n is a, c, g, or t
tcagtcacgtactacacgaccggtgctcgatttagcgtcgatctcagggggggaagcctgggaacacttagccttcatgagtgtccccaccatggcctggatgatgcttctcctcggactccttgcttatggatcaggagtggattctcagactgtggtgacccaggagccatcgttctcagtgtctcctggagggacagtcacactcacttgtggcttgagatacggctcagtctctagtagttactacccagctggtaccaacagaccccaggccaggctccgcgcacgctcatctacaacacaaacactacgctcttctgggtaccctcactcgcttctctggctccactccttgggaacaaagctcgccttatcatcgacggggcccaggcagaagatagatctagattattactgtnttctttatagtggtatgctattctgctgtgttcggnggagcgaccggtctgacccgtccgtcgtcacgcccgaacggctcgcccagtcccgg

SEQ ID NO: 158167 - DNA, 537 bp, Homo sapiens
  misc_feature: GYAE6OF01B9J2D.13.10.A10.1.454.CMB.1.raw
tcagtcacgtactacacgaccggtgctcgatttagcgtcgatctcagggggggaagcctgggaacacttagccttcatgagtgtccccaccatggcctggatgatgcttctcctcggactccttgcttatggatcaggagtggattctcagactgtggtgacccaggagccatcgttctcagtgtctcctggagggacagtcacactcacttgtggcttgagatacggctcagtctctagtagttactaccccagctggtaccaacagaccccaggccaggctccgcgcacgctcatctacaacacaaacactcgctcttctggggtccctcatcgcttctctggctccatccttgggacaaagctgcccttatcatcacgggggcccaggcagaagatgaatctgattattactgtgttctttattatgggtagtgcctatttctgtctgtgttcgggaggtaggccgaccccggtcgttacccgtccgttccgggtccacgccccgaagggcctcgcccccagtccgggtacccg

SEQ ID NO: 158168 - DNA, 204 bp, Homo sapiens; identical to SEQ ID NO: 158162
  misc_feature: GYAE6OF01DCOV0.13.10.A10.1.454.CMB.1.raw
  modified_base (202)..(204): a, c, t, g, unknown or other
  misc_feature (202)..(204): n is a, c, g, or t

SEQ ID NO: 158169 - DNA, 515 bp, Homo sapiens
  misc_feature: GYAE6OF01B3D31.13.10.A10.1.454.CMB.1.raw
  modified_base (508)..(508): a, c, t, g, unknown or other
  misc_feature (508)..(508): n is a, c, g, or t
tcagtcacgtactacacgaccggtgctcgatttagcgtcgatctcaggggggaagcctgggaacacttagccttcatgagtgtccccaccatggcctggatgatgcttctcctcggactccttgcttatggatcaggagtggattctcagactgtggtgacccaggagccatcgttctcagtgtctcctggagggacagtcacactcacttgtggcttgagatacggctcagtctctagtagttactaccccagctggtaccaacagaccccaggccaggctccgcgcacgctcatctacaacacaaacactcgctcttctggggtccctcatcgcttctctggctccatccttgggacaaagctgcccttatcatcacggggcccaggcagaagatgaatctgattatactgtgttctttatagtgggtagtgcctatttctgtctgtgttcggaggaggcgacccggctgacccgttcctcggtcacgtcccaaggcctcgccccngtcccgg

SEQ ID NO: 158170 - DNA, 748 bp, Homo sapiens
  misc_feature: GYAE6OF01C9KK8.13.10.A10.1.454.CMB.1.raw
  modified_base (214)..(214): a, c, t, g, unknown or other
  misc_feature (214)..(214): n is a, c, g, or t
  modified_base (287)..(287): a, c, t, g, unknown or other
  misc_feature (287)..(287): n is a, c, g, or t
tcagtcacgtactacacgaccggtgctcgatttagcgtcgatctcgaggggggaagcctgggaacacttagccttcatgagtgtccccaccatggcctggatgatgcttctcctcggactccttgcttatggatcaggagtggatttctcagactgtggtgacccaggagccatcgtctcagtgtctcgtggaggacagtcacgactcacttgnggcttgagatacggctcagtctactagtagttacctacccagctggtaccaacacgacccgacggccaggccnccgcgacgacgctcatcacaacaacaaacactcgactcttcgtcgggtccctcactcgtcttctctcggctccgtaactccgttaacgggaaacaaaacggtcctacggtacccttaactacctaaccgttacccggaacccggggggtacccccgtaacgggtaacccgaaaggttaaaacgaaagtaccgggttaaaatttaccgtaaggttaacttttaaacgtttaacccgttaggttttacgttttaaccgtttttaagttaaagggtttacggggtttaacggttaccggttaaccttttaacgtttttcccgttaggttccgtttagggttaccgggtttaccgggtaacggggaccgggtacccgtaaccccgggtcgtaccggtaccccggttcccgtaccgggttaccaccggacccgaacgggtacccaccgtccccgtaccttcccggg

SEQ ID NO: 158171 - DNA, 247 bp, Homo sapiens
  misc_feature: GYAE6OF01CWB0A.13.10.A10.1.454.CMB.1.raw
  modified_base (245)..(247): a, c, t, g, unknown or other
  misc_feature (245)..(247): n is a, c, g, or t
tcagtcacgtactacacgaccggtgctcgatttagcgtcgatctcagggtcttcgtggctcacgtccaccaccacgcatgtgacctcaggggtccgggagatcatgagggtgtccttgggttttggggggaagaggaagactgacggtcccccaggagttcaggtgctgggcacagcggccctgggctgcctggtcaaggactacttcctagtacgtgactgagcgggctggcaaggcgcatagnnn

SEQ ID NO: 158172 - DNA, 292 bp, Homo sapiens
  misc_feature: GYAE6OF01BD2O0.13.10.A10.1.454.CMB.1.raw
  modified_base (287)..(292): a, c, t, g, unknown or other
  misc_feature (287)..(292): n is a, c, g, or t
tcagtcacgtactacacgaccggtgctcgatttagcgtcgatctcagggatccctgagcgattctctggctccaactctgggaacacagccactctgaccatcagcggacccagcctatggatgaggctgactattactgtcatacatgggacaacgatattggatggctgttcggcggagggaccaaactgaccgtcctaggtcagcccaaggcctcgccccgtcggtcactctcgttcccacctctctagtacgtgacctgagcgggactggcaaggcgcatagnnnnnn

SEQ ID NO: 158173 - DNA, 214 bp, Homo sapiens
  misc_feature: GYAE6OF01BHXLC.13.10.A10.1.454.CMB.1.raw
  modified_base (203)..(214): a, c, t, g, unknown or other
  misc_feature (203)..(214): n is a, c, g, or t
tcagtcacgtactacacgaccggtgctcgatttagcgtcgatctcagggtccgggagatacatgagggtgtccttgggttttgggggaagaggaagactgaccggtcccccaggagttcaggtgctgggcacagcggccctgggctgcctggtcaaggactacttcctagtacgtgactgagcgggctggcaaggcgcatagnnnnnnnnnnnn

SEQ ID NO: 158174 - DNA, 310 bp, Homo sapiens
  misc_feature: GYAE6OF01DZKJ3.13.10.A10.1.454.CMB.1.raw
  modified_base (172)..(172): a, c, t, g, unknown or other
  misc_feature (172)..(172): n is a, c, g, or t
  modified_base (295)..(310): a, c, t, g, unknown or other
  misc_feature (295)..(310): n is a, c, g, or t
tcagtcacgtactacacgaccggtgctcgatttagcgtcgatctcagggatccctgagcgattctctggctccaactctgggaacacagccactctgaccatcaggccggacccagcctatggatggaggctgactattactgtcaggcgtgggacagcagcactcgcccgntatcgtcttacggaacgtcgggaccaaggtccaccgtctaagtcacgcccaacgcccaacccactgcactctcgtcccacctctctagtactgactgacgcgggctggacaaggcgacatagnnnnnnnnnnnnnnnn

SEQ ID NO: 158175 - DNA, 308 bp, Homo sapiens
  misc_feature: GYAE6OF01EA9JC.13.10.A10.1.454.CMB.1.raw
  modified_base (233)..(233): a, c, t, g, unknown or other
  misc_feature (233)..(233): n is a, c, g, or t
  modified_base (299)..(308): a, c, t, g, unknown or other
  misc_feature (299)..(308): n is a, c, g, or t
tcagtcacgtactacacgaccggtgctcgatttagcgtcgatctcagggatccctgagcgattctctggctccaactctgggaactcagccactctgaccatcagccgggacccaggctatggatggaggctgactattactgtcaggcgtgggacagcagcactcgcccgctatgtcttacggactgggaccaaggtccaccgtctaagtcacgcccaacggcccaaccccntgtccactctcgttccccaccttcctctagtacgtgactgacggccggctggcaaggcgcagtagnnnnnnnnnn

SEQ ID NO: 158176 - DNA, 513 bp, Homo sapiens
  misc_feature: GYAE6OF01CQDVO.13.10.A10.1.454.CMB.1.raw
  modified_base (459)..(459): a, c, t, g, unknown or other
  misc_feature (459)..(459): n is a, c, g, or t
  modified_base (506)..(506): a, c, t, g, unknown or other
  misc_feature (506)..(506): n is a, c, g, or t
tcagtcacgtactacacgaccggtgctcgatttagcgtcgatctcagggggggaagcctgggaacacttagccttcatgagtgtccccaccatggcctggatgatgcttctcctcggactccttgcttatggatcaggagtggattctcagactgtggtgacccaggagccatcgttctcagtgtctcctggagggacagtcacactcacttgtggcttgagatacggctcagtctctagtagttactaccccagctggtaccaacagaccccaggccaggctccgcgcacgctcatctacaacacaaacactcgctcttctggggtccctcatcgcttctctggctcatccttggacaaagctgcccttatcatcacggggcccaggcagaagatagatctgattatactgttgttctttatagtgggtagtgcctatttctgtctgtgttcggaggnggcacccggtctggaccgtccgtcggtcacgcccaaggctcgccccngtcccgg

SEQ ID NO: 158177 - DNA, 294 bp, Homo sapiens
  misc_feature: GYAE6OF01BVCD1.13.10.A10.1.454.CMB.1.raw
  modified_base (287)..(294): a, c, t, g, unknown or other
  misc_feature (287)..(294): n is a, c, g, or t
tcagtcacgtactacacgaccggtgctcgatttagcgtcgatctcagggatccctgagcgattctctggctccaactctgggaacacagccactctgaccatcagcgggacccagcctatggatgaggctgactattactgtcatacatgggacaacgatattggatggctggttcggcggagggaccaaactgaccgtcctaggtcagcccaaggctcgcccctcgtcactctcgttccccgcctcctctagtacgtgactgaggcgggctggcaaggcgcatagnnnnnnnn

SEQ ID NO: 158178 - DNA, 644 bp, Homo sapiens
  misc_feature: GYAE6OF01EJV95.13.10.A10.1.454.CMB.1.raw
  modified_base (428)..(428): a, c, t, g, unknown or other
  misc_feature (428)..(428): n is a, c, g, or t
tcagtcacgtactacacgaccggtgctcgatttagcgtcgatctcagggggggaagcctgggaacacttagccttcatgagtgtccccaccatggcctggatgatgcttctcctcggactccttgcttatggatcaggagtggattctcagactgtggtgacccaggagccatcgttctcagtgtctcctgggagggacagtcacactcacttgtggcttgagatacggctcagtctctagttagttacctaccccagctggtaccaacacgacccaggccaggcctccgcgcacgctcatctacaacacaaacactcgctcttcgtggggtccctcatcgcttctctcggctcctactccgttagggaacaaagctcgtcccttatacacgtaccgggccggaccgacgacgagagtagtagtactntagttattacgttagttgtttacttttatttagttagggttaggtacgttccgttactttacgtttcggttcgttggtttacgggttcgggtacgggtacggggcccggtaccccgggtccggtacccggttcccggtacccggttcccgggtaccggtaccggaccccgtaaccggtacccggtcccgtaccccggtcccgtccggttaccccgg

SEQ ID NO: 158179 - DNA, 616 bp, Homo sapiens
  misc_feature: GYAE6OF01BM8ER.13.10.A10.1.454.CMB.1.raw
  modified_base (169)..(169): a, c, t, g, unknown or other
  misc_feature (169)..(169): n is a, c, g, or t
  modified_base (256)..(256): a, c, t, g, unknown or other
  misc_feature (256)..(256): n is a, c, g, or t
  modified_base (347)..(347): a, c, t, g, unknown or other
  misc_feature (347)..(347): n is a, c, g, or t
  modified_base (426)..(426): a, c, t, g, unknown or other
  misc_feature (426)..(426): n is a, c, g, or t
tcagtcacgtactacacgaccggtgctcgatttagcgtcgatctcagggggggaagcctgggaacacttagccttcatgagtgtccccacatggcctggatgatgcttctcctcggactccttgcttatggatcagggagtggattctcagactgtggtgacccagganccatcgttctcagtgtctccgtggagggacagtcacactcacttgtggcttgagatacggctcagtctctagtagttacctaccccngctgtaaccaacacgaccccaggccaggcctccgcgcacgctcatcctaacaacaacaaacactcgcttcttcgtcgggtccctcactccncttctctcggctcacttccgttagggaaacaagctacgtcccttatcctagtccggaccggggcccagggcaaggaagntaagaactcgtagtactttatttacttgttcttttactttagttagttgggttacgtcgtaccttattttcgtagtcgttggttcggttcggggaggtacggtaccgtacccgggtcgttaccggtacccggtccgttacggtacccgaccgaccccggtaacggccgtacccgtccccgtaggtcccgg

SEQ ID NO: 158180 - DNA, 619 bp, Homo sapiens
  misc_feature: GYAE6OF01E2J5A.13.10.A10.1.454.CMB.1.raw
  modified_base (172)..(172): a, c, t, g, unknown or other
  misc_feature (172)..(172): n is a, c, g, or t
  modified_base (194)..(194): a, c, t, g, unknown or other
  misc_feature (194)..(194): n is a, c, g, or t
  modified_base (303)..(303): a, c, t, g, unknown or other
  misc_feature (303)..(303): n is a, c, g, or t
  modified_base (329)..(329): a, c, t, g, unknown or other
  misc_feature (329)..(329): n is a, c, g, or t
  modified_base (366)..(366): a, c, t, g, unknown or other
  misc_feature (366)..(366): n is a, c, g, or t
  modified_base (395)..(395): a, c, t, g, unknown or other
  misc_feature (395)..(395): n is a, c, g, or t
tcagtcacgtactacacgaccggtgctcgatttagcgtcgatctcaggggggggaagcctgggaacacttagccttcatgagtgtccccaccatggcctggatgatgcttctcctcggactccttgcttatggatcaggagtggattctcagactgtggtcgacccaggganccatcgttctcagtgtctccgnggaggacagtcacactcacgttggtcggtcttggagataccggctcagtctctaggtacttaccctacccagctcggtaaccaacacgacccaggccaggctccgcgcncgctcactctaacacaacaacactcnctcttcgtcgggtccctcactcgtcttctctgcctcnctcgttaggaaacaagctgtcccttatcngccggaccggggaccaggacgagaagactagtaatctagtatttattacgttagttgtttactttagtagttgggttacgttcgtaccttagtttcgtgttcgttggttcggttacggggtagggaccggtcccgacccgggtcgttaccgacccgggttcccgtaccgggtaccacccggtacccggaacggtccgtccccggtaccccgtcggttaccccgg

SEQ ID NO: 158181 - DNA, 874 bp, Homo sapiens
  misc_feature: GYAE6OF01B4RB3.13.10.A10.1.454.CMB.1.raw
tcagtcacgtactacacgaccggtgctcgatttagcgtcgatctcagggggggaagcctgggaacacttagccttcatgagtgtccccaccatggcctggatgatgcttctcctcgactccttgcttatggatcaggagtggattctcagactggtggtcgacccaggagccatcgttctcgagtgtctccgtgggagggtacacgtcacgtacttaacgttgtcggtactttgaagtacgttaccgggctaccgtagttccttacgttaacgtttaacgtttaaccctaaccccgtaggtccgttacgggttaacccaaaccaaccggaacccccgacgggacccgaacgggccctccccgggccgaccgtacccggtcctacctaacttaccctaaaccaaaaccaaaccctaaaacctaacccgtaccgtccttaccgtttccggttccggggttacccctactacgttccggtcctttaccgtccgttcggccttacccgtacgttacccggtttaacgggaaaccgtaaacgtccgttacccggttacccctttactaccgtaaccgttcccgggaaccggggggtaccccgaaggggtaccaagggtaaacgtaagttaacggaacgtttacgttacgtttaaacgtttacgttttacgtttcggttttacgttttaactttttaaggttagggttttacggggttaacgttcggttaccctttacgttttccgacggtttcgtagggtttcgggttacggaacgggtccggaccgtacccggtccgtccggttaaccggtccgttcccgggtacgacccggacccgggtaacgtcccggtacctaccccgtacgtcccgggttaccc

SEQ ID NO: 158182 - DNA, 395 bp, Homo sapiens
  misc_feature: GYAE6OF01BOSQT.13.10.A10.1.454.CMB.1.raw
  modified_base (372)..(372): a, c, t, g, unknown or other
  misc_feature (372)..(372): n is a, c, g, or t
  modified_base (374)..(395): a, c, t, g, unknown or other
  misc_feature (374)..(395): n is a, c, g, or t
tcagtcacgtactacacgaccggtgctcgatttagcgtcgatctcagggatccctgagcgattctctggctccaactctgggaacacagccactctgaccatcagcgggacccagcctatggatggaggctagacttattactgtacatacaggtacgggaacaaagtattaggtggacgtgggtcgttcgggttcgggacgggaacggaaccaaacgtcgtacccgtacgtacggtaccaccgaccgacgtcctcccgtccccgtcggtactaccttccgttcccgttcccctcccttaccgtacgttacggtaccgtacgacggttcggacgggtccgggtagtacggaacggacggcccgtatagagcnannnnnnnnnnnnnnnnnnnnnn

SEQ ID NO: 158183 - DNA, 535 bp, Homo sapiens
  misc_feature: GYAE6OF01E5AY1.13.10.A10.1.454.CMB.1.raw
tcagtcacgtactacacgaccggtgctcgatttagcgtcgatctcagggggggaagcctgggaacacttagccttcatgagtgtccccaccatggcctggatgatgcttctcctcggactccttgcttatggatcaggagtggattctcagactgtggtgacccaggagccatcgttctcagtgtctcctggagggacagtcacactcacttgtggcttgagatacggctcagtctctagtagttacctaccccagctggtaccaacagaccccaggccaggctccgcgcacgctcatctacaacacaaacactcgctcttctgggtccctcatcgcttctctggctccatcctggaacaaagctgcccttatcatccgacggggcccaggcagaagatgaatctagattattactgtgtttctttatagtgggttagtgtcctatttctgtctgtgttcggaggtacggccgacccggtctcggacccggtccgtccggtcgacgtcccgaacggcctcgccccgtagtcccgg

SEQ ID NO: 158184 - DNA, 595 bp, Homo sapiens
  misc_feature: GYAE6OF01BEM23.13.10.A10.1.454.CMB.1.raw
  modified_base (431)..(431): a, c, t, g, unknown or other
  misc_feature (431)..(431): n is a, c, g, or t
tcagtcacgtactacacgaccggtgctcgatttagcgtcgatctcagggggggaagcctgggaacacttagccttcatgagtgtccccaccatggcctggatgatgcttctcctcggactccttgcttatggatcaggagtggattctcagactgtggtgacccaggagccatcgttctcagtgtctcctggagggacagtcacactcacttgtggcttgagatacggctcagtctctagtagttacctaccccagctggtaccaacagaccccaggccaggctccgcgcacgctcatctacaacacaaacactcgctcttctggggtccctcactcgcttctctcggctccatccttgggaacaaagctcgcccttatcatcgacgggggccaggcaagaagatagaatcgtagtattatttactggttntttacttttatacgttgggttaacggtgtaccgttatttacgttgtcgttggttacggttcgggaagggtaccggccggaaccccgggtcgttcggaccccgttcccggtccgggttccgacggaccccgtaagggccctccggcccccgtaaggttccccggg

SEQ ID NO: 158185 - DNA, 684 bp, Homo sapiens
  misc_feature: GYAE6OF01BNKZB.13.10.A10.1.454.CMB.1.raw
  modified_base (175)..(175): a, c, t, g, unknown or other
  misc_feature (175)..(175): n is a, c, g, or t
  modified_base (192)..(192): a, c, t, g, unknown or other
  misc_feature (192)..(192): n is a, c, g, or t
tcagtcacgtactacacgaccggtgctcgatttagcgtcgatctcaggggggggaagcctggggaacacttagccttcatgagtgtccccaccatggcctggatgatgcttctcctcggactccttgcttatggatcagggagtggattctcagactgtggtcgacccagggacnccatcgtttctcaggtntcctcctgggagggcagtcacacctcactttggtggtcttggagactacggctcagtctacttagttacgttacctaccccagctggtaccaacacgaccccaggccaggcctccgcgcacgctcatcctacaacaacaacactcgcttcttcgtcgggtccctcactcgtcttcttctcggtctccacttccgttacgggaaacaaacgtctcgtacccttatacgtacgtccgaccgggggcccacggacgaacggaaaggtaactaggtaacttcgtagttaattttacttacgttcgtttagttttactttagttagttaggggttacgttacgtccttattttcgttagttcgttgggttcggtttacggggacgggtccggtacccggtaccgggtccggttacgggtaccccgttccgggttcccggtacccgtaccggtacccggtaccgggtaccctcccggccccgttaacggttccccggg

SEQ ID NO: 158186 - DNA, 378 bp, Homo sapiens
  misc_feature: GYAE6OF01CH9EF.13.10.A10.1.454.CMB.1.raw
  modified_base (160)..(160): a, c, t, g, unknown or other
  misc_feature (160)..(160): n is a, c, g, or t
  modified_base (175)..(175): a, c, t, g, unknown or other
  misc_feature (175)..(175): n is a, c, g, or t
  modified_base (340)..(378): a, c, t, g, unknown or other
  misc_feature (340)..(378): n is a, c, g, or t
tcagtcacgtactacacgaccggtgctcgatttagcgtcgatctcagggatccctgagcgattctctggctccaactctgggaactcagccactctgaccatcaggccgggacccaggctagtggatggaggctgacttattactgtcaggcgtgggacngcagcactcgcccgnttagtgttcgttcggaacgtgggaaccaaggtccaccgttctaagcacgacccgaaggccccaaccccatcgtaccacttccgttccgttcccccgcctccgtacgttagtaccgttgacgttggacgggtccgggctggaccgaacgggtcgactagagcagtnnnnnnnnnnnnnnnnnnnnnnnnnnnnnnnnnnnnnnn

SEQ ID NO: 158187 - DNA, 423 bp, Homo sapiens
  misc_feature: GYAE6OF01EQIMW.13.10.A10.1.454.CMB.1.raw
  modified_base (174)..(174): a, c, t, g, unknown or other
  misc_feature (174)..(174): n is a, c, g, or t
  modified_base (371)..(423): a, c, t, g, unknown or other
  misc_feature (371)..(423): n is a, c, g, or t
tcagtcacgtactacacgaccggtgctcgatttagcgtcgatctcagggatccctgagcgattctctggctccaactctgggaacacagccactctgaccatcagccgggacccagcctatggatggaggctgacttattactgtcaggcgtgggacagcagcacgtcgcccgntagtgtcgttacgggaactcgggaccaagggtccacccgtctaagtccaacgccccgaacggccccaaacccctagttcgtacctaccttccgttccgttacccccaccccgttctacgttaacggtaccgtggtaacctggaacgggccgggttcaggggacctaaaggggcccactaaggtagcacatcatcgcnnnnnnnnnnnnnnnnnnnnnnnnnnnnnnnnnnnnnnnnnnnnnnnnnnnnn

SEQ ID NO: 158188 - DNA, 730 bp, Homo sapiens
  misc_feature: GYAE6OF01C4PV4.13.10.A10.1.454.CMB.1.raw
  modified_base (237)..(237): a, c, t, g, unknown or other
  misc_feature (237)..(237): n is a, c, g, or t
  modified_base (636)..(636): a, c, t, g, unknown or other
  misc_feature (636)..(636): n is a, c, g, or t
tcagtcacgtactacacgaccggtgctcgatttagcgtcgatctcagggggggaagcctgggaacacttagccttcatgagtgtccccaccatggcctggatgatgcttctcctcggactccttgcttatggatcaggagtgatttctcagactgtggtacgacccaggacgccattcgttctcagtcgtcctaccgtgggaggacagtccacactctacgttggtagctttagganacgtacgggctctagttcctacgtagttacgttacctaaccccgagctacggtaacccaaaccgaccgaaccccgaacggtcccacggtcctaccccggccgccgaccgcctaacactacctaacaaccaaccaaacctaccgtcgtccttaccgtttcggtaccgggtcccttaccgacttccgtacctttcgtccgtcggtacctacccgtacgtttccgtaaggggaaccaacggtcctcgtacccttatccgacgtccggacccggggccacggacaaggtaatacgtagtatcgtacgtaatttacgttacgttacgttttagttactttaacgtggtttaacggttacgttcgtacttgtttacgtcggtagttcgggttggttaaccggggngacccggtaccgacccgggtcgtacccggtacccgttcccggtccgtccgttaacccggacccggtacgtccgtacccggcccttcggtcccgg

SEQ ID NO: 158189 - DNA, 998 bp, Homo sapiens
  misc_feature: GYAE6OF01DZSS8.13.10.A10.1.454.CMB.1.raw
tcagtcacgtactacacgaccggtgctcgatttagcgtcgatctcgaggggggggaagcctgggaacacttagcctttcatgagtcgtccccaccatggcctggatgatgcttctcctcggactccttgcttatggatcaggagtggattctcagacgttggtcgggtacgaccccgaagggacgtcctattccgtttactcgaggtttcgtccttccgtggggacgggaacacggttaccacaccttctacgtttgggtcggtctttaggaacgtaacgtaccgggtcttaccgtaggttccttaccgtttaaggtttaaccgttaaccctaacccccgtacgtaccgttaccgggttaaacccaaaaccgtaacccgggaacccccaacggggaccccgtaacgggtccccttccccggacccggtacccgaccggtcccttaactaactttaacccgtaaaacccaaaaaccaaaaccctaaaaaccgtacccttaccgtcctttacccgtttccgggttccgggggttacccctctaaccgttcgtcctttctacggtcggtaccctccttaacgttcccggttaagggaaaccctaaacgtccgttacccgttaacccgttattaccgtacggtacccggggtacccgggggacccgaacggaacggaaacggtaaggtaacgttaacgtaacgtttacgttaagggttaactttttaacgtttaacggtttggttttaacgttttttacgttttaagggttaacggtttacggggtttaacggttccggtaaccgttttacgtttttccggtcgggtttccgtttacgggtttcgggggttaaccgggggtaaacgggtcccgggtaaccccggtccccgggttacccggttaccgggttacccccggttacccgggttacccgggtacccgttaaccccgggacccgttaaacggggtccctaccccgggtaaccctcgggttaaccccgg

SEQ ID NO: 158190 - DNA, 659 bp, Homo sapiens
  misc_feature: GYAE6OF01ESUA2.13.10.A10.1.454.CMB.1.raw
  modified_base (335)..(335): a, c, t, g, unknown or other
  misc_feature (335)..(335): n is a, c, g, or t
  modified_base (358)..(358): a, c, t, g, unknown or other
  misc_feature (358)..(358): n is a, c, g, or t
  modified_base (477)..(477): a, c, t, g, unknown or other
  misc_feature (477)..(477): n is a, c, g, or t
tcagtcacgtactacacgaccggtgctcgatttagcgtcgatctcagggggggaagcctgggaacacttagccttcatgagtgtccccacatggcctggatgatgcttctcctcggactccttgcttatggatcaggagtggattctcagacttgtggtgacccaggacgccatccgttctcagtcgtctccgtgggagggacagtcacactctacttggtggtctttggagtatacggctctacgttctactagtagttaccctacccgagtctcggtacccaacacgacccgaggccaggcctccgcgccacgctcactctaacaacacaacnctacgctcttcgtcggtccctcnctcgtcttctctcgtcctcctacttccgttacgggaaactaacgtccttacgtaccctttatccgtacgaccgggtacccgggggacccgaggaccgtaaagaagtactaagtaacttnttagtaatttacgtttagtgtttattttactttagttggtgggttactgtccttagtttcgttgtcgttggttcggtacgggacggtaccggaccgtcccggtccgttaccgggtcccggttcgttcccgggacgtacccgtaacccgggcggtcccctcccggtaccgtcggttaccccgg

SEQ ID NO: 158191 - DNA, 784 bp, Homo sapiens
  misc_feature: GYAE6OF01C1QI6.13.10.A10.1.454.CMB.1.raw
  modified_base (186)..(186): a, c, t, g, unknown or other
  misc_feature (186)..(186): n is a, c, g, or t
  modified_base (198)..(198): a, c, t, g, unknown or other
  misc_feature (198)..(198): n is a, c, g, or t
tcagtcacgtactacacgaccggtgctcgatttagcgtcgatctcgagggggggaagcctgggaacacttagcccttcatgagtgtccccacatggcctggatgatgcttctcctcggactccttgcttatggatcagggagtggattctcagactggtggtagacccgaggacgccatcgttctnagtcgtctccgngggaggacagtcacactcacttggtggcttggatctacggctcgagttctacgtagttacgtaacctacccacgtactcggtaacctaacacgaaccccacggaccacgggcctccggccgcgaccgtcctcactacctaaccaaaccaacctaaaccacctaccgtccgttcttccgggttccggggtaccctactaacgtccgtacctttcctcgttcggccttccgtacgttaccgttaacgggaaaccgtaaaacggtccgtaccggttaccccttagtacctaacgttacccggggaccccgggggtaacccacgggcaaaggaagtaactaagaacgttcgtagtaactttaacgtttaacgttgtttaacgttttacgtttaattaggtttacgggttaggttacgttcccgttaagttttccgttacggttcggttacgggtttacggggttacgggaacgggtaccggggtaccgtaccccggggttccgtaacccgggtacccggttcccggtaccgggttcccggaacggaccccggtaacgggtccgttacccggcccctacgggttaccccgg

SEQ ID NO: 158192 - DNA, 759 bp, Homo sapiens
  misc_feature: GYAE6OF01BUAVI.13.10.A10.1.454.CMB.1.raw
  modified_base (213)..(213): a, c, t, g, unknown or other
  misc_feature (213)..(213): n is a, c, g, or t
tcagtcacgtactacacgaccggtgctcgatttagcgtcgatctcagggggggaagcctgggaacacttagccttcatgagtgtccccacatggcctggatgatgcttctcctcggactccttgcttatggatcaggagtggattctcagactgtggtgacccaggagccatcgttctcagtgtctcgtggagggacagtcacactcacttgnggtcttggagatacggctcgtagtctactagttacgttacctacccagctaggtaccaacacgacccaggccaggacctccgcgcacgctcactctaacaacacaaacactcgtactcttcgtacgggtccctctactcgtcttctctcggtctccgtacttccttacggggaaacaaacgtccgttcggtaccctttagtacctacgtcccgggtaaccgggggaccccgacgggaaccggaacgtaaagggtaacgttaggtaaacttacgttacgttaaacgttttaagttttaacgttacggttttacggttttaacttttaagtttaacggtttggggtttaacggttacggtcccgtttaacgtttttccgtacggtttcgttacgggtttaccggttacggggtaacggggtaccgggtacccgtaacccccggggtccgttacccggtaaccccgggtttccccggttaccgggttacccgaaccggtaccccgggtacggtacccgttcccgtaacccccggtccgttacccccggg

SEQ ID NO: 158193 - DNA, 768 bp, Homo sapiens
  misc_feature: GYAE6OF01DYWZK.13.10.A10.1.454.CMB.1.raw
  modified_base (329)..(329): a, c, t, g, unknown or other
  misc_feature (329)..(329): n is a, c, g, or t
  modified_base (355)..(355): a, c, t, g, unknown or other
  misc_feature (355)..(355): n is a, c, g, or t
tcagtcacgtactacacgaccggtgctcgatttagcgtcgatctcagggggggaagcctgggaacacttagccttcatgagtgtccccaccatggcctggatgatgcttctcctcggacttccttgcttatggatcaggagtggattctcagactggtggtgacccaggagccatcgttctcagtcgtctccgtgggaggacagtcacactcacttggtgcttgagtatacgactcagttctctagtacgttacctacccagctcggtaccaaccacgaaccccaggaccgacggcctccgacgcacgctcactctaacacaataaacnctacgtctcgttctacgggtccctcnctcgtcttctctcggcctctactcgttaacggaacaacgtctacgtcccttagtcacgtaccggccgggggaccccgtaagggaccgaaaggtaagtaacgttaaggtaaacttccgttagttaaactttacttttaaacggttttcgttttacgtttttaccggtttttaagtttaacgggttacgggggtttaagttaccgggtttaccctttacgttttttacccggtggtttcggtttcgggttttaaccgggttccgggggtaacggggtacccgggtacccgggtacccccgggtaccgttaccccgggggttaccccgttaacccgggtttcccgggtcctaaaccccgggtaccccggtaaacgggttcccgtaaaccccgttcccccgtaccgggtttccccgg

SEQ ID NO: 158194 - DNA, 608 bp, Homo sapiens
  misc_feature: GYAE6OF01AR9PC.13.10.A10.1.454.CMB.1.raw
tcagtcacgtactacacgaccggtgctcgatttagcgtcgatctcagggggggaagcctgggaacacttagccttcatgagtgtccccaccatggcctggatgatgcttctcctcggactccttgcttatggatcaggagtggattctcagactgtggtgacccaggagccatcgttctcagtgtctccgtggaggacagtcacactcacttgtggcttgagatacggctcagtctctagtagttacctacccagctggtaccaacagaccccaggccaggctccgcgcacgctcatctacacacaacactcgctcttctcgggtccctcactcgcttctctcggctcctactccgttacgggaaaccaaagccttacgtcccttatcctagccggaccgggggcccaggccaaggaagataggactcgtatattattacttgttagtttctttagtatgggtagtcgtaccttatttcgtgttctagttcggttggtagggtaccggtccgaaccccgggtcctaccgggtacccggttcccgtaccgggttccgaacggtcccccgaaacgggtcccgtcccggtacccccgtcggttaccccggg

SEQ ID NO: 158195 - DNA, 668 bp, Homo sapiens
  misc_feature: GYAE6OF01ANSPN.13.10.A10.1.454.CMB.1.raw
  modified_base (366)..(366): a, c, t, g, unknown or other
  misc_feature (366)..(366): n is a, c, g, or t
tcagtcacgtactacacgaccggtgctcgatttagcgtcgatctcagggggggaagcctgggaacacttagccttcatgagtgtccccaccatggcctggatgatgcttctcctcggactccttgcttatggatcaggagtggattctcagactgtggtgacccaggagccatcgttctcagtgtctccgtggagggacagtcacactcacttgtggcttgagactacggctcagtctctagttacgttacctaccccagctggtacccaacacgaccccaggccaggcctccgcgcacgctcactctacaacaacaaacactcgctcttcgtcggggtccctcactcgtcttctctcggctcccnctccttacgggaacaaagtctcgtcccttatcctacgtccggacccgggggcccacgggacgaacggaaagagtagtaaactctaagttatttaacgtttacgttgtttagtttattttagttaaggttgggttaagttcgtacgttactttcgtggtcgtttggttcggtttcgggtacgggaccgggtacccggtaccccgggtccgttccggggtaccccggttcccggtacccgggttaccgaacccggtaccccggtaacggccccgttcccggtcccccggttccggttacccccg

SEQ ID NO: 158196 - DNA, 869 bp, Homo sapiens
  misc_feature: GYAE6OF01AZA6R.13.10.A10.1.454.CMB.1.raw
  modified_base (114)..(114): a, c, t, g, unknown or other
  misc_feature (114)..(114): n is a, c, g, or t
  modified_base (188)..(188): a, c, t, g, unknown or other
  misc_feature (188)..(188): n is a, c, g, or t
  modified_base (202)..(202): a, c, t, g, unknown or other
  misc_feature (202)..(202): n is a, c, g, or t
  modified_base (237)..(237): a, c, t, g, unknown or other
  misc_feature (237)..(237): n is a, c, g, or t
  modified_base (252)..(252): a, c, t, g, unknown or other
  misc_feature (252)..(252): n is a, c, g, or t
  modified_base (310)..(310): a, c, t, g, unknown or other
  misc_feature (310)..(310): n is a, c, g, or t
tcagtcacgtactacacgaccggtgctcgatttagcgtcgatctcgagggggggaagccgtggggaacacttagccttcatgagtgtccccaccatggcctggatgatgcttcncctcggacttccttgcttagtggatcgaggtacgtggtatttcacgagcgttggtgggtacgacccgagggacncctattcggtttcncaggttgtcctccgtagggacgggactacgcaacncgttccgagtttcgngggtacttaggacgtagtccggctctaggttcctactaggtaccgtttaccttacccncgtacgtacggtaccaacgacgtacccgacgaccgtacgccgtaccgcgccgaccgcgtaccactaccaacaacaacaaaccgtcctccgtaccgttccgttccggtaccgggttccctcgttcgtccgttccttccgttcgtcccggttacctttacccgtaccgtaccgtttaacggggtaaaccgtaaaccggtacccgtttacccggttaccccttactaacccgttccggttaaacccggggcccggggtaaacccccgggcgggaaaccggttaacggaaacggtaaaccgtttggtaaaccgtttacccgggtattttaaccggtttaaaccttgggtttacgtttttacggtttttaccggttttaagtttacgggttacggggttttaacgtacggtttacccgtttacgttttacccggtggtttacgttacgggtttacggggtcggttaaccgggtccggaccggttaccggtcccgttaccggaccgttcccgacgggtccgtaccgaccgggttacgaccggtacccctcgtcccggttacccgg

SEQ ID NO: 158197 - DNA, 830 bp, Homo sapiens
  misc_feature: GYAE6OF01CO70R.13.10.A10.1.454.CMB.1.raw
  modified_base (57)..(57): a, c, t, g, unknown or other
  misc_feature (57)..(57): n is a, c, g, or t
  modified_base (183)..(183): a, c, t, g, unknown or other
  misc_feature (183)..(183): n is a, c, g, or t
  modified_base (216)..(216): a, c, t, g, unknown or other
  misc_feature (216)..(216): n is a, c, g, or t
  modified_base (252)..(252): a, c, t, g, unknown or other
  misc_feature (252)..(252): n is a, c, g, or t
tcagtcacgtactacacgaccggtgctcgatttagcgtcgatctcgagggggggaancctgggaacacttagccttcatgagtgtccccacatggcctggatgatgcttctcctcgactccttgcttatggatcgagggagtggtacttcacaacgtcgttggtcggtacgacccgagggacncctagttccgttctacgtagtcgttcctacggngggacggacagtccaactcctctacgttggtcggtnttaggaacgtacgtacggcttaccgtagttcctagttaaggttaaccttacccgtaccctaacgtccgttacggtaaccaaaccgaaccgaccccgacggaccgacggtcccgaccgccgtaccaccgtcctactactacctaaaccaacctaaccaaacctactaccgtcctttaccgttccggtaccgggttcccctactaccgttccgttccgttccgttccgtccgtccctaccgtaccttaccggtaacgggtaaaaccctacgtaccgtaccgttacccttacgtacctaccggtacccggggtacccggggacccgtaggaaccgaacgtaagagttaacgtaacttcgttaagttaactttacgtatttacgttacttttaacgttaggttaaggttcgggtaacgttcgtacctttgttaccgtgttcccgggtttagttcgggtacgtaccgggtacggtcccgtaccggttccggtaaccgttcccggttcccggtaccgggtaaccgaccccggtaacccgggtacgttcccccggtaacccggtaccccgttccggttaaccccg

SEQ ID NO: 158198 - DNA, 591 bp, Homo sapiens
  misc_feature: GYAE6OF01EJMQS.13.10.A10.1.454.CMB.1.raw
  modified_base (130)..(130): a, c, t, g, unknown or other
  misc_feature (130)..(130): n is a, c, g, or t
  modified_base (216)..(216): a, c, t, g, unknown or other
  misc_feature (216)..(216): n is a, c, g, or t
  modified_base (224)..(224): a, c, t, g, unknown or other
  misc_feature (224)..(224): n is a, c, g, or t
  modified_base (257)..(257): a, c, t, g, unknown or other
  misc_feature (257)..(257): n is a, c, g, or t
  modified_base (298)..(298): a, c, t, g, unknown or other
  misc_feature (298)..(298): n is a, c, g, or t
  modified_base (313)..(313): a, c, t, g, unknown or other
  misc_feature (313)..(313): n is a, c, g, or t
  modified_base (338)..(338): a, c, t, g, unknown or other
  misc_feature (338)..(338): n is a, c, g, or t
  modified_base (407)..(407): a, c, t, g, unknown or other
  misc_feature (407)..(407): n is a, c, g, or t
  modified_base (473)..(473): a, c, t, g, unknown or other
  misc_feature (473)..(473): n is a, c, g, or t
tcagtcacgtactacacgaccggtgctcgatttagcgtcgatctcagggggggaagcctgggaacacttagccttcatgagtgtccccaccatggcctggatgatgcttctcctcggactccttgcttanggatcaggagtggattctcagactgtggtgacccgaggagccatcgttctcagtgtctcctgggacggacagtcacactcacttgnggcttganatacggctcagtctctagtacgttcctacccanctggtaccaacacgacccaggccaggctccgcgcacgctcntctacaacacaaacnctcgctcttcgtcgggtcctcatcncttctctgctcatcttaggaacaagtctacgtccttatcagtccggaccgggccaggctaaggagagtnaattgtgtactttagttacttgttgttttactttagtacgttgggttagtcgtacctttatttgtntacgttggttacggttcgggagggtcggacctcccggggtacttaccgggtcccgttcccgttcgggtacccaccggacccgtaacccggtcctcccggacccgttccggttacccgg

SEQ ID NO: 158199 - DNA, 536 bp, Homo sapiens
  misc_feature: GYAE6OF01A4G1H.13.10.A10.1.454.CMB.1.raw
  modified_base (408)..(408): a, c, t, g, unknown or other
  misc_feature (408)..(408): n is a, c, g, or t
  modified_base (420)..(420): a, c, t, g, unknown or other
  misc_feature (420)..(420): n is a, c, g, or t
  modified_base (423)..(423): a, c, t, g, unknown or other
  misc_feature (423)..(423): n is a, c, g, or t
tcagtcacgtactacacgaccggtgctcgatttagcgtcgatctcagggggggaagcctgggaacacttagccttcatgagtgtccccaccatggcctggatgatgcttctcctcggactccttgcttatggatcaggagtggattctcagactgtggtgacccaggagcccatcgttctcagtgtctcctgggagggacagtcacactcacttgtggcttgagatacggctcagtctctagtagttactaccccagctggtaccaacagaccccaggccaggctccgcgcacgctcatcacacacaaacactcgctcttctggggtccctcatcgcttctctcggctcccatccttgggaacaaagctgcccttatcatcgacggggcccaggcagaagatgaatcngacttattactnttnttctttagtatggtagtgtcctatttctgtcttgcgtttcggaggacggcgtacccggcgtcggacccggtccgacggtcacggccctaagggccctacgcccctagtcccgg

SEQ ID NO: 158200 - DNA, 885 bp, Homo sapiens
  misc_feature: GYAE6OF01BSKT7.13.10.A10.1.454.CMB.1.raw
  modified_base (130)..(130): a, c, t, g, unknown or other
  misc_feature (130)..(130): n is a, c, g, or t
tcagtcacgtactacacgaccggtgctcgatttagcgtcgatctcgagggggggaagcctgggaacacttagccttcatgagtgtccccacatggcctggatgatgcttctcctcggactccttgcttanggatcaggatggattctcagactggtggtcgacccaggacgccattcgttctactaggtcgtcctccgtagggagggactaggtccaactacgtctacgtttggtcggtcttagaacggtagttaccggcttcgaagttcttacgttaggttaacgttaacccgtacccctaggtacccgttacggtaaccaaaaccgtaccggtaaccccgtagggacccgtaacggcccgtcccggacggccctaccggtcctacaccttaccctaacgaaacctaaccgaaacctacctccgtactttccgttacggttccgggtaccctcgacgttccgtccttcgtccgtcggtcctaccacgttaccgtacggaaacacgtccgtacgtacccgtttatccgaacgttccccgggaaccgggggacccacgggtacgtaaacgaaacgtacgtaggtaacttacgttaagtttaactttaacgtttacggttacggttttagtttttaaccgttttaagtttacggggttacgtttaacggtaccggtttacccttttaacggttttccggtttacggttcgggtttaccgggtttacggggttacccgggggtacgggttaccggggtaccccggtacccccgggttaccggttaccccggttaaccccgggtttcgggtaccccgggttaacccgaccccgggttaaccccggtacgggtccccgttacccggttacccccggttcggttacccccg

SEQ ID NO: 158201 - DNA, 337 bp, Homo sapiens
  misc_feature: GYAE6OF01BOVL3.13.10.A10.1.454.CMB.1.raw
  modified_base (182)..(182): a, c, t, g, unknown or other
  misc_feature (182)..(182): n is a, c, g, or t
  modified_base (217)..(217): a, c, t, g, unknown or other
  misc_feature (217)..(217): n is a, c, g, or t
  modified_base (231)..(231): a, c, t, g, unknown or other
  misc_feature (231)..(231): n is a, c, g, or t
  modified_base (280)..(280): a, c, t, g, unknown or other
  misc_feature (280)..(280): n is a, c, g, or t
  modified_base (289)..(289): a, c, t, g, unknown or other
  misc_feature (289)..(289): n is a, c, g, or t
  modified_base (292)..(337): a, c, t, g, unknown or other
  misc_feature (292)..(337): n is a, c, g, or t
tcagtcacgtactacacgaccggtgctcgatttagcgtcgatctcagggatccctgagcgattctctggctccaactctgggaacacagccactctgaccatcagcggacccagcctatggatgaggctgactattactgtcatacatggaacagatatgatgctgtcggcggaggaccaangccgtctaggcacgaccaggctaccgcccctcgcncgtctccgttcccnccctctacgtacgtacgtcgacgttgacgggcggtgtcgggactacggngctagtagngcnnnnnnnnnnnnnnnnnnnnnnnnnnnnnnnnnnnnnnnnnnnnnn

SEQ ID NO: 158202 - DNA, 877 bp, Homo sapiens
  misc_feature: GYAE6OF01BW2HC.13.10.A10.1.454.CMB.1.raw
tcagtcacgtactacacgaccggtgctcgatttagcgtcgatctcgagggggggaagcctgggaacacttagccttcatgagtgtccccaccatggcctggatgatgcttctcctcggactccttgcttatggatcagggagtggattctcagactgtggtcgacccaggagccattcgttctctagtcgtctccgtgggagggacagtccacactcacgttggtggtcttgagtagtaccggctcgtagttccttacgtaaggttacgtttaaccctacccctaggtccgttacgggtaacccaaacgaaccggacccccgaacggtcccgaagggcccgtcccggccgacccgaccggcctaccgacttacctaaccaaacctaaaccaaaaccctaccgttaccgtaccctttcccgtttccggttcccggggttacccccttacgtaccgtttccggtcccttttccgttccggttccggtaccctttacccgtaacctttacccgggtttaacggggtaaaaacccgtaacgtcccgttaaccgttaccccctttaacgtaccctaacggtacccggggtaaccccgggggcccgaacgggtacgaaaggtaaacgtaacggtaacgtaacttcgtaagtttaactttaacgtttacgttcggttttacgttttacgtttattaagggttgggttaacgtcgttacccgtttacttttcgtcgttacgtttcggggttacggtaccggggtacggtacccgggtacccgtaacccggtaccggttacccggttaccccggttccgttacccggaccgtacccggtaaccccggtgggaccccgttcccggtaccccgtacgggttacccccg

SEQ ID NO: 158203 - DNA, 286 bp, Homo sapiens
  misc_feature: GYAE6OF02I17VT.13.10.A10.1.454.CMB.1.raw
  modified_base (283)..(286): a, c, t, g, unknown or other
  misc_feature (283)..(286): n is a, c, g, or t
tcagtcacgtactacacgaccggtgctcgatttagcgtcgatctcagggatccctgagcgattctctggctccaactctgggaacacagccactctgaccatcagcgggacccagcctatggatgaggctgactattactgtcatacatgggacaacgatattggatggctgttcggcggagggaccaaactgaccgtcctaggtcagcccaaggctgccccctggtcactctgttcccgcctcctctagtacgtgactgagcgggctggcaaggcgcatagnnnn

SEQ ID NO: 158204 - DNA, 202 bp, Homo sapiens
  misc_feature: GYAE6OF02G0WAC.13.10.A10.1.454.CMB.1.raw
  modified_base (200)..(202): a, c, t, g, unknown or other
  misc_feature (200)..(202): n is a, c, g, or t
tcagtcacgtactacacgaccggtgctcgatttagcgtcgatctcagggtccgggagatcatgagggtgtccttgggtttgggggaagaggaagactgacggtcccccaggagttcaggtgctgggcacagcggccctgggctgcctggtcaaggactacttcctagtacgtgactgagcgggctggcaaggcgcatagnnn

SEQ ID NO: 158205 - DNA, 205 bp, Homo sapiens
  misc_feature: GYAE6OF02JQHEQ.13.10.A10.1.454.CMB.1.raw
  modified_base (200)..(205): a, c, t, g, unknown or other
  misc_feature (200)..(205): n is a, c, g, or t
tcagtcacgtactacacgaccggtgctcgatttagcgtcgatctcagggtccgggagatcatgagggtgtccttgggtttgggggaagaggaagactgacggtcccccaggagttcaggtgctgggcacagcggccctgggctgcctggtcaaggactacttcctagtacgtgactgagcgggctggcaaggcgcatagnnnnnn

SEQ ID NO: 158206 - DNA, 199 bp, Homo sapiens
  misc_feature: GYAE6OF02HN8HH.13.10.A10.1.454.CMB.1.raw
  modified_base (198)..(199): a, c, t, g, unknown or other
  misc_feature (198)..(199): n is a, c, g, or t
tcagtcacgtactacacgaccggtgctcgatttagcgtcgatctcagggtccgggagatcatgagggtgtccttgggtttggggaagaggaagactgacggtccccaggagttcaggtgctgggcacagcggccctgggctgcctggtcaaggactacttcctagtacgtgactgagcgggctggcaaggcgcatagnn

SEQ ID NO: 158207 - DNA, 287 bp, Homo sapiens
  misc_feature: GYAE6OF02HPMT3.13.10.A10.1.454.CMB.1.raw
  modified_base (285)..(287): a, c, t, g, unknown or other
  misc_feature (285)..(287): n is a, c, g, or t
tcagtcacgtactacacgaccggtgctcgatttagcgtcgatctcagggatccctgagcgattctctggctccaactctgggaaacagccactctgaccatcagcgggacccagcctatggatgaggctgactattactgtcatacatgggacaacgatattggatggctgttcggcggagggaccaaactgaccgtcctaggtcagcccaaggctgccccctcggtcactctgttccccgccctcctctagtaagtgactgagcgggctggcaaggcgcatagnnn

SEQ ID NO: 158208 - DNA, 202 bp, Homo sapiens
  misc_feature: GYAE6OF02H4YQ2.13.10.A10.1.454.CMB.1.raw
  modified_base (201)..(202): a, c, t, g, unknown or other
  misc_feature (201)..(202): n is a, c, g, or t
tcagtcacgtactacacgaccggtgctcgatttagcgtcgatctcagggtccgggagatcatgagggtgtccttgggtttgggggaagaggaagactgaccggtcccccaggagttcaggtgctgggcacagcggccctgggctgcctggtcaaggactacttcctagtacgtgactgagcgggctggcaaggcgcatagnn

SEQ ID NO: 158209 - DNA, 291 bp, Homo sapiens
  misc_feature: GYAE6OF02GQJ4I.13.10.A10.1.454.CMB.1.raw
  modified_base (288)..(291): a, c, t, g, unknown or other
  misc_feature (288)..(291): n is a, c, g, or t
tcagtcacgtactacacgaccggtgctcgatttagcgtcgatctcagggatccctgagtgattctctggctccaactctgggaactcagccactctgaccatcagcgggacccaggctatggatgaggctgactattactgtcaggcgtgggacagcagcactgcccgctatgtcttcggaactgggaccaaggtcaccgtcctaagtcagcccaaggccaaccccactgtcactctgttcccaccctcctctagtacgtgactgagcgggctggcaaggcgcatagnnnn

SEQ ID NO: 158210 - DNA, 286 bp, Homo sapiens
  misc_feature: GYAE6OF02HSH6J.13.10.A10.1.454.CMB.1.raw
  modified_base (284)..(286): a, c, t, g, unknown or other
  misc_feature (284)..(286): n is a, c, g, or t
tcagtcacgtactacacgaccggtgctcgatttagcgtcgatctcagggatccctgagcgattctctggctccaactctgggaacacagccactctgaccatcagcgggacccagcctatggatgaggctgactattactgtcatacatgggacaacgatattggatggctgttcggcggagggaccaaactgaccgtctaggtcagcccaaggctgccccctggtcactctcgttcccaccctcctctagtacgtgactgagcgggctggcaaggcgcatagnnn

SEQ ID NO: 158211 - DNA, 294 bp, Homo sapiens
  misc_feature: GYAE6OF02GW45T.13.10.A10.1.454.CMB.1.raw
  modified_base (291)..(294): a, c, t, g, unknown or other
  misc_feature (291)..(294): n is a, c, g, or t
tcagtcacgtactacacgaccggtgctcgatttagcgtcgatctcagggatccctgagcgattctctggctccaactctgggaactcagccactctgaccatcagcgggacccaggctatggatgaggctgactattactgtcaggcgtgggacagcagcactgcccgctatgtcttcggaactgggaccaaggtcaccgtcctaagtcagcccaaggcccaaccccactcgtcactctgttcccgccctcctctagtaccgtgactgagcgggctggcaaggcgcatagnnnn

SEQ ID NO: 158212 - DNA, 203 bp, Homo sapiens
  misc_feature: GYAE6OF02H2MSQ.13.10.A10.1.454.CMB.1.raw
  modified_base (201)..(203): a, c, t, g, unknown or other
  misc_feature (201)..(203): n is a, c, g, or t
tcagtcacgtactacacgaccggtgctcgatttagcgtcgatctcagggtccgggagatcatgagggtgtccttgggttttgggggaagaggaagactgacggtcccccaggagttcaggtgctgggcacagcggccctgggctgcctggtcaaggactacttcctagtacgtgactgagcgggctggcaaggcgcatagnnn

SEQ ID NO: 158213 - DNA, 287 bp, Homo sapiens
  misc_feature: GYAE6OF02FLEB3.13.10.A10.1.454.CMB.1.raw
  modified_base (285)..(287): a, c, t, g, unknown or other
  misc_feature (285)..(287): n is a, c, g, or t
tcagtcacgtactacacgaccggtgctcgatttagcgtcgatctcagggatccctgagcgattctctggctccaactctgggaacacagccactctgaccatcagcgggacccagcctatggatgaggctgactattactgtcatacatgggacaacgatattggatggctgttcggcggagggaccaaactgaccgtcctaggtcagcccaaggctgccccctcggtcactctgttcccgccctcctctagtacgtgactgagcgggctggcaaggcgcatagnnn

SEQ ID NO: 158214 - DNA, 285 bp, Homo sapiens
  misc_feature: GYAE6OF02FF8W7.13.10.A10.1.454.CMB.1.raw
  modified_base (284)..(285): a, c, t, g, unknown or other
  misc_feature (284)..(285): n is a, c, g, or t
tcagtcacgtactacacgaccggtgctcgatttagcgtcgatctcagggatccctgagcgattctctggctccaactctgggaacacagccactctgaccatcagcgggacccagcctatggatgaggctgactattactgtcatacatgggacaacgatattggatggctgttcggcggagggaccaaactgaccgtcctaggtcagcccaaggctgccccctcggtcactctgttcccgccctccctagtacgtgactgagcgggctggcaaggcgcatagnn

SEQ ID NO: 158215 - DNA, 247 bp, Homo sapiens; identical to SEQ ID NO: 158171
  misc_feature: GYAE6OF02GQW45.13.10.A10.1.454.CMB.1.raw
  modified_base (245)..(247): a, c, t, g, unknown or other
  misc_feature (245)..(247): n is a, c, g, or t

SEQ ID NO: 158216 - DNA, 528 bp, Homo sapiens
  misc_feature: GYAE6OF02H7C8E.13.10.A10.1.454.CMB.1.raw
  modified_base (236)..(236): a, c, t, g, unknown or other
  misc_feature (236)..(236): n is a, c, g, or t
  modified_base (266)..(266): a, c, t, g, unknown or other
  misc_feature (266)..(266): n is a, c, g, or t
  modified_base (480)..(480): a, c, t, g, unknown or other
  misc_feature (480)..(480): n is a, c, g, or t
tcagtcacgtactacacgaccggtgctcgatttagcgtcgatctcagggggggaagcctgggaacacttagccttcatgagtgtcccaccatggcctggatgatgcttctcctcggactccttgcttatggatcaggagtggattctcagactgtggtgacccaggagccatcgttctcagtgtctcctggagggacagtcacactcacttgtggcttgagatacggctcagtctntagtagttacctaccccagctggtaccaanagaccccaggccaggctccgcgcacgctcatctacaacacaaacactcgctcttctcggggtccctcatcgctttctctggctccatccttgggaacaaagctgccttatcatcgaccggggcccaggcagaagatgaatctagatttattactgttgtttcttaatagttgggtagtgcctatttctgtctgtgttggaggagccgtacccgntacgtccgtcccgttcgtcacgcccaaggcctacgccccgagtcccgg

SEQ ID NO: 158217 - DNA, 286 bp, Homo sapiens
  misc_feature: GYAE6OF02IDW3E.13.10.A10.1.454.CMB.1.raw
  modified_base (284)..(286): a, c, t, g, unknown or other
  misc_feature (284)..(286): n is a, c, g, or t
tcagtcacgtactacacgaccggtgctcgatttagcgtcgatctcagggatccctgagcgattctctggctccaactctgggaacacagccactctgaccatcagcgggacccagcctatggatgaggctgactattactgtcatacatgggacaacgatattggatggctgttcggcggagggaccaaactgaccgtcctaggtcagcccaaggctgccccctggtcactctgttccccacctcctctagtacgtgactgagcgggctggcaaggcgcatagnnn

SEQ ID NO: 158218 - DNA, 205 bp, Homo sapiens
  misc_feature: GYAE6OF02GMBK2.13.10.A10.1.454.CMB.1.raw
  modified_base (202)..(205): a, c, t, g, unknown or other
  misc_feature (202)..(205): n is a, c, g, or t
tcagtcacgtactacacgaccggtgctcgatttagcgtcgatctcagggtccgggagatcatgagggtgtccttgggttttgggggaagaggaagactgacggtcccccaggagttcaggtgctgggcacagcggccctgggctgcctggtcaaggactacttcctagtacgtgactgagcgggctggcggaagcgcatagnnnn

SEQ ID NO: 158219 - DNA, 534 bp, Homo sapiens
  misc_feature: GYAE6OF02H4X92.13.10.A10.1.454.CMB.1.raw
tcagtcacgtactacacgaccggtgctcgatttagcgtcgatctcagggggggaagcctgggaacacttagccttcatgagtgtccccaccatggcctggatgatgcttctcctcggactccttgcttatggatcaggagtggattctcagactgtggtgacccaggagccatcgttctcagtgtctcctggagggacagtcacactcacttgtggcttgagatacggctcagtctctagtagttacctaccccagctggtaccaacagaccccaggccaggctccgcgcacgctcatctacaacacaaacactcgctcttctcggggtccctcatcgcttctctggctccatccttgggaacaaagctgccctttatcatcgacgggggccccaggccagaagatgaatctgtatttattacttgttgtttctttatagttgggttagtgtcctatttctgtctgtgttcggaggaggccaccggctcggaccgtccgtcgtcgacggcccaacggcctcgccccagtcccgg

SEQ ID NO: 158220 - DNA, 270 bp, Homo sapiens
  misc_feature: GYAE6OF02GIX8K.13.10.A10.1.454.CMB.1.raw
  modified_base (248)..(270): a, c, t, g, unknown or other
  misc_feature (248)..(270): n is a, c, g, or t
tcagtcacgtactacacgaccggtgctcgatttagcgtcgatctcagggtcttcgtggctcacgtccaccaccacgcatgtgacctcagggtccgggagatcatgagggtgtccttggttttgggggaagaggaagactgacggtcccccaggagttcgaggtgctgggcgtacagcggccctgggtctgcctggtcaaggactacttcctagtacgtgactgagcggggctggcaaggcgcgatagnnnnnnnnnnnnnnnnnnnnnnn

SEQ ID NO: 158221 - DNA, 517 bp, Homo sapiens
  misc_feature: GYAE6OF02I2QKO.13.10.A10.1.454.CMB.1.raw
tcagtcacgtactacacgaccggtgctcgatttagcgtcgatctcaggggggaagcctgggaacacttagccttcatgagtgtccccaccatggcctggatgatgcttctcctcggactccttgcttatggatcaggagtggattctcagactgtggtgacccaggagccatcgttctcagtgtctcctggagggacagtcacactcacttgtggcttgagatacggctcagtctctagtagttactaccccagctggtaccaacagacccaggccaggctccgcgcacgctcatctacaacacaaacactcgctcttctggggtccctcatcgcttctctgctcatcctggaacaagctgccttatcatcgacggggcccaggcagaagatgaatctagtattattactgttgtttactttattattgggttagtgctatttctgtctgttgttcggtgggagcacccgggctcggaccgtccgtcggtcgacgcccgaggctcggccctatccgg

SEQ ID NO: 158222 - DNA, 292 bp, Homo sapiens
  misc_feature: GYAE6OF02H7V3J.13.10.A10.1.454.CMB.1.raw
  modified_base (225)..(225): a, c, t, g, unknown or other
  misc_feature (225)..(225): n is a, c, g, or t
  modified_base (286)..(292): a, c, t, g, unknown or other
  misc_feature (286)..(292): n is a, c, g, or t
tcagtcacgtactacacgaccggtgctcgatttagcgtcgatctcagggatccctgagcgattctctggctccaactctgggaacacagccactctgaccatcagcgggacccaggctatggatgaggctgactattactgtcaggcgtgggacagcagcactgcccgctatgtcttcggaactgggaccaaggtcaccgtctaagtcagccaaggccaaccccntgtcactctcgttcccaccctctctagtaccgtgactgagcgggctggcaaggcgcatagnnnnnnn

SEQ ID NO: 158223 - DNA, 285 bp, Homo sapiens
  misc_feature: GYAE6OF02FG420.13.10.A10.1.454.CMB.1.raw
  modified_base (285)..(285): a, c, t, g, unknown or other
  misc_feature (285)..(285): n is a, c, g, or t
tcagtcacgtactacacgaccggtgctcgatttagcgtcgatctcagggatccctgagcgattctctggctccaactctgggaacacagccactctgaccatcagcgggacccagcctatggatgaggctgactattactgtcatacatgggacaacgatattggatggctgttcggcggagggaccaaactgaccgtcctaggtcagcccaaggctgccccctcggtcactctgttcccgccctcctctagtacgtgactgagcgggctggcaaggcgcatagn

SEQ ID NO: 158224 - DNA, 205 bp, Homo sapiens
  misc_feature: GYAE6OF02IWAXL.13.10.A10.1.454.CMB.1.raw
  modified_base (203)..(205): a, c, t, g, unknown or other
  misc_feature (203)..(205): n is a, c, g, or t
tcagtcacgtactacacgaccggtgctcgatttagcgtcgatctcaggggtccgggagatcatgagggtgtccttgggttttggggggaagaggaagactgacggtcccccaggagttcaggtgctgggcacagcggccctgggctgcctggtcaaggactacttcctagtacgtgactgagcgggctggcaaggcgcatagnnn

SEQ ID NO: 158225 - DNA, 203 bp, Homo sapiens
  misc_feature: GYAE6OF02IVITU.13.10.A10.1.454.CMB.1.raw
  modified_base (200)..(203): a, c, t, g, unknown or other
  misc_feature (200)..(203): n is a, c, g, or t
tcagtcacgtactacacgaccggtgctcgatttagcgtcgatctcagggtccgggagatcatgagggtgtccttgggtttgggggaagaggaagactgacggtcccccaggagttcaggtgctgggcacagcggccctgggctgcctggtcaaggactacttcctagtacgtgactgagcgggctggcaaggcgcatagnnnn

SEQ ID NO: 158226 - DNA, 550 bp, Homo sapiens
  misc_feature: GYAE6OF02G6Y9G.13.10.A10.1.454.CMB.1.raw
  modified_base (436)..(436): a, c, t, g, unknown or other
  misc_feature (436)..(436): n is a, c, g, or t
  modified_base (543)..(543): a, c, t, g, unknown or other
  misc_feature (543)..(543): n is a, c, g, or t
tcagtcacgtactacacgaccggtgctcgatttagcgtcgatctcaggggggaagcctgggaacacttagccttcatgagtgtccccaccatggcctggatgatgcttctcctcggactccttgcttatggatcaggagtggattctcagactgtggtgacccaggagccatcgttctcagtgtctcctggagggacagtcacactcacttgtggcttgagatacggctcagtctctagtagttactaccccagctggtaccaacagaccccaggccaggctccgcgcacgctcatctacaacacaaacactcgctcttctggggtccctcatccgcttcctctcggctcccatccgttagggaacaaaggctcgtccctttatccatcgaccgggggccccagggcagaagatagaatctgatttattactgttntttctttatagttgggtagttgcctatttcttgtcgttgtggttcgggaggacggccgacccgggctccggaccgtccgtccggtcacgcccgaaggctccgccccngtcccgg

SEQ ID NO: 158227 - DNA, 555 bp, Homo sapiens
  misc_feature: GYAE6OF02HLRRP.13.10.A10.1.454.CMB.1.raw
  modified_base (428)..(428): a, c, t, g, unknown or other
  misc_feature (428)..(428): n is a, c, g, or t
tcagtcacgtactacacgaccggtgctcgatttagcgtcgatctcagggggggaagcctgggaacacttagccttcatgagtgtccccaccatggcctggatgatgcttctcctcggactccttgcttatggatcaggagtggattctcagactgtggtgacccaggagccatcgttctcagtgtctcctggagggacagtcacactcacttgtggcttgagatacggctcagtctctagtacgttacctaccccagctggtaccaacagaccccaggccaggctccgcgcacgctcatctacaacacaaacactcgctcttctggggtccctcatccgcttctctcggctccatccttggaacaaagctcgccttatcatcgacggggcccaggcagagatgaatctagattattacttgttgtttntttagttatgggttagtgtcctattttctgtcttggttgttcgggaggacgggccgaccccgggtctcggtacccgtcccgtccgggtaccacgccccggaaggcccgtcggccccctagtcccggg

SEQ ID NO: 158228 - DNA, 581 bp, Homo sapiens
  misc_feature: GYAE6OF02HBUAZ.13.10.A10.1.454.CMB.1.raw
tcagtcacgtactacacgaccggtgctcgatttagcgtcgatctcagggggggaagcctgggaacacttagccttcatgagtgtccccaccatggcctggatgatgcttctcctcggactccttgcttatggatcaggagtggattctcagactgtggtgacccaggagccatcgttctcagtgtctcctggaggacagtcacactcacttgtggcttgagatacggctcagtctctagtagttacctaccccagctcggtaccaacacgaccccaggccaggctccgcgcacgctcatctacaacacaaacactcgctctcgtcgggtccctcatcgcttctcgtcgctcctactccgttagggaaacaaacgtctacgtccctttaatcactccgaccgggggtcccaggaccgaagaagactagaactctagtatttacttacgtgttagttttacttattagttgggtagttcgaccttatttctgtcttggttgttcgggaggcggccgacccggtcgtacgacccggttccgtccggtacaccggcccgaacggtcctccgccccgtagtcccgg

SEQ ID NO: 158229 - DNA, 549 bp, Homo sapiens
  misc_feature: GYAE6OF02HO2HL.13.10.A10.1.454.CMB.1.raw
  modified_base (424)..(424): a, c, t, g, unknown or other
  misc_feature (424)..(424): n is a, c, g, or t
tcagtcacgtactacacgaccggtgctcgatttagcgtcgatctcagggggggaagcctgggaacacttagccttcatgagtgtccccaccatggcctggatgatgcttctcctcggactccttgcttatggatcaggagtggattctcagactgtggtgacccaggagccatcgttctcagtgtctcctggagggacagtcacactcacttgtggcttgagatacggctcagtctctagtagttacctaccccagctggtaccaacagaccccagccaggctccgcgcacgctcatctacaacacaaacactcgctctctcggggtccctcatcgcttctctggcctcatccgttggaacaaagctgcccttatcatccgacggggcccaggcgagaagatgaatctgtatttattcttgttnttctttatagtgggtagtgcctatttctgtcgttgtggttcggagggacggccgacccggtactccggacccgtccgttaccggtccgtacggccccaaggtccgtaccggcccctagttcccgg

SEQ ID NO: 158230 - DNA, 518 bp, Homo sapiens
  misc_feature: GYAE6OF02F2MD2.13.10.A10.1.454.CMB.1.raw
  modified_base (461)..(461): a, c, t, g, unknown or other
  misc_feature (461)..(461): n is a, c, g, or t
tcagtcacgtactacacgaccggtgctcgatttagcgtcgatctcagggggggaagcctgggaacacttagccttcatgagtgtccccaccatggcctggatgatgcttctcctcggactccttgcttatggatcaggagtggattctcagactgtggtgacccaggagccatcgttctcagtgtctcctggagggacagtcacactcacttgtggcttgagatacggctcagtctctagtagttactaccccagctggtaccaacagaccccaggccaggctccgcgcacgctcatctacaacacaaacactcgctcttctggggtccctcatcgcttctctggctccatcctgggaacaaagctgcccttatcatcgacggggcccaggcagaagatgaatctgattattactgttgttctttatattgggtagtcgtctatttctgctgtgtcgaggngcgaccggctcggaccgtcctacggtcacgcccgaaggcctcgccccgtcgtacccg

SEQ ID NO: 158231 - DNA, 536 bp, Homo sapiens
  misc_feature: GYAE6OF02FUGD7.13.10.A10.1.454.CMB.1.raw
  modified_base (379)..(379): a, c, t, g, unknown or other
  misc_feature (379)..(379): n is a, c, g, or t
  modified_base (402)..(402): a, c, t, g, unknown or other
  misc_feature (402)..(402): n is a, c, g, or t
tcagtcacgtactacacgaccggtgctcgatttagcgtcgatctcagggggggaagcctgggaacacttagccttcatgagtgtccccaccatggcctggatgatgcttctcctcggactccttgcttatggatcaggagtggattctcagactgtggtgacccaggagccatcgttctcagtgtctcctggagggacagtcacactcacttgtggcttgagatacggctcagtctctagtagttacctaccccagctggtaccaacagaccccaggccaggctccgcgcacgctcatctacaacacaaacactcgctcttctcggggtccctcatcgcttctctggtctccactccttgggaacaaagctgcccttancatcgacggggcccaggcagaanatgaatctagattattactgtgttctttatagtggtagtgcctatttctgtctagttggttcggaggtaggccgacccggctcggacccggttccgtcgtaccgacgcccgacggcctacgcccctagtcccgg

SEQ ID NO: 158232 - DNA, 614 bp, Homo sapiens
  misc_feature: GYAE6OF02IHHAK.13.10.A10.1.454.CMB.1.raw
  modified_base (309)..(309): a, c, t, g, unknown or other
  misc_feature (309)..(309): n is a, c, g, or t
  modified_base (330)..(330): a, c, t, g, unknown or other
  misc_feature (330)..(330): n is a, c, g, or t
tcagtcacgtactacacgaccggtgctcgatttagcgtcgatctcagggggggaagcctgggaacacttagccttcatgagtgtccccaccatggcctggatgatgcttctcctcggactccttgcttatggatcaggagtggattctcagactgtggtgacccaggagccatcgttctcagtgtctcgtggagggacagtcacactcacttgtggcttgagatacggctcagtctgtagtacgttacctacccagctggtaccaacacgacccaggccaggcctcgcgcacgctcatcacacacaacnctcgctcttcgtcgggtcctnactcgcttctcgtggctcacgtccgtaggaacaaacggctcgtaccttatcacgtcggaccggggaccaggtcgagaagatagactcgtagtactttattctgtttgtttacttagtacgttagggtacgttcgtaccttagttcgtacgtcgttacggttggttaccgggaggtacgggtaccgtcccgggtacgttacccggacccggtttcccgtacccggttaccgacccggttacccggtaaccgggtccgtaccccggtaccccgtacggttacccgg

SEQ ID NO: 158233 - DNA, 296 bp, Homo sapiens
  misc_feature: GYAE6OF02F8NAK.13.10.A10.1.454.CMB.1.raw
  modified_base (290)..(296): a, c, t, g, unknown or other
  misc_feature (290)..(296): n is a, c, g, or t
tcagtcacgtactacacgaccggtgctcgatttagcgtcgatctcagggatccctgagcgattctctggctccaactctgggaacacagccactctgaccatcagcgggacccaggctatggatgaggctgactattactgtcaggcgtgggacagcagcactgcccgctatgtcttcggaactgggaccaaggtcaccgtcctaagtcagcccaaggcccaaccccatgtcactctcgttccccaccctcctctagtacgtgactgagcgggctggcaaggcgcatagnnnnnnn

SEQ ID NO: 158234 - DNA, 213 bp, Homo sapiens
  misc_feature: GYAE6OF02HQV9X.13.10.A10.1.454.CMB.1.raw
  modified_base (204)..(213): a, c, t, g, unknown or other
  misc_feature (204)..(213): n is a, c, g, or t
tcagtcacgtactacacgaccggtgctcgatttagcgtcgatctcaggggtccgggagatcatgagggtgtccttgggttttgggggaagaggaagactgaccggtccccccaggagttcaggtgctgggcacagcggccctgggctgcctggtcaaggactacttcctagtacgtgactgagcgggctggcaaggcgcatagnnnnnnnnnn

SEQ ID NO: 158235 - DNA, 289 bp, Homo sapiens
  misc_feature: GYAE6OF02F4IVI.13.10.A10.1.454.CMB.1.raw
  modified_base (286)..(289): a, c, t, g, unknown or other
  misc_feature (286)..(289): n is a, c, g, or t
tcagtcacgtactacacgaccggtgctcgatttagcgtcgatctcagggatccctgagcgattctctggctccaactctgggaacacagccactctgaccatcagcgggacccagcctatggatgaggctgactattactgtcatacatgggacaacgatattggatggctgttcggcggagggaccaaactgaccgtcctaggtcagcccaaggctgccccctggtcacctctgttccccaccctcctctagtacgtgactgagcgggctggcaaggcgcatagnnnn

SEQ ID NO: 158236 - DNA, 561 bp, Homo sapiens
  misc_feature: GYAE6OF02I3FED.13.10.A10.1.454.CMB.1.raw
  modified_base (367)..(367): a, c, t, g, unknown or other
  misc_feature (367)..(367): n is a, c, g, or t
  modified_base (374)..(374): a, c, t, g, unknown or other
  misc_feature (374)..(374): n is a, c, g, or t
  modified_base (398)..(398): a, c, t, g, unknown or other
  misc_feature (398)..(398): n is a, c, g, or t
  modified_base (422)..(422): a, c, t, g, unknown or other
  misc_feature (422)..(422): n is a, c, g, or t
tcagtcacgtactacacgaccggtgctcgatttagcgtcgatctcagggggggaagcctgggaacacttagccttcatgagtgtccccaccatggcctggatgatgcttctcctcggactccttgcttatggatcaggagtggattctcagactgtggtgacccaggagccatcgttctcagtgtctccgtggaggacagtcacactcacttgtgcttgagatacggctcagtctctagtacgttactaccccagctggtaccaacacgacccaggccaggctccgcgcacgctcatctacaacacaaacactcgctcttctgggtccctcatcgcttctctgctccatccttaggaacaagctacncctttancatcgaccggggccaggcagacgntagatcgtagtattattactgttnttactttatagtgggtactgcctattttcagtcgttgtacgtttcgggaggtacggcctacccgggtctccggtaaccgttcccgtaccgggtcctaccggacccggtaacggtccgtccgtaccccgtagttccccgg

SEQ ID NO: 158237 - DNA, 659 bp, Homo sapiens
  misc_feature: GYAE6OF02HJE7O.13.10.A10.1.454.CMB.1.raw
  modified_base (226)..(226): a, c, t, g, unknown or other
  misc_feature (226)..(226): n is a, c, g, or t
tcagtcacgtactacacgaccggtgctcgatttagcgtcgatctcagggggggaagcctgggaacacttagccttcatgagtgtccccaccatggcctggatgatgcttctcctcggactccttgcttatggatcaggagtggattctcagacttggtggtgacccagggagccattccgttctcagtgtctcctgggaggacagtcacactcattgtggcttganagtacggctcgagttctactagtacttacctaccccagctggtaaccaacgacgacccccaggccaggcctccgcgcacgctcatctacaacacaacactcgctcttcgtcgggtcctcatcgtcttctcgtgcctctactccgttaggaacaagtctaccgtaccttagtccacgtcgggacccggggtacccagggacgaacggtaagaacgtacgtaacgttaccgtagttaactttactttacgttaggtttacgtttacttttaagtaggttacggggttaattccgtaccgttgttttactcgggttcttggttacgggttcgggtaagggcggtacccgtacccggggtcttaccggtacccggttccgtaccggtaccgaccggtacccgaacggtcccgttacggaccccgttcggttacccgg

SEQ ID NO: 158238 - DNA, 640 bp, Homo sapiens
  misc_feature: GYAE6OF02GP271.13.10.A10.1.454.CMB.1.raw
  modified_base (232)..(232): a, c, t, g, unknown or other
  misc_feature (232)..(232): n is a, c, g, or t
  modified_base (299)..(299): a, c, t, g, unknown or other
  misc_feature (299)..(299): n is a, c, g, or t
tcagtcacgtactacacgaccggtgctcgatttagcgtcgatctcagggggggaagcctgggaacacttagccttcatgagtgtccccaccatggcctggatgatgcttctcctcggactccttgcttatggatcaggagtggattctcagactgtggtgacccaggagccatcgttctcagtgtctccgtggagggacagtcacactcacttgtggcttgagatacggctnagtctctagtagttacctacccagctggtaccaacacgaccccgaggaccaggcctccgcgcacgcncactctacaacacaaacactcgctcttcgtcgggtccctcactctctctctcgctcacttccgtagaacaacgctacgtccttatacactcggccggggaccaggacgaagaagatagaacttctcgttaattacgtttactgtttcgtttactttataggtttcgggttagttcgtaccttacgtttcgttacgtaccggttggttcggtacgggggacgtacgggacccgttaccggggaccgttccggtaccccggttcccggttaccgggtaccggtaacccggtaccccggtaaacgggtcccccgttacggacccccccttagggttaaccccgg

SEQ ID NO: 158239 - DNA, 207 bp, Homo sapiens
  misc_feature: GYAE6OF02GLPUX.13.10.A10.1.454.CMB.1.raw
  modified_base (202)..(207): a, c, t, g, unknown or other
  misc_feature (202)..(207): n is a, c, g, or t
tcagtcacgtactacacgaccggtgctcgatttagcgtcgatctcaggggtccgggagatcatgagggtgtccttgggttttgggggaagaggaagactgacggtcccccaggagttcaggtgctgggcacagcggccctgggctgcctggtcaaggactacttcctagtacgtgactgagcgggctggcaaggcgcatagnnnnnn

SEQ ID NO: 158240 - DNA, 670 bp, Homo sapiens
  misc_feature: GYAE6OF02GY85L.13.10.A10.1.454.CMB.1.raw
tcagtcacgtactacacgaccggtgctcgatttagcgtcgatctcagggggggaagcctgggaacacttagccttcatgagtgtccccaccatggcctggatgatgcttctcctcggactccttgcttatggatcaggagtggattctcagactgtggtgacccaggagccattcgttctcagtgtctcctgggagggacagtcacactcacttgtggctttagagtatacggctcagttctactagtacgttacctaccccagctggtaccaacacgaccccaggccaggctccgcgcacgctcatctacaacacaaacactcgctcttcgtcggggtccctcactcgtcttcctctcggtctccgacttccgttagggaactaaagtctccgtaccctttactcgaactccggaccgggggccccagggacgaaggaaagtacgtagtaaacgtcgtaggtaattttatttacgttcgttagttttacctttaagtttaggtacggggtttagtcgtacccgtttagttttcgtgttcggttgttgggttaccgggtagggtaccgggtccgaccccgggttacgtccggtaccccgtcccggttaccggttccgtaacccggcccgggtaacggtacccgtcccggtaccccgtacgttaccccggg

SEQ ID NO: 158241 - DNA, 330 bp, Homo sapiens
  misc_feature: GYAE6OF02H7EDY.13.10.A10.1.454.CMB.1.raw
  modified_base (88)..(88): a, c, t, g, unknown or other
  misc_feature (88)..(88): n is a, c, g, or t
  modified_base (250)..(250): a, c, t, g, unknown or other
  misc_feature (250)..(250): n is a, c, g, or t
  modified_base (284)..(284): a, c, t, g, unknown or other
  misc_feature (284)..(284): n is a, c, g, or t
  modified_base (320)..(330): a, c, t, g, unknown or other
  misc_feature (320)..(330): n is a, c, g, or t
tcagtcacgtactacacgaccggtgctcgatttagcgtcgatctcagggatccctgagcgattctctggctccaactctgggaacacngccactctgaccatcaggccgggacccaggctagtggatggaggtctgacttattactgtcgaggcggtgggacagcagcactcgcccgctagtgtcgttacggaacgtcgggaacctaaggtccaccgttacctaagtcacgacccaacggcccaaccccntgtccacctcttccgtcccaccctctctagtcgngactgacggcgggctagggcaaggccactaagtagnnnnnnnnnnn

SEQ ID NO: 158242 - DNA, 736 bp, Homo sapiens
  misc_feature: GYAE6OF02H47SK.13.10.A10.1.454.CMB.1.raw
  modified_base (149)..(149): a, c, t, g, unknown or other
  misc_feature (149)..(149): n is a, c, g, or t
tcagtcacgtactacacgaccggtgctcgatttagcgtcgatctcagggggggaagcctgggaacacttagccttcatgagtgtccccaccatggcctggatgatgcttctcctcggactccttgcttatggatcaggagtggattctnagactgtggtcgacccgagggacgccatcgttctcgagtcgtctccgtgggacggacagtcacactcacttgtggtcttggagataccgggctcgagttcctactagttacgttacctaccccagcctggtaccaacacgaccccagccaggcctccgcgcacgctcactctaaccaacaacaaacactccgctcttcgtcggggtccctcactcgccttctcgtcggcctcctacgttccttagggaaacaaacgtctccgtacctttactacgtacgtccggaccggggaccccgaagggaccgaacggaaagtacgtaaggtaacgttacgttaaggttacttttaaacgtttacgtttacggttttcgtttaacttttaagtttaacggttaggggtttacggttacgtaccgtttcgttttaacgttcggttcggttggtttcgggttacggggtacggtaccggggtacccgtaaccccggggtcgttaacccgtcccgggtttcccggttacccggttacccgggtaccgtaccccgggtaccggtcccgtaccggtacccccgtaggtttacccccggg

SEQ ID NO: 158243 - DNA, 748 bp, Homo sapiens
  misc_feature: GYAE6OF02H88PZ.13.10.A10.1.454.CMB.1.raw
  modified_base (171)..(171): a, c, t, g, unknown or other
  misc_feature (171)..(171): n is a, c, g, or t
  modified_base (223)..(223): a, c, t, g, unknown or other
  misc_feature (223)..(223): n is a, c, g, or t
tcagtcacgtactacacgaccggtgctcgatttagcgtcgatctcagggggggaagcctgggaacacttagccttcatgagtgtccccaccatggcctggatgatgcttctcctcggactccttgcttatggatcagggatggattctcagactggtggtgacccaggacnccattcgttctcagtgtctccgtagggagggactagtcacactcactttggnggtcttggagagtaccggctcaggttcctcttagtacgtttaccctaccccagctcggtaaccaacacgaccccaggcccaggcctccgcgcaccgctcatctaacaacacaaaccactcgactcttcgtcgggtccctctctcgtctctcgtcgcctcacttccgttagggaactaaacgtctacgtccctttatcagttccggaccggggacccgtaaggccgtaaggaagacgtaacgtacgtacgttacgttaattttaacttaagtttcgtttagttttaccgtttaagtttacggttaggggttacggttccgttaaccttaacggttttccgttcgttccggtttagggttacggggttttacggggtacggggtaccggggtcccggtaaccccgggttcggttaaaccccgggttccccgttacccggtttaccccggtaacccgggaccccggttaccccggaaaccggggtcccgttaccccggtaccccgggttaaccggttaccccccgggg

SEQ ID NO: 158244 - DNA, 653 bp, Homo sapiens
  misc_feature: GYAE6OF02FK8NM.13.10.A10.1.454.CMB.1.raw
  modified_base (393)..(393): a, c, t, g, unknown or other
  misc_feature (393)..(393): n is a, c, g, or t
tcagtcacgtactacacgaccggtgctcgatttagcgtcgatctcagggggggaagcctgggaacacttagccttcatgagtgtccccaccatggcctggatgatgcttctcctcggactccttgcttatggatcaggagtggattctcagactgtggtgacccaggagccatcgttctcagtgtctcctggaggacagtcacactcacttgtggcttgagatacggctcagtctctagtagttacctaccccagctggtaccaacacgaccccaggccaggcctccgcgcacgctcatcctaacaaccaacaaacactcgcttcttcgtcgggtccctcactcgcttctctcggctccacttccgtagggaacaaacgctccgtccctttanctacgtcggacccggggcccaggccgaaggaagtagtgtaaatcgtagtaatttaacgtttacttgttacgtttacttttaataggtttggggttaagttcgttacctttaagttttcgtacgttcgttcggttcggtttcgggaagggtaccgggacccgtaccccggggtccgttaccggtaccccggttcccggtccggttaccggaacccggtcccggtaacgggtccctacccggtaccccgtcggttaccccgg

SEQ ID NO: 158245 - DNA, 290 bp, Homo sapiens
  misc_feature: GYAE6OF02HGS1A.13.10.A10.1.454.CMB.1.raw
  modified_base (285)..(290): a, c, t, g, unknown or other
  misc_feature (285)..(290): n is a, c, g, or t
tcagtcacgtactacacgaccggtgctcgatttagcgtcgatctcagggatccctgagcgattctctggctccaactctgggaacacagccactctgaccatcagcgggacccagcctatggatgaggctgactattactgtcatacatgggacaacgatattggatggctgttcggcggagggaccaaactgaccgtcctaggtcagcccaaggctcgccccctggtcactctcgttcccacctctctagtacgtgactgagcgggctggcaaggcgcataggnnnnnn

SEQ ID NO: 158246 - DNA, 292 bp, Homo sapiens
  misc_feature: GYAE6OF02FJOBO.13.10.A10.1.454.CMB.1.raw
  modified_base (257)..(257): a, c, t, g, unknown or other
  misc_feature (257)..(257): n is a, c, g, or t
  modified_base (278)..(278): a, c, t, g, unknown or other
  misc_feature (278)..(278): n is a, c, g, or t
  modified_base (283)..(292): a, c, t, g, unknown or other
  misc_feature (283)..(292): n is a, c, g, or t
tcagtcacgtactacacgaccggtgctcgatttagcgtcgatctcagggatccctgagcgattctctggctccaactctgggaacacagccactctgaccatcagcggacccagcctatggatgaggctgactattactgtcatacatgggacaacgatattggatggctgtcggcggaggaccaaactcgaccgtctaggtcagcccaaggctcgccccctcggtcactctcgttcccgcctcctctagtaccgtnacgtgagcggctggcaagcgnatagnnnnnnnnnn

SEQ ID NO: 158247 - DNA, 654 bp, Homo sapiens
  misc_feature: GYAE6OF02GDQ8L.13.10.A10.1.454.CMB.1.raw
  modified_base (290)..(290): a, c, t, g, unknown or other
  misc_feature (290)..(290): n is a, c, g, or t
  modified_base (338)..(338): a, c, t, g, unknown or other
  misc_feature (338)..(338): n is a, c, g, or t
  modified_base (390)..(390): a, c, t, g, unknown or other
  misc_feature (390)..(390): n is a, c, g, or t
tcagtcacgtactacacgaccggtgctcgatttagcgtcgatctcaggggggaagcctgggaacacttagccttcatgagtgtccccaccatggcctggatgatgcttctcctcggactccttgcttatggatcaggagtggattctcagactgtggtgacccaggagccatcgttctcagtgtctccgtggaggacagtcacactcacttggtggcttgagatacggctcagtctctagtagttacctaccccagctggtaccaacacgacccaggccaggctccggcncacgctcatctaccaacaacaaacactcgcttctacgtggggtccctnactcgtcttctctggctccacttccgttagggaaacaaacgctcgcccttancactccggaccggggccccagggaccaaggaacgtatagaactctaggtactttaacttacttggttattttccttttaagttagttacgggttagttacgtaccttaagttttcgtacgttacgtttggttaccggtttaggggaccgggtacgggacccggtaaccccgggtaccgttaccgggaccccggttccggttacccggtccgtacccggtacccggtaaacggtcccgtcccggtacccgtacgtttaccccggg

SEQ ID NO: 158248 - DNA, 740 bp, Homo sapiens
  misc_feature: GYAE6OF02G3L1T.13.10.A10.1.454.CMB.1.raw
  modified_base (327)..(327): a, c, t, g, unknown or other
  misc_feature (327)..(327): n is a, c, g, or t
  modified_base (419)..(419): a, c, t, g, unknown or other
  misc_feature (419)..(419): n is a, c, g, or t
  modified_base (556)..(556): a, c, t, g, unknown or other
  misc_feature (556)..(556): n is a, c, g, or t
tcagtcacgtactacacgaccggtgctcgatttagcgtcgatctcagggggggaagcctgggaacacttagccttcatgagtgtccccaccatggcctggatgatgcttctcctcggactccttgcttatggatcaggagtggattctcagactgtggtgacccaggagtccatcgttctcagtgtctcctgggagggacagtcacactcacttgtggtcttggagatacggctcagttctctagtacgttacctaccccagtctggtaaccaacacgtacccccaggccaggcctccgcgccacgctcatcctaacaacacaaacncctacgccttcgttccgtcggggtccctacacttcgcttcctcgtcgtccttaccatccggttagggaaactaaagtcctacgtccctttancgtacgtaccggaccggggccccagggccaaaggaacgtagtagtaaactcgtaagttaaactttacgttaacgtttggtttacgttttactttaacggttagggttacgggttacgttacgtaacccggttttttntttccgttcgtttacggttacgggtttaacggggttaccggggaaccgggttcccgggtacccggtaccccgggttacggttaacccggttaccccgggttacccggttaccgggtaacccgaaccccgggtaccggtaccgggtaccccggtacccggttaccccggttacggttaccccggg

SEQ ID NO: 158249 - DNA, 946 bp, Homo sapiens
  misc_feature: GYAE6OF02HEC0G.13.10.A10.1.454.CMB.1.raw
  modified_base (150)..(150): a, c, t, g, unknown or other
  misc_feature (150)..(150): n is a, c, g, or t
tcagtcacgtactacacgaccggtgctcgatttagcgtcgatctcagggggggaagcctgggaacacttagccttcatgagtgtccccaccatggcctggatgatgcttctctcggactccttgcttatggatcgaggagtggtattctnacgtacttggtggtcgacccgagggacgcctagttccgttctcgtaggttgttcctccgtaggggacggactagtaccactactctacgttggtggtcttaggagtacgtacggcctacgtacgttctacgttaaggttacgttaccctaccccgagtcgtacggtaacccaacgaccgaccccgaggacccgacggtcccgtccggacgaccaccggtcctacgtacttacctaaaccaaaccaaacctaaaccaccgttccggtaccttaccgttccgggttccgggggttccccttacgtaaccgttccgttaccgtttccgttccgttaccggtacccttaccctaaccgtttaccggtaacgggtaaaaccgtaaacggttcccgtaaccggttccccttttaactaccggtaccgtaccccgggggtaacccgggggtacccggtaacgggaaccggtaaaaggtaacggtaacgttaacgtaaaccgtttccgttaacggtttaacttttaacgttttacccggttggtttttaacgttttttaaccgtttaaggttacgggtttacggggttacgttaccggtacctttttaacggttttcgttaccgggttttgtttaccgggtttagggtttaccggggtaagggtaccccgggttaacccggtccccggggtttaaccggttacccgggttaccccggtttaccgggtacccggttaaccgtacccgggttaacccggaacccgggttcccgtaccccggttaccccgttaacggtttcccccgg

SEQ ID NO: 158250 - DNA, 579 bp, Homo sapiens
  misc_feature: GYAE6OF02GHOXY.13.10.A10.1.454.CMB.1.raw
  modified_base (487)..(487): a, c, t, g, unknown or other
  misc_feature (487)..(487): n is a, c, g, or t
tcagtcacgtactacacgaccggtgctcgatttagcgtcgatctcaggggggaagcctgggaacacttagccttcatgagtgtccccaccatggcctggatgatgcttctcctcggactccttgcttatggatcaggatggattctcagactgtggtgacccaggagccatcgttctcagtgtctcctggagggacagtcacactcacttgtggcttgagataccggctcagtctctagtagttacctacccagctggtaccaacagaccccaggccaggctccgcgcacgctcatctacaacacaaacactcgctcttctcggggtccctcactcgcttctctcggctcccactccgttacggaacaaacgctcgacccttatcatccgaccggggtcccaggtacaagaacgtatacgaactcgtagttaatttattaccgttagtcgtttctttatacgtgggttagtcgtcctaatttctgtnttcgtgttcggagtacggccgcccggtctccggtacccgttccgtccggtcctacggcccgtaaggtccgtacgtccccgtagttaccccgg

SEQ ID NO: 158251 - DNA, 343 bp, Homo sapiens
  misc_feature: GYAE6OF02JLD2E.13.10.A10.1.454.CMB.1.raw
  modified_base (120)..(120): a, c, t, g, unknown or other
  misc_feature (120)..(120): n is a, c, g, or t
  modified_base (159)..(159): a, c, t, g, unknown or other
  misc_feature (159)..(159): n is a, c, g, or t
  modified_base (296)..(296): a, c, t, g, unknown or other
  misc_feature (296)..(296): n is a, c, g, or t
  modified_base (306)..(306): a, c, t, g, unknown or other
  misc_feature (306)..(306): n is a, c, g, or t
  modified_base (310)..(310): a, c, t, g, unknown or other
  misc_feature (310)..(310): n is a, c, g, or t
  modified_base (313)..(313): a, c, t, g, unknown or other
  misc_feature (313)..(313): n is a, c, g, or t
  modified_base (315)..(343): a, c, t, g, unknown or other
  misc_feature (315)..(343): n is a, c, g, or t
tcagtcacgtactacacgaccggtgctcgatttagcgtcgatctcagggatccctgagcgattctctggctccaactctgggaacacagccactcgtgaccatcagcgggaccagcctanggatgaggactgatatactgtcatacatgggaccaaagntattggatggcttggtcgcggaaggaccaaactgacgtctagcacgcctaaaggctagcccctggtcactctcgtcccgccctcgtacgtagtacggttcgaaccgtggacggtcgggctggaaccgaaagcccgtnaagtacgctnagtncancnnnnnnnnnnnnnnnnnnnnnnnnnnnnn

SEQ ID NO: 158252 - DNA, 539 bp, Homo sapiens
  misc_feature: GYAE6OF02JJRXN.13.10.A10.1.454.CMB.1.raw
tcagtcacgtactacacgaccggtgctcgatttagcgtcgatctcagggggggaagcctgggaacacttagccttcatgagtgtccccaccatggcctggatgatgcttctcctcggactccttgcttatggatcaggagtggattctcagactgtggtgacccaggagccatcgttctcagtgtctcctggagggacagtcacactcacttgtggcttgagatacggctcagtctctagtagttacctaccccagctggtaccaacacgacccaggccaggctccgcgcacgctcatcacaacacaacactcgctctctcggggtccctcatcgcttctctggcctcctactccttagggaacaacgctacgcccttatcacgtcgaccggggccagggacgagaagataggaactctgtattacttactgttagttctttatagttggtagtcgctatttcgtgctgtcgtcgaggacggcctaccggcgtacgtaccgtccgtcgtcacgaccgtaccgctccggcccagttccgg

SEQ ID NO: 158253 - DNA, 300 bp, Homo sapiens
  misc_feature: GYAE6OF02FIXBF.13.10.A10.1.454.CMB.1.raw
  modified_base (291)..(300): a, c, t, g, unknown or other
  misc_feature (291)..(300): n is a, c, g, or t
tcagtcacgtactacacgaccggtgctcgatttagcgtcgatctcagggatccctgagcgattctctggctccaactctgggaacacagccactctgaccatcagcgggacccaggctatggatgaggctgactattactgtcaggcgtgggacagcagcactgcccgctatgtcttcggaactgggaccaaggtcaccgtcctaaagtcagcccaaggccaacccccatgtcactctgttccccaccctcctctagtaccgtgactgagcgggctggcaaggcgcatagnnnnnnnnnn

SEQ ID NO: 158254 - DNA, 702 bp, Homo sapiens
  misc_feature: GYAE6OF02GIARR.13.10.A10.1.454.CMB.1.raw
  modified_base (150)..(150): a, c, t, g, unknown or other
  misc_feature (150)..(150): n is a, c, g, or t
  modified_base (295)..(295): a, c, t, g, unknown or other
  misc_feature (295)..(295): n is a, c, g, or t
  modified_base (303)..(303): a, c, t, g, unknown or other
  misc_feature (303)..(303): n is a, c, g, or t
  modified_base (320)..(320): a, c, t, g, unknown or other
  misc_feature (320)..(320): n is a, c, g, or t
tcagtcacgtactacacgaccggtgctcgatttagcgtcgatctcaggggggggaagcctgggaacacttagccttcatgagtgtccccaccatggcctggatgatgcttctcctcggactccttgcttatggatcagggagtggattcncagactgtggtgacccaggagccatcgttctcagtgtctcctgggaggacagtcacactcagttgtggcttgagactacggctcagtctctagtacgttacctaccccagcctggtaccaacacgacccacggccaggctccgcncacgctcntcacaacacaacactcnctcttctcggggtccctcgtactcgtcttctcgttcgtcgtcccacttccgttacggaaactaaacggtctaccggtacctttactccaacgttccgaccggggggtacccgacgggaccgaaggaaagacgtaggtaacttcgttagttaactttaacgttcgttagttttgttttaacctttttaagttacggttaaggggttacgttcggttaacccgttatttttccgtcgggttacgttcgggtttcgggtttaccgggagggtacgggtacccgtaacccgggtccgttaccggttacccgggttcccgttaccggacccgttaacggccccggttaacggtccccggtacccggtacccgtacggtttaccccgg

SEQ ID NO: 158255 - DNA, 576 bp, Homo sapiens
  misc_feature: GYAE6OF02HP305.13.10.A10.1.454.CMB.1.raw
tcagtcacgtactacacgaccggtgctcgatttagcgtcgatctcagggggggaagcctgggaacacttagccttcatgagtgtccccaccatggcctggatgatgcttctcctcggactccttgcttatggatcaggagtggattctcagactgtggtgacccaggagccatcgttctcagtgtctcctggagggacagtcacactcacttgtggcttgagatacggctcagtctctagttacgttacctaccccagctggtaccaacagaccccaggccaggctccgcgcacgctcatctacaacacaaacactcgctcttctggggtccctcatccgcttctctggctcatccttgggaacaaagctacgccttatcatccgacggggcccaggcagaagatgaatctgaatttatacttgtgtttcttttaatcgtaggggttagtgtacctattttcgtgtcttggtcgttcgggaggtacgggactaccccgggtctacggtacccgtccggttcggtacccgacggtacccgaacgggccgtacccggtccccccgtacgggttacccc

SEQ ID NO: 158256 - DNA, 813 bp, Homo sapiens
  misc_feature: GYAE6OF02JO3C2.13.10.A10.1.454.CMB.1.raw
  modified_base (180)..(180): a, c, t, g, unknown or other
  misc_feature (180)..(180): n is a, c, g, or t
  modified_base (191)..(191): a, c, t, g, unknown or other
  misc_feature (191)..(191): n is a, c, g, or t
  modified_base (263)..(263): a, c, t, g, unknown or other
  misc_feature (263)..(263): n is a, c, g, or t
tcagtcacgtactacacgaccggtgctcgatttagcgtcgatctcagggggggaagcctgggaacacttagccttcatgagtgtccccaccatggcctggatgatgcttctcctcggacctccttgcttagtggatcgaggtaggtggacttctcagactggtcggtcgacccgaggacncctatcgttcncgtagtctactccgtgggacggactgtaccactacctagtcgttggtcgtcgttgaagtcgtacggtcctanacgttcttacgtaagttaccgtaccctacccgtgtcgtaccggtaaccaacgaaccgaaccccggaggtacccgaacggtcccgtccggaccgaccgaaccgcgtactaccctacctaaccgaaacctaaccaaaccgtaccgtaccggtcttaccgttccgggtacccggttccctacggtacctccgttcttccttcggtccggtacctccctacgttaccggtaacggtaacccgtaaacgtccgttaccgtacccgttactaccgtaccggaaccgggtcccgggaaccgtacggacgtaacggagtacgtaacgtactacgtacgttatttaacgttacgttcgtttacgtttactttacgttagggtaaggtccggttcgtacctttaaggtttccgtcgtttaccggttgttacggggttaaccgggtccgggtaccggacccgggtaccggttcccggttacgttaccccgggtaacccgttccggaaccggtacccgtaccggtacccgtccggaccccggttacccgtccggttaacccg

SEQ ID NO: 158257 - DNA, 686 bp, Homo sapiens
  misc_feature: GYAE6OF02IICGM.13.10.A10.1.454.CMB.1.raw
  modified_base (217)..(217): a, c, t, g, unknown or other
  misc_feature (217)..(217): n is a, c, g, or t
  modified_base (245)..(245): a, c, t, g, unknown or other
  misc_feature (245)..(245): n is a, c, g, or t
  modified_base (474)..(474): a, c, t, g, unknown or other
  misc_feature (474)..(474): n is a, c, g, or t
tcagtcacgtactacacgaccggtgctcgatttagcgtcgatctcagggggggaagcctgggaacacttagccttcatgagtgtccccaccatggcctggatgatgcttctcctcggactccttgcttatggatcaggagtggattctcagactgtggtgacccaggacgccattcgttctcagttgtctccgtggaggacagtcacactcacttgnggtcttagagatacggctcgtacgtctntaggttacgttacctaccccagtctacggtaaccaacgacgaccccgaggacccaggcctccggccgcgacgtcctacactacctaacaacaacaaacctactccgtactcgttcgtccgggttccctactacttccgtccttctcgtcggcctccgtagttccgtaggaaacaacgtctcgtacctttagctacgtcgggaccggggcccaagggtacaaggtaaagngtaacgacgttacttaaggtattttactacgtttcgtttcgttttacgttaagttacggtcggggttagttacctaccgtttagttccgttagttcgttaggtttcggttacggcgggtacggcccggtaccggcgttacccgtacccggttcccggtacggtacccgcggtaccccggaaccggtcccggtcccgacccgtacggtcccgg

SEQ ID NO: 158258 - DNA, 893 bp, Homo sapiens
  misc_feature: GYAE6OF02FI0LN.13.10.A10.1.454.CMB.1.raw
  modified_base (146)..(146): a, c, t, g, unknown or other
  misc_feature (146)..(146): n is a, c, g, or t
  modified_base (331)..(331): a, c, t, g, unknown or other
  misc_feature (331)..(331): n is a, c, g, or t
tcagtcacgtactacacgaccggtgctcgatttagcgtcgatctcaggggggtagcctgggaacacttagccttcatgagtgtccccaccatggcctggatgatgcttctcctcggactccttgcttatggatcaggatggattcncaggactgtggtgacccaggagccctattccgttctcagtgtcctccgtggacgggacagtcaacactcacgttggtggccttgacgtctaccgggctccgtagttcctactaggttaacgtttacctacccccgaagcctacgggtacccaacacgtacccccaggcccaagggtcctcccgcnccgaacgctcactctaccaaccaacgtaaacactccgctaccttcgtcggggtccctctacgtccgtcctttacgtccttcgggtctacccctacgttcccgtttaggggggaaacctaaaaaccggccgttacgggtacccccttttaacgtacctaaaccgtttaccggaacccgggggggtacccccaacgggggaccctaaacggaaacgggtaaacgttaacgggtaaaccttaccggttaacgggttaaaccttttaacgttttaaccggttaccggtttacgtttttaaccggtttttaaacgttaaacggtttttacgggggttaaaccggtttaccggtaccgttttaaaccgttttaccgttacgggtaacccctttgggttaccgggtttaccgggtaacggggtaccggggtaccccgtaacccgggggtaacccttccgggtaaacccccggtttcccggtacccgggttaccccgtaaccggttaccccccgtaaaaccgggggttcctttacccccgggaccccccgtttacccggttaacccccgg

SEQ ID NO: 158259 - DNA, 334 bp, Homo sapiens
  misc_feature: GYAE6OF02JCFUF.13.10.A10.1.454.CMB.1.raw
  modified_base (253)..(259): a, c, t, g, unknown or other
  misc_feature (253)..(259): n is a, c, g, or t
  modified_base (261)..(261): a, c, t, g, unknown or other
  misc_feature (261)..(261): n is a, c, g, or t
  modified_base (271)..(276): a, c, t, g, unknown or other
  misc_feature (271)..(276): n is a, c, g, or t
  modified_base (278)..(334): a, c, t, g, unknown or other
  misc_feature (278)..(334): n is a, c, g, or t
tcagtcacgtactacacgaccggtgctcgattttagcgtcgatctcagggggtcttcgtggctcacgtccaccaccacgcatgtgacctcaggggtccggggagatcatgaggggtggtccttgggttttgggggggaagaggaagactggacggtccccccaggagttcaggtgctgggcacagcggccctgggctgcctggcaaggctactcctagtacgtgactgagcgggctggcaaggcgcagtacgnnnnnnncngtgatcatcnnnnnngnnnnnnnnnnnnnnnnnnnnnnnnnnnnnnnnnnnnnnnnnnnnnnnnnnnnnnnnn

SEQ ID NO: 158260 - DNA, 634 bp, Homo sapiens
  misc_feature: GYAE6OF02JN7L7.13.10.A10.1.454.CMB.1.raw
  modified_base (181)..(181): a, c, t, g, unknown or other
  misc_feature (181)..(181): n is a, c, g, or t
  modified_base (196)..(196): a, c, t, g, unknown or other
  misc_feature (196)..(196): n is a, c, g, or t
  modified_base (439)..(439): a, c, t, g, unknown or other
  misc_feature (439)..(439): n is a, c, g, or t
  modified_base (509)..(509): a, c, t, g, unknown or other
  misc_feature (509)..(509): n is a, c, g, or t
  modified_base (521)..(521): a, c, t, g, unknown or other
  misc_feature (521)..(521): n is a, c, g, or t
  modified_base (540)..(540): a, c, t, g, unknown or other
  misc_feature (540)..(540): n is a, c, g, or t
  modified_base (558)..(558): a, c, t, g, unknown or other
  misc_feature (558)..(558): n is a, c, g, or t
  modified_base (564)..(564): a, c, t, g, unknown or other
  misc_feature (564)..(564): n is a, c, g, or t
tcagtcacgtactacacgaccggtgctcgatttagcgtcgatctcagggggggaagcctgggaacacttagccttcatgagtgtccccacatggcctggatgatgcttctcctcggactccttgcttatggatcaggagtggattcctcgaggtaccttggtcggtacgaccccagggacnccagttccgttcctnaggttcgtctccgtgggacggcagtccactctcgtacgttggtcgtacttaggaacgtacgtcggtcctacgtgttacctcgtagttaaccgtacccaccccgtagtcttaccggaacctaccgtaccgaccccggaggtcccgacggtcccgtaccgcccgtaaccgtccggtcctactacttaccaaccgaacaaccgaacctcgtccgtcttcgtccgtaccgggtcccatccgtcgttntccgtagtccgtactctaacgtcgtagaacacgtctactcctgacgcgacgtaccggccgtagcgaaganactagactcgtntacgttctattcgttattntcgtgttcgtctatcgtntacgtntcgtcgtgtcgcgtcgcgtaccgtgtccgccgtacgcgtccgacgcgtaccaccggtctaccgtacctcg

SEQ ID NO: 158261 - DNA, 729 bp, Homo sapiens
  misc_feature: GYAE6OF02GK6LY.13.10.A10.1.454.CMB.1.raw
tcagtcacgtactacacgaccggtgctcgatttagcgtcgatctcagggggggaagcctgggaacacttagccttcatgagtgtccccaccatggcctggatgatgcttctcctcggactccttgcttatggatcaggagtggattcgtcagactggtggtcgacccaggacgccattcgttctcgagtgtctccgtagggagggtacagtccactactctacgttggtggtcttagagtacgtacggctcgagttcctgttaacgtacgttaccctaccccgagccgtcggtaaccaacacgtaaccccgaggcccgtaggcctccggacgtccaccgccgtacactactaaccgtaaaccaaaccaaaaccgtaccgtacgtccttaccgttttccgggtaccgggggttcccctactacgtccgtaccgttcctcggtcggtcctacccgtaacttccggttaggaaacctaacgtcctacgtaccctttatcctacgtaccgggaccgggggtcccacggtacgaaggaacgagtacgtaacgttactagtaatttacgttagttcgtttacgtttactttagttagttaggggttatccgttacctttgtttcgtacgttgttcggttacgggtacgggtggaccggcgtacccggtcgtaccggtcccggttcgtcggaccgtaccgtaccggtaccgccggtacccgtcccgagttaccccg

SEQ ID NO: 158262 - DNA, 211 bp, Homo sapiens
  misc_feature: GYAE6OF02IPJRL.13.10.A10.1.454.CMB.1.raw
  modified_base (203)..(211): a, c, t, g, unknown or other
  misc_feature (203)..(211): n is a, c, g, or t
tcagtcacgtactacacgaccggtgctcgatttagcgtcgatctcaggggtccgggagatcatgagggtgtccttgggttttggggggaagaggaagactgacggtcccccaggagttcaggtgctgggcacagcggccctgggctgcctggtcaaggactacttcctagtacgtgactgagcgggctggcaaggcgcatagnnnnnnnnn

SEQ ID NO: 158263 - DNA, 640 bp, Homo sapiens
  misc_feature: GYAE6OF02IN3GP.13.10.A10.1.454.CMB.1.raw
  modified_base (149)..(149): a, c, t, g, unknown or other
  misc_feature (149)..(149): n is a, c, g, or t
  modified_base (179)..(179): a, c, t, g, unknown or other
  misc_feature (179)..(179): n is a, c, g, or t
  modified_base (223)..(223): a, c, t, g, unknown or other
  misc_feature (223)..(223): n is a, c, g, or t
  modified_base (231)..(231): a, c, t, g, unknown or other
  misc_feature (231)..(231): n is a, c, g, or t
  modified_base (237)..(237): a, c, t, g, unknown or other
  misc_feature (237)..(237): n is a, c, g, or t
tcagtcacgtactacacgaccggtgctcgatttagcgtcgatctcaggggggaagcctgggaacacttagcctttcatgagtgtccccaccatggcctggatgatgcttctcctcggactccttgcttatggatcagggagtggattcncagactgtggtgacccaggagccatcgttntcagtgtctcctgggaggacagtcacactcacttgtggcttganatacgctnagtctntagtagttactaccccagctggtaccaacacgacccagccaggctcgcgcacggctcatctacaacacaaacactcgctcttcgtcggggtccctctacgtccgtcttcttctggcctcacgtccgttaggggaactaaacgctcgtaccctttagtctacgtccgaaccgggggcccagggacctagaaacggatcggtaaatccgtagttaatttactttaacgtgtttacgttttaccgtttattggttagggttacgttcggtaaccttgttttccgtggttccttggttaccgggttgggaacgggttacgggccgtaaccgggtcttaacccggtccgtttcccggcggtttacgacggtaccgaacggttccgtccggacccttacggtacccggg

SEQ ID NO: 158264 - DNA, 767 bp, Homo sapiens
  misc_feature: GYAE6OF02FWKY9.13.10.A10.1.454.CMB.1.raw
  modified_base (179)..(179): a, c, t, g, unknown or other
  misc_feature (179)..(179): n is a, c, g, or t
  modified_base (286)..(286): a, c, t, g, unknown or other
  misc_feature (286)..(286): n is a, c, g, or t
  modified_base (316)..(316): a, c, t, g, unknown or other
  misc_feature (316)..(316): n is a, c, g, or t
tcagtcacgtactacacgaccggtgctcgatttagcgtcgatctcatggggggggaagcctgggaacacttagccttcatgagtgtcccacatggcctggatgatgcttctcctcggactccttgcttatggatcgaggacgtggacttctcgagtacgtgtggtccaaccgagggacnccattcgttctcgagtctctccgtagggaggactggtccaacgtctcaagtttggtcggctttaggagtacgtcggctactagttcctatacgttcttaacctaccngtctcgtaaccaactacgacccctaggccnggccgtcgcgtacgcgctcgacttccgtaaccaacaaccgtaactaccgtccgtccttaccgttccgggttacccggggtaccccttcgtacccgttccgtccgtttaccgttcgtaccgggttccctaccgttccgggttaacccgtaacgggtaaaccgtaaccggtcgttaccggtaccttactcccgtacgggtacccgggaccggggtaccggacggtaacgaggtaaactaggtacgtacttacggttatacgtttaacgttgttacgggttcttagttagttcggtacggtgtacgttacgttgttcgtcttggttcgggtacgttacgggtacgggtaccggtacccggtcggtacccggtaccggttcccggttacccggtacgggttcccgtaaccgggttacccggtacggtccccgtacccggtacccggttacccggg

SEQ ID NO: 158265 - DNA, 164 bp, Homo sapiens
  misc_feature: GYAE6OF01DM77G.36.67.G01.1.454.CMB.1.raw
  modified_base (164)..(164): a, c, t, g, unknown or other
  misc_feature (164)..(164): n is a, c, g, or t
tcagtacgctgtctcacgaccggtgctcgatttagagtatacatattggttgggaagaggagactgacggtcccaggagttcaggtgctggcacagcggcctgggctgcctggtcaaggactacttccagacagcgtactgagcgggctggcaaggcgcatagn

SEQ ID NO: 158266 - DNA, 180 bp, Homo sapiens
  misc_feature: GYAE6OF01DMUXZ.36.67.G01.1.454.CMB.1.raw
  modified_base (180)..(180): a, c, t, g, unknown or other
  misc_feature (180)..(180): n is a, c, g, or t
tcagtacgctgtctcacgaccggtgctcgatttagagtatacatattgggtttgggttttgggggaagaggaagactgacggtcccccaggagttcaggtgctgggcacagcggccctgggctgcctggtcaaggactacttccagacagcgtactgagcgggctggcaaggcgcatagn

SEQ ID NO: 158267 - DNA, 180 bp, Homo sapiens; identical to SEQ ID NO: 158266
  misc_feature: GYAE6OF01E3UTJ.36.67.G01.1.454.CMB.1.raw
  modified_base (180)..(180): a, c, t, g, unknown or other
  misc_feature (180)..(180): n is a, c, g, or t

SEQ ID NO: 158268 - DNA, 187 bp, Homo sapiens
  misc_feature: GYAE6OF01ENFW6.36.67.G01.1.454.CMB.1.raw
  modified_base (181)..(187): a, c, t, g, unknown or other
  misc_feature (181)..(187): n is a, c, g, or t
tcagtacgctgtctcacgaccggtgctcgatttagagtatacatattgggtttgggttttgggggaagaggaagactgacggtcccccaggagttcaggtgctgggcacagcggccctgggctgccctggtcaaggactacttccagacagcgtactgagcgggctggcaaggcgcatagnnnnnnn

SEQ ID NO: 158269 - DNA, 195 bp, Homo sapiens
  misc_feature: GYAE6OF01DJ2F9.36.67.G01.1.454.CMB.1.raw
  modified_base (180)..(195): a, c, t, g, unknown or other
  misc_feature (180)..(195): n is a, c, g, or t
tcagtacgctgtctcacgaccggtgctcgatttagagtatacatattgggtttgggtttgggggaagaggaagactgacggtcccccaggagttcaggtgctgggcacagcggccctgggctgcctggtcaaggactacttccagacagcgtactgagcgggctgggcaaggcgcatagnnnnnnnnnnnnnnnn

SEQ ID NO: 158270 - DNA, 173 bp, Homo sapiens
  misc_feature: GYAE6OF01BAFFH.36.67.G01.1.454.CMB.1.raw
  modified_base (173)..(173): a, c, t, g, unknown or other
  misc_feature (173)..(173): n is a, c, g, or t
tcagtacgctgtctcacgaccggtgctcgatttagagtatacatattgggtttgggggaagaggaagactgacggtcccccaggagttcaggtgctgggcacagcggccctgggctgcctggtcaaggactacttccagacagcgtactgagcgggctggcaaggcgcatagn

SEQ ID NO: 158271 - DNA, 214 bp, Homo sapiens
  misc_feature: GYAE6OF01EA3S5.36.67.G01.1.454.CMB.1.raw
  modified_base (212)..(214): a, c, t, g, unknown or other
  misc_feature (212)..(214): n is a, c, g, or t
tcagtacgctgtctcacgaccggtgctcgatttagagtatacatattgggtttgggtgcccaagctgctggagggcacggtcaccacgctgctgagggagtagagtcctgaggactgtaggacagacgggaaggtgggcacagcggccctgggctgcctggtcaaggactacttccagacagcgtactgagcgggctggcaaggcgcatagnnn

SEQ ID NO: 158272 - DNA, 178 bp, Homo sapiens
  misc_feature: GYAE6OF01BCJ21.36.67.G01.1.454.CMB.1.raw
  modified_base (177)..(178): a, c, t, g, unknown or other
  misc_feature (177)..(178): n is a, c, g, or t
tcagtacgctgtctcacgaccggtgctcgatttagagtatacatattgggtttggttttggggaagaggaagactgacggtccccaggagttcaggtgctgggcacagcggccctgggctgcctggtcaaggactacttccagacagcgtactgagcgggctggcaaggcgcatagnn

SEQ ID NO: 158273 - DNA, 174 bp, Homo sapiens
  misc_feature: GYAE6OF01AM5UE.36.67.G01.1.454.CMB.1.raw
  modified_base (173)..(174): a, c, t, g, unknown or other
  misc_feature (173)..(174): n is a, c, g, or t
tcagtacgctgtctcacgaccggtgctcgatttagagtatacatattgggtttgggggaagaggaagactgacggtcccccaggagttcaggtgctgggcacagcggccctgggctgcctggtcaaggactacttccagacagcgtactgagcgggctggcaaggcgcatagnn

SEQ ID NO: 158274 - DNA, 214 bp, Homo sapiens
  misc_feature: GYAE6OF01BYHQ7.36.67.G01.1.454.CMB.1.raw
  modified_base (177)..(214): a, c, t, g, unknown or other
  misc_feature (177)..(214): n is a, c, g, or t
tcagtacgctgtctcacgaccggtgctcgatttagagtatacatattgggtttggggggaagaggaagactgacggtcccccaggagttcaggtgctgggcacagcggccctgggctgcctggtcaaggactacttccagacagcgtactgagcgggctgggcctaaggcgcatagnnnnnnnnnnnnnnnnnnnnnnnnnnnnnnnnnnnnnn

SEQ ID NO: 158275 - DNA, 784 bp, Homo sapiens
  misc_feature: GYAE6OF01ADO6G.36.67.G01.1.454.CMB.1.raw
  modified_base (151)..(151): a, c, t, g, unknown or other
  misc_feature (151)..(151): n is a, c, g, or t
  modified_base (158)..(158): a, c, t, g, unknown or other
  misc_feature (158)..(158): n is a, c, g, or t
  modified_base (185)..(185): a, c, t, g, unknown or other
  misc_feature (185)..(185): n is a, c, g, or t
tcagtacgctgtctcacgaccggtgctcgatttagagtatacatagttggggtttgggggcagaagtctctctcagtcaggacacagcatggacatggacgggtccctgctcagcctccgtgggctcctgctgctctggctccagactacngatggtnactatccagctccgacccttagttccnctccctcctgtctgctagttcgtaggaaggacgacaggtactaccacctacgtccgtacggtcgggaccgggtatacggtacgaaggtaactaacttaaacacttcgtaagttccgaccgttagtacacgaacggacgaaacggaaccggaaggtacctccgtaactacgtcctacgtagtacttacgtcgtacgtcttacgttactcgtacgtacgtacgtaaccgtacggttaccgggtaccggttctcggttcggtttacgggacgtacggggtcgtacggtagggtacggttacggtacggtacggttaccttacgtccctacgtcctaaccggtactacggtacgccggtaccgtaccgtccgtacggaaccttcgggtacgttaacgtaacgtttacgttttaaccgtaacggtttaaactttaacgtttaaagggtaaccgttaacggtaaacgttaacggtcgtaaccggttacccggaccggtttccccggtaacccggttacgggttaccgggtacccggggtaaacgggggtaccgaaacggggttaacggaggttaaacccgacgtaaaccggaacgttacccgggg

SEQ ID NO: 158276 - DNA, 173 bp, Homo sapiens; identical to SEQ ID NO: 158270
  misc_feature: GYAE6OF01A0I4M.36.67.G01.1.454.CMB.1.raw
  modified_base (173)..(173): a, c, t, g, unknown or other
  misc_feature (173)..(173): n is a, c, g, or t

SEQ ID NO: 158277 - DNA, 173 bp, Homo sapiens; identical to SEQ ID NO: 158270
  misc_feature: GYAE6OF01BWJNO.36.67.G01.1.454.CMB.1.raw
  modified_base (173)..(173): a, c, t, g, unknown or other
  misc_feature (173)..(173): n is a, c, g, or t

SEQ ID NO: 158278 - DNA, 567 bp, Homo sapiens
  misc_feature: GYAE6OF01C7JE6.36.67.G01.1.454.CMB.1.raw
  modified_base (349)..(349): a, c, t, g, unknown or other
  misc_feature (349)..(349): n is a, c, g, or t
tcagtacgctgtctcacgaccggtgctcgatttagagtatacatattgggtttgggctcaaccgccatcctcgccctcctcctggctgttctccaaggagtctgtgccgaggtgcagctggtgcagtctggagcggaggtgaaaaagcccggggagtctctgaaaatctcctgtaaggcttctggatacacctttaccaacttctggatcggctgggtgcgccagatgcccgggaaaggcctggactggatggggatcgtctatcctggtgactctgataccagatacagcccgtccttcaaggccaggtcaccatctcagtcgacaagtccatcagcaccgcctaccnccactggagtagcctgaacggcctcggacacccgcatatacttactgtgcgagacagtggaagctagtagtagggaacttagttttggggtggggggcctggcgtggggccacgggtacccgtggtcaccgtctccgtacgacgcctccaccgacgggcccagtcccggttccttcccccgtggccctacccgtccctaccgaacgtcgccgtacccg

SEQ ID NO: 158279 - DNA, 634 bp, Homo sapiens
  misc_feature: GYAE6OF01CK0MZ.36.67.G01.1.454.CMB.1.raw
  modified_base (325)..(325): a, c, t, g, unknown or other
  misc_feature (325)..(325): n is a, c, g, or t
  modified_base (399)..(399): a, c, t, g, unknown or other
  misc_feature (399)..(399): n is a, c, g, or t
  modified_base (406)..(406): a, c, t, g, unknown or other
  misc_feature (406)..(406): n is a, c, g, or t
  modified_base (417)..(417): a, c, t, g, unknown or other
  misc_feature (417)..(417): n is a, c, g, or t
tcagtacgctgtctcacgaccggtgctcgatttagagtatacatattgggtttggggggaagaggaagactgacggtccccccaggagttcaggagtctgtgccgaggtgcagctggtgcattctggagcggaggtggaaaagccggggagtctctagaaaatctcctgtaaggcttctggatacacctttaccaacttctggatcggctgggtgcgccagatcggacccgggaaagcctggactgggatggggatcgtctatccgtggtgactctgataccagatacagcccgtcttccaagccaggtcaccatctcagtcganaacgtccatcagccaccgccctacctccactggagtacgctagaacggcctacggaccaccgccatatattacngtgcganacagtacgaanctaagtaggtagggaacttaggtttgggtcggggggcctcggcggttcggggacccgaaggggtaaccccgttgggtacccgtacccggttcctcccgtccacggtcccctacccgaaccgaacgggtcccacgtaccggttcccttcccccgtcggtcccaccccgtccctacccgtaacgacgcccgtaaccgtccgtcggggccacgtaccggg

SEQ ID NO: 158280 - DNA, 684 bp, Homo sapiens
  misc_feature: GYAE6OF01C4CBM.36.67.G01.1.454.CMB.1.raw
tcagtacgctgtctcacgaccggtgctcgatttagagtatacatattgggtttggggggaagaggaagactgacggtccccccaggagttcaggagtctgtgccgaggtgcagctggtgcattctggagcggaggtgaaaaagcccggggagtctctgaaaatctcctgtaaggcttctggatacacctttaccaacttctggatcggctgggtgcgccagatgcccgggaaagcctggactggatggggatcgtctatcctggtgactctgataccagatacacgcccgtccttccgaaggccaggtcaccatctcagtcgacagtccatcagccaccgcctacctccactggacgtacgccgtaggaacggcctacggaccaccgactattatacttactggtgcgaagacgagtagggaatcgtaagttaggtagggtaaacgtttagggttttaggggtcggggggtacctgggtccggtcgggggacccgaacggggtacccgttcgggtacccgtaacccggttccgttacccgtccgaccgtccccttacccgacccggtaaccgggtcccctacgttccccggttcccttccccccgtcggtacccctaccccgttccctacccgaaacggtacccgtccgtaaccccgtcgggtcgggggcccacggtacccggg

SEQ ID NO: 158281 - DNA, 180 bp, Homo sapiens
  misc_feature: GYAE6OF01D2KT8.36.67.G01.1.454.CMB.1.raw
  modified_base (179)..(180): a, c, t, g, unknown or other
  misc_feature (179)..(180): n is a, c, g, or t
tcagtacgctgtctcacgaccggtgctcgatttagagtatacatattgggtttgggtttgggggaagaggaagactgacggtcccccaggagttcaggtgctgggcacagcggccctgggctgcctggtcaaggactacttccagacagcgtactgagcgggctggcaaggcgcatagnn

SEQ ID NO: 158282 - DNA, 568 bp, Homo sapiens
  misc_feature: GYAE6OF01C0XAR.36.67.G01.1.454.CMB.1.raw
  modified_base (471)..(471): a, c, t, g, unknown or other
  misc_feature (471)..(471): n is a, c, g, or t
tcagtacgctgtctcacgaccggtgctcgatttagagtatacatattgggtttgggggaagaggaagactgacggtccccccaggagttcaggagtctgtgccgaggtgcagctggtgcattctggagcggaggtgaaaaagcccggggagtctctgaaaatctcctgtaaggcttctggatacacctttaccaacttctggatcggctgggtgcgccagatgcccgggaaaggcctggactggatggggatcgtctatcctggtgactctgataccagatacagcccgtcttccaaggccaggtcaccatctcagtcgacaagtccatcagcaccgcctacctccactgagtagcctgaaggcctcggacaccgccatatattactgtgcgagacatggaagctatagtgggaactagttttgggtgggggtcctgcgtggggccagggaccctggtcaccgtctcctcncgccctccaccgaacgggcccacgtccggtccttccccccgtcggcccacccctcccgtcccaacgacgtcccacccttcgtcggggccacgaccgg

SEQ ID NO: 158283 - DNA, 571 bp, Homo sapiens
  misc_feature: GYAE6OF01C3R0U.36.67.G01.1.454.CMB.1.raw
  modified_base (230)..(230): a, c, t, g, unknown or other
  misc_feature (230)..(230): n is a, c, g, or t
  modified_base (443)..(443): a, c, t, g, unknown or other
  misc_feature (443)..(443): n is a, c, g, or t
  modified_base (478)..(478): a, c, t, g, unknown or other
  misc_feature (478)..(478): n is a, c, g, or t
tcagtacgctgtctcacgaccggtgctcgatttagagtatacatattgggtttgggggcagaagtctctctcagtcaggacacagcatggacatgagggtccctgctcagctcctgggactcctgctgctctggctcccagataccagatgtgacatccagatcgaccctagtttccatcctccctgtctgcatctgtaggagacagagtcaccatcacgttggccgggnagtcgagggcattaacaatcatttagcctggtatcagcaaggaaaccgagggaaacgctacctaagcctacctagatatatgtctgtacttcacttgtgacaagtccgacggggtcccagtcgtcggttacaggtggacgtaggtaggtaataggtagggtacggtactttcgaccttcgtaccactatcgagcagcctgcagcctagaagtntagtcgactaacttattacttagtaactaaagttntagacgtagtaccgtccccgtattaccgtacgtttccgggacgggtaacgggtaacccgtaagggtacggaacgtaacgtaacgtaaaaccgg

SEQ ID NO: 158284 - DNA, 575 bp, Homo sapiens
  misc_feature: GYAE6OF01EKNXD.36.67.G01.1.454.CMB.1.raw
  modified_base (345)..(345): a, c, t, g, unknown or other
  misc_feature (345)..(345): n is a, c, g, or t
  modified_base (568)..(568): a, c, t, g, unknown or other
  misc_feature (568)..(568): n is a, c, g, or t
tcagtacgctgtctcacgaccggtgctcgatttagagtatacatattgggtttggggggaagaggaagactgacggtccccccaggagttcaggagtctgtgccgaggtgcagctggtgcagtctggagcggaggtgaaaaagcccggggagtctctgaaaatctcctgtaaggcttctggatacacctttaccaacttctggatcggctgggtgcgccagatgcccgggaaagcctggactggatggggatcgtctatcctggtgactctgataccagatacagcccgtccttccaaggccaggtcaccatctcagtcgacaagtccatcagcaccgcctaccncactggatacgcctgaacgcctcggacaccgcatatattactgtgcgagacagtggaagctatagtagggtaacttagtttgggtgggggtcctggcgtggggccgacgggaaccctggtccaccgtctccgtcacgccctccaccgacggcccagtccggtccttcccccgtcggccctaccccgtccctacccgaacgacgtccacccgtcgtcggggccncgaccgg

SEQ ID NO: 158285 - DNA, 553 bp, Homo sapiens
  misc_feature: GYAE6OF01A6HGB.36.67.G01.1.454.CMB.1.raw
tcagtacgctgtctcacgaccggtgctcgatttagagtatacatattgggtttgggctcaaccgccatcctcgccctcctcctggctgttctccaaggagtctgtgccgaggtgcagctggtgcagtctggagcggaggtgaaaaagcccggggagtctctgaaaatctcctgtaaggcttctggatacacctttaccaacttctggatcggctgggtgcgccagatgcccgggaaaggcctggactggatggggatcgtctatcctggtgactctgataccagatacagcccgtccttccaaggccaggtcaccatctcagtcgacaagtccatcagcaccgcctacctccactggagtagcctgaagcctcggacaccgcatatattactgtgcgagacatggaagctatagtgggaactagttttgggtgggggtcctggcgtggggccgagggaccctggtccaccgtcctccctcacgccctccaccgaacgggcccagtccggtccttccccccgtgccctacccctcctacccaagcgcctacccg

SEQ ID NO: 158286 - DNA, 623 bp, Homo sapiens
  misc_feature: GYAE6OF01C279M.36.67.G01.1.454.CMB.1.raw
tcagtacgctgtctcacgaccggtgctcgatttagagtatacatattgggtttgggggaagaggaagactgacggtcccccaggagttcaggagtctgtgccgaggtgcagctggtgcagtctggagcggaggtgaaaagcccgggagtctctgaaaatctcctgtaaggcttctggatacgacctttacaacttctggatcggctgggtgcgccagatgccggaaagcctggactggatggggatcgtctagtcctggtgactgtgataccagattacagcccgtcttaccaaggtccaggtccacagtctcagtcgacaagtccaagtcaggcaccgctacctcaactggatagcctagaacggcctacggacaccgtcatacgtacttactgtcgacgagtactagtcggaagtctaagtacgtagggtaacttagtttcgggagggggtaccctaggccgttacggggcctaacgggtaacccgttgggtaccgtaaccggttcgtacccgtacgtacgtccttaccgaccgtaacggccctaagtccggttaccgttaccccgtggacctacccgtcgtaccgaagtcgtactaccgtcgtcggggctacgtaccggg

SEQ ID NO: 158287 - DNA, 564 bp, Homo sapiens
  misc_feature: GYAE6OF01CU5GD.36.67.G01.1.454.CMB.1.raw
  modified_base (433)..(433): a, c, t, g, unknown or other
  misc_feature (433)..(433): n is a, c, g, or t
  modified_base (550)..(550): a, c, t, g, unknown or other
  misc_feature (550)..(550): n is a, c, g, or t
tcagtacgctgtctcacgaccggtgctcgatttagagtatacatattgggtttgggggaagaggaagactgacggtcccccaggagttcaggagtctgtgccgaggtgcagctggtgcattctggagcggaggtgaaaaagcccggggagtctctgaaaatctcctgtaaggcttctggatacacctttaccaacttctggatcggctgggtgcgccagatgcccgggaaagcctggactggagtggggatcgtctatcctggtgactctgactaccagatacagcccgtccttcaaggccaggtcaccatctcagtcgacaagtccatcagcaccgcctacctcactggagtacgcctgaacgcctcggacaccgccatatattactgtagcgagacagtaggaagctagtaggtggtaacttgtttggggngggggctgcgtcgggcacgggaccctggtcaccgtctcctcgacgcctccgacaacggcccacgtccggtccttccccgtcggcccaccctcctccgaacgacgtccaccgtccggnggggccacggacgg

SEQ ID NO: 158288 - DNA, 651 bp, Homo sapiens
  misc_feature: GYAE6OF01DEWES.36.67.G01.1.454.CMB.1.raw
  modified_base (269)..(269): a, c, t, g, unknown or other
  misc_feature (269)..(269): n is a, c, g, or t
  modified_base (310)..(310): a, c, t, g, unknown or other
  misc_feature (310)..(310): n is a, c, g, or t
  modified_base (344)..(344): a, c, t, g, unknown or other
  misc_feature (344)..(344): n is a, c, g, or t
tcagtacgctgtctcacgaccggtgctcgatttagagtatacatattgggtttggggggaagaggaagactgacggtccccccaggagttcaggagtctgtgccgaggtgcagctggtgcagtctggagcggaggtgaaaaagcccggggagtctctgaaaatctcctgtaaggcttctggatacacctttaccaacttctggatcggctgggtgcgccagatcgcccgggaaaggcctggactggatggggatcgtctatccgtggtnactctgataccagatacagcccgtctcaagcagtcacatcncagtcgacaagtccatcacgccaccgtcctaccnccactggagtacgcctagacggcctacggaccacccgcacttatacttacgtgtcgcgagacagtaggaagactataggtagggtaacgttaggttttaggggtcggggggtccgtgggcggtcgggggtaccgaacggggtaacccgtcgggtaccgtacccggttccgtccgtccgtaccgccctacccgaaccgtaaccgggaccccgtacgtcccggttcccttcccccgtcggtacccctaccccgtcccgtacccgtaacgacgtacctacccgtcggtacgggggccctacggacccggg

SEQ ID NO: 158289 - DNA, 742 bp, Homo sapiens
  misc_feature: GYAE6OF01C1H00.36.67.G01.1.454.CMB.1.raw
tcagtacgctgtctcacgaccggtgctcgatttagagtatacatattgggtttgggggaagaggaagactgacggtcccccaggagttcaggagtctgtgccgaggtgcagctggtgcagtctggagcggaggtgaaaaagcccggggagtctctgaaaatctcctgtaaggcttctggatacacctttaccaacttctggatcggctgggtgcgccagatcggacccgggaaagcctggactggagtggggatcgtctatccgtggtgactctgactaccagactacacgcccgtccttccgaaggccaggtccaccatctcagtcgacaagtccatcagccaccgcctaccgtccacgtcggaacgtacgcctacggaacggtccctaccgggaacacccgcctaattaacttacttaccgtggtacgaccgaaggaacctaggttacgggaaacgtcgttaagttaaggttacggggtaaacgtttagggttttcgggggtcggggggtccctgggtccggtacgggggacccgaacggggtaaccccgttgggtacccgtacccggttccgtaccccgtaccgtaaccggtccccttacccgaacccggaaaccggggtcccctacggttccccgggttaccccttccccccggtcgggtacccctaccccgttccccgtacccgaaaccgaccgtcccgtaacccgtccgggtccgggggaccctaccggacccggg

SEQ ID NO: 158290 - DNA, 509 bp, Homo sapiens
  misc_feature: GYAE6OF01AVXF3.36.67.G01.1.454.CMB.1.raw
  modified_base (395)..(395): a, c, t, g, unknown or other
  misc_feature (395)..(395): n is a, c, g, or t
  modified_base (428)..(428): a, c, t, g, unknown or other
  misc_feature (428)..(428): n is a, c, g, or t
tcagtacgctgtctcacgaccggtgctcgatttagagtatacatattgggtttgggggcagaagtctctctcagtcaggacacagcatggacatgagggtccctgctcagctcctgggactcctgctgctctggctcccagataccagatgtgacatccagatgacccagtttccatcctccctgtctgcatctgtaggagacagagtcaccatcacttggccgggcagtcagggcattaacaatcatttagcctggtatcagcagaaaccagggaaagctcctaagctcctgatatatgctgtattcactgtgcaatcagggtcccatctcggtcagtgcagtgatagtgggacgtattcactctcaccatcagcagcctgcacgcctagaagntgttgactaactttattattgtaactaaaagtntacgactagtccgccccgtatcgtaccgtttcgggacgggtacgggacccgtaagggtaggaagtacgtacgtaaaaccgg

SEQ ID NO: 158291 - DNA, 563 bp, Homo sapiens
  misc_feature: GYAE6OF01BS4O7.36.67.G01.1.454.CMB.1.raw
  modified_base (520)..(520): a, c, t, g, unknown or other
  misc_feature (520)..(520): n is a, c, g, or t
tcagtacgctgtctcacgaccggtgctcgatttagagtatacatattgggtttgggggaagaggaagactgacggtcaccccaggagttcaggagtctgtgccgaggtgcagctggtgcagtctggagcggaggtgaaaaagcccggggagtctctgaaaatctcctgtaaggcttctggatacacctttaccaacttctggatcggctgggtgcgccagatgcccgggaaaggcctggactggatggggatcgtctatcctggtgactctgataccagatacagcccgtccttccaaggccaggtcaccatctcagtcgacaagtccatcagcaccgcctacctccactggagtagcctgaaggcctcggacaccgccatatattactgtgcgagacatggaagctatagtgggaacttagtttgggtggggggcgtgcgtgggccgagggacccgtggtcaccgtctcctcacgcctccaccaacgggcccacgtccggtcccttcccccgtggcccncccctccctcccgaacgacgaccaccctcgtcggggctaccgg

SEQ ID NO: 158292 - DNA, 684 bp, Homo sapiens
  misc_feature: GYAE6OF01ALJQQ.36.67.G01.1.454.CMB.1.raw
tcagtacgctgtctcacgaccggtgctcgatttagagtatacatattgggtttggggggaagaggaagactgacggtccccccaggagttcaggagtctgtgccgaggtgcagctggtgcagtctggagcggaggtgaaaaagcccggggagtctctgaaaatctcctgtaaggcttctggatacacctttaccaacttctggatcggctgggtgcgccagatcgcccgggaaaggcctggactggagtggggatcggtctatccgtggtcgactctgactaccagatacacgccccgtccttaccgaaggccaggtccacctatcctcagtcgacaacgtccatcagccaccgcctacctcacgtggactacgctaggaacgcctcggaccaccgcagtacttacttacgtgtcgacgacgacagtggaagctaagtaggtacggtaacgtttaggttttcggggtacggggggtcctggtcggtacgggggaccgtacggggtaaccccgttcgggtaccgtacccggttccgtcccgtcgtaaccgtccctacccgacccgaaccgggtcccctacggttccccggttaccctttcccccgtccggtcccctacccccgttccctaacccgaacgtcccgtacctaccccgttccgggtaccggggccaccggtacccggg

SEQ ID NO: 158293 - DNA, 538 bp, Homo sapiens
  misc_feature: GYAE6OF01DV3Y0.36.67.G01.1.454.CMB.1.raw
  modified_base (201)..(201): a, c, t, g, unknown or other
  misc_feature (201)..(201): n is a, c, g, or t
tcagtacgctgtctcacgaccggtgctcgatttagagtatacatattgggtttgggggcagaagtctctctcagtcaggacacagcatggacatgagggtccctgctcagctcctgggactcctgctgctctggctcccagataccagatgtgacatccagatgacccagtttccatcctccctgtctgcatctgtagganacagagtcaccatcacttggccgggcgagtcagggcaattaacaatcatttagcctggtatcagcagaaaccaggaaagctacctaagctcctgatatatgctgtattcactgtgcaatcgacgggtcccatcgtcggtcaggtggctagtggatagtgggacgtatttcactctcactatcagcagcctgccagcctagaagtagttgttgacttaactttattagtttagtactaaaaggttatacgaacgtaggtccgccccgtacttcgttaccggtttccgggacgggaacgggtaccgtaaaggggtgaaacgtacgtaaccgtaaaacgg

SEQ ID NO: 158294 - DNA, 660 bp, Homo sapiens
  misc_feature: GYAE6OF01CGSYY.36.67.G01.1.454.CMB.1.raw
tcagtacgctgtctcacgaccggtgctcgatttagagtatacatattgggtttgggggaagaggaagactgacggtccccccaggagttcaggagtctgtgccgaggtgcagctggtgcattctggagcggaggtgaaaaagcccggggatctctgaaaatctcctgtaaggcttctggatacacctttaccaacttctggatcggctgggtgcgccagatgcccgggaaagcctggactggatggggatcgtctatccgtggtgactctgataccagatacgacgtcccgtccttaccgaacggccaaggtccaccatctcagtcgaactagtccatcagccacccgtcctacctccactggatacgcctaggaacggcctacggaccaccgcataatattactgtcgacgagacatggaagctaagtagtaggtaacttggttttggggtcggggggtcctggtcgtcggggaccgtaacgggtaacccgttggtacccgtaccgttcccgtacccgtccgaccgtcccttacccgaaccgaaccgggcccctaacgttcccggttaccccgttcccccgtccggtacccctaccccttcccacccgaacgtaccgtacccgtaacccgtcgggttacggggccctaccggacccggg

SEQ ID NO: 158295 - DNA, 602 bp, Homo sapiens
  misc_feature: GYAE6OF01AEAF5.36.67.G01.1.454.CMB.1.raw
  modified_base (220)..(220): a, c, t, g, unknown or other
  misc_feature (220)..(220): n is a, c, g, or t
  modified_base (357)..(357): a, c, t, g, unknown or other
  misc_feature (357)..(357): n is a, c, g, or t
  modified_base (431)..(431): a, c, t, g, unknown or other
  misc_feature (431)..(431): n is a, c, g, or t
tcagtacgctgtctcacgaccggtgctcgatttagagtatacatattgggtttgggggggaagaggaagactgacggtccccccaggagttcaggagtctgtgccgagggtcgcagctggtgcagtctggagcggaggtgaaaaagcccgggggagtctctgaaaatctcctgtaaggcttctggataccacctttaccaacttctggatcggctgggtncgccagatgacccgggaaaggcctggactggatggggatcggtctatccgtggtgactctgactaccagaattacagtccccgttcttaccgaaggccaagggtccaacccactctcacgtcgaacagtccatcacncaccgcctacctccacgtggactacgcctagaacggcctcggacaccgcatagtatctgtgcgagacatagganctagtaggtggtaacttagtttggggtgggggtcctggtccgtggggcctagggtaccctggtccaccggtctccgtcacgtccctccgtacgacggcccgtacgtccggtcccttcccgtcggccctaccctcccaccgaacgcgcctacccgtcgcgggcacgtccggg

SEQ ID NO: 158296 - DNA, 708 bp, Homo sapiens
  misc_feature: GYAE6OF01EK0W2.36.67.G01.1.454.CMB.1.raw
tcagtacgctgtctcacgaccggtgctcgatttagagtatacatattgggtttgggctcaaccgccatcctcgccctcctcctggctgttcgtccaaggagtctgtgccgaggtgcagctggtgcagtctggagcggaggtagaaaaagcccggggagtctctagaaaatctcctgtaaggcttctggatacacctttaccaacttctggatcggctggggtgcgccagatcggacccgggaaaggcctggactggagtggggatcgtctatcctggtgactctgataccagatacacgccccgtccttccaaggccaggtccaccatctcagtcgacaagtccatcacgccaccgccctaccctccacgtggagtacgccgtaggaacggccctcgggaccacccgacctatacttattacgtgtcgacgaagacagtaggaagtactaagtacggtagggtaaactttaggttttggggtcggggggtacctgggtcggtcggggacccgtaacggggtaccccgttgggttacccgtaccggttccttcccgtcgacccgtccccgtaccccgaaacccggaacccggggtaccccctaacgggtttccccgggttaccccctttcccccccggtaccgggtacccccctaaccccccgttcccccgttaacccgaaaccggacccgtaccccgtaacccccggg

SEQ ID NO: 158297 - DNA, 573 bp, Homo sapiens
  misc_feature: GYAE6OF01BNORV.36.67.G01.1.454.CMB.1.raw
tcagtacgctgtctcacgaccggtgctcgatttagagtatacatattgggtttggggggaagaggaagactgacggtccccccaggagttcaggagtctgtgccgaggtgcagctggtgcagtctggagcggaggtgaaaaagcccggggagtctctgaaaatctcctgtaaggcttctggatacacctttaccaacttctggatcggctgggtgcgccagatgcccgggaaaggcctggactggatggggatcgtctatcctggtgactctgataccagatacagcccgtccttccaaggccaggtcaccatctcagtcgacaagtccatcagcaccgcctacctccactggatagcctgaacggcctacgggacaccgccatatattactgtgcgagacatggaagctatagtgggaacttagtttgggtgggggtcctggcgtggggcagggaccctgggtccaccgtctccctcacgccctccaccgaacgggcccagtccggtccttcccccgtggcccaccctcccgtaccgaacgacgtccacccgtccgtggggcccacgaccgg

SEQ ID NO: 158298 - DNA, 839 bp, Homo sapiens
  misc_feature: GYAE6OF01DGRP4.36.67.G01.1.454.CMB.1.raw
tcagtacgctgtctcacgaccggtgctcgatttagagtatacatagttggggtttgggctcaaccgccatcctcgccctcctcctggctgttcctccaaggagtctgtgccgaggtgcagctggtgcagtctggagcggaggtaggaaaaaggcccggggagtctctgaaaatctcctgtaaggcttctggatacctacctttaaccaacgttctggactcggcgtgggtcgcgccagagtcggaccgggaaagtcctaggactgggagtgggactcgtactagtccgtaggtcgactcgtacgactaccagtactaccgacgtccccgtacgttaccgaacggtccgacgttccaccgtactccgtactaaccgtaccgaactaacggtcctactaccgacggaccacccggtcccgttaacccgtaccgtaacgttacgggacgttacggccgttacggaaccgggtccgtacccggaaaccacccggtactaacttacgttacgttacgtcggtacgacgtacgtaaccgtagttaacgggtaactaccgttaaggttaacgggttacgggtaaaccggttttagggttttacggggggtacgggggggttccttacgggtacccgggtttccgggggaacccgggttaccggggtaaccccgtttccggggtacccggttaacccggtccgttacccggtaccgtaccgggtaccccttacccggaacccggtaaccgggcccgttacggttaccccggttccccgttacccccgccgggtacccctaccccgttacccgtaccgtaaacccggttccgacccgttaccccgggg

SEQ ID NO: 158299 - DNA, 646 bp, Homo sapiens
  misc_feature: GYAE6OF01CZFRH.36.67.G01.1.454.CMB.1.raw
  modified_base (327)..(327): a, c, t, g, unknown or other
  misc_feature (327)..(327): n is a, c, g, or t
  modified_base (360)..(360): a, c, t, g, unknown or other
  misc_feature (360)..(360): n is a, c, g, or t
  modified_base (420)..(420): a, c, t, g, unknown or other
  misc_feature (420)..(420): n is a, c, g, or t
tcagtacgctgtctcacgaccggtgctcgatttagagtatacatattgggtttggggggaagaggaagactgacggtccccccaggagttcaggagtctgtgccgaggtgcagctggtgcattctggagcggaggtgaaaaagcccgggggagtctctgaaaatctcctgtaaggcttctggatacaccttttaccaacttctggatcggctgggtgcgccagatcgcccgggaaaggcctggactggagtggggatcgtctatccgtggtcgactctgactaccagatacacgccctccttccaaggcctaggtccacactcctanagtcgacaacgtccatcacgccaccgcctaccnccacgtcggagtacgcctaggaacggccgtacggacacccgactatactacgttactcgngacgagacagtaggaagtctaagtaggtaggtaacgtttaggtttcggggtgggggtcctcggcggtcggggaccgacgggtaacccttggtacctaccggttcctccgtacgacgacccttaccgacccgtaacggccccgtacgttcccggtcccttccccgtcggccctaccccgtccctaccgaacgaccgcccgtaccgtcggacggggccacgacccggg

SEQ ID NO: 158300 - DNA, 562 bp, Homo sapiens
  misc_feature: GYAE6OF01AS386.36.67.G01.1.454.CMB.1.raw
  modified_base (200)..(200): a, c, t, g, unknown or other
  misc_feature (200)..(200): n is a, c, g, or t
  modified_base (226)..(226): a, c, t, g, unknown or other
  misc_feature (226)..(226): n is a, c, g, or t
  modified_base (283)..(283): a, c, t, g, unknown or other
  misc_feature (283)..(283): n is a, c, g, or t
  modified_base (359)..(359): a, c, t, g, unknown or other
  misc_feature (359)..(359): n is a, c, g, or t
tcagtacgctgtctcacgaccggtgctcgatttagagtatacatattgggtttgggggcagaagtctctctcagtcaggacacagcatggacatgagggtccctgctcagctcctgggactcctgctgctctggctcccagataccagatgtgacatccagatgacccagtttccatcctccctgtctgcatctgtaganacagagtcaccatcacttggccgggnagtcgagggcaattaacaatcatttagcctaggtatcagcaagaaccgaagggaacnctacctaagctacctgatatatgcttgtattcactgtgacaagtcgacggggtccctatcgtcggttcaggtcggntagtggagtagtgggtacggtattaccgtactcctacacatcgagcacgcctgcacgtccgtagaagtacgtaggttacgtactaactttagttacgtttaacggtaactaaaagttacgtagtacgtacgttaccgccccgttactccgttacggttacgggacgggacggaacgggtagacggagtagtaacgtaaacggg

SEQ ID NO: 158301 - DNA, 718 bp, Homo sapiens
  misc_feature: GYAE6OF01ANSNU.36.67.G01.1.454.CMB.1.raw
  modified_base (334)..(334): a, c, t, g, unknown or other
  misc_feature (334)..(334): n is a, c, g, or t
tcagtacgctgtctcacgaccggtgctcgatttagagtatacatattgggtttgggggcagaagtctctctcagtcaggacacagcatggacatgagggtccctgctcagctcctgggactcctgctgctctggctcccagataccagatgtgacatccagatgacccacgtttcctactccctccctcgtctgcatctgtaggagacagagtcaccactctacgttcggccgggcgagtcgagggcgattaacaatctatttagcctagtatcagcacgaaaccgaggaaacgctacctaagcctctcgatatatgtctgttattcactgtcnctatcgacgggtcccactcgttcggttcagtggcagggtgagtagtaggggtacggtacgtttacaccgtcctccgaccaacttcgaacgtcccgaacggtccctcgtacccgacgtacccgtaggtaaacggttattaccggtttacggtacctttaaaacctttttaacgttttaacgtttaacgggttaaaccctaaaaaagggtttacgttacggtaaaccccgttaacgggttcccccggtaccccccgggttaccccttaaccggtttaccccggttttaacccggggggaccggggtaaacccgggggttaaaccccgggttaaacggggtaaccgggggtaaacgtaaaccgggttaccccgtaaaaaacccgggg

SEQ ID NO: 158302 - DNA, 173 bp, Homo sapiens; identical to SEQ ID NO: 158270
  misc_feature: GYAE6OF01A6RDL.36.67.G01.1.454.CMB.1.raw
  modified_base (173)..(173): a, c, t, g, unknown or other
  misc_feature (173)..(173): n is a, c, g, or t

SEQ ID NO: 158303 - DNA, 701 bp, Homo sapiens
  misc_feature: GYAE6OF01B8MKU.36.67.G01.1.454.CMB.1.raw
  modified_base (273)..(273): a, c, t, g, unknown or other
  misc_feature (273)..(273): n is a, c, g, or t
  modified_base (277)..(277): a, c, t, g, unknown or other
  misc_feature (277)..(277): n is a, c, g, or t
tcagtacgctgtctcacgaccggtgctcgatttagagtatacatattgggtttggggggaagaggaagactgacggtccccccaggagttcaggagtctgtgccgaggtgcagctggtgcattctggagcggaggtgaaaaagcccggggagtctctgaaaatctcctgtaaggcttctggatacaccctttaccaacttctggatcggctgggtgcgccagagtcggacccgggaaagcctggactggagtggggatcgtctatccgtggtnactntgataccagatacacgtcccgtccttaccgaacggccctaggtaccaaccctattcctacgtacgtaccgaactaacgtccaatcgaacgcccaacccgtccctaacctccgaccgtgggaacgtacgccgttaggaaaccggtcccgtaccggaacctacccgcctaataacttacttaacgtggtacgacgtagaacgagtaggaatacgttagttaaggtaggtaactttagggtttggggtcgggggtcctaggtcggtcggggaccggtaacgggtacccgtggtccgtaccgtcctccgtcaccgccaacccgaccgaaccggtccctacgttcccgtcccttcccccgtcggtacccacccccgttcgtacccaacggaccaccgttacccggcggtacggggccacggtacccggg

SEQ ID NO: 158304 - DNA, 733 bp, Homo sapiens
  misc_feature: GYAE6OF01CTSBB.36.67.G01.1.454.CMB.1.raw
  modified_base (308)..(308): a, c, t, g, unknown or other
  misc_feature (308)..(308): n is a, c, g, or t
tcagtacgctgtctcacgaccggtgctcgatttagagtatacatattgggtttggggcagaagtctctctcagtcaggacacagcatggacatgagggtccctgctcagctcctggactcctgctgctctggctcccagataccagatgtgacatccagatcgacccagtttccatcctcctgtctgcatctgtaggagacagtagtcaaccgatctaacgttcggaccgggacgtagtcgagggctaagttaaccaagtctaagttttacgcctggtactcgagacgaacgtaaaccgagggaaacnccgtacctaaagccttaccgttagtaacttaagttattacggtacttacggttaacttcctaaccgtttaggttacgaacgttaaacgttcccggtaacgggggttacccctaacgttccggttaccgggtttaccgaaggtttccggagtaacggttacgggtagttaacgggttacggggtaaccgggttaactttttaccgaccgttaccttaccgtaaccgtaacgttacgtaacgcgtaccgtacccgttacgaccgtacgaccgttacggaagttacgttgttacgtaacttaactttagttacgttaagtacgtaaagttatacgtaccgtacgtcccgtacccgttactacgttccggtttaccgggacggttaacgggtaccgaagggttacggaaacgtacgttaacgtaaacgg

SEQ ID NO: 158305 - DNA, 716 bp, Homo sapiens
  misc_feature: GYAE6OF01EEKRS.36.67.G01.1.454.CMB.1.raw
  modified_base (283)..(283): a, c, t, g, unknown or other
  misc_feature (283)..(283): n is a, c, g, or t
tcagtacgctgtctcacgaccggtgctcgatttagagtatacatattgggtttgggctcaaccgccatcctcgccctcctcctggctgttctccaaggagtctgtgccgaggtgcagctggtgcagtctggagcggaggtagaaaaggcccggggagtctctagaaatctcctgtaaggtcttctggatactacctttaccaacttcgtgagtcggcgtgggtgcgcagagtcggaccgggaaagccgtggacgtggagtggggatcgtctacgtccgtggtnactctgtaactaccagtactacgaccggtccccgttccttaccgaacggccgtacggttaccaacctactctacgtacgtacgaactacgtccatacgacgccgaccgtacctacctaccgacgttggacgttacgccgtacggaaccgtcccgtacggaaccacccgtactaacttaacgtttactacgtggtacgacgaagaactggtaaggaactagttaagttagggtacggttacgtttaggttttggggggcggggtccctgggtccggtacgggggaccctacggggaccgttcggacccgttaccggtccttccgtacgacccgttccctaaccgaaccggaccggtccctacggttcccggttccccgttcccccgtcgggacccctcccgttaccgaacccgtacggccgtcccgtacccggg

SEQ ID NO: 158306 - DNA, 603 bp, Homo sapiens
  misc_feature: GYAE6OF01A4CMN.36.67.G01.1.454.CMB.1.raw
  modified_base (231)..(231): a, c, t, g, unknown or other
  misc_feature (231)..(231): n is a, c, g, or t
  modified_base (287)..(287): a, c, t, g, unknown or other
  misc_feature (287)..(287): n is a, c, g, or t
  modified_base (440)..(440): a, c, t, g, unknown or other
  misc_feature (440)..(440): n is a, c, g, or t
tcagtacgctgtctcacgaccggtgctcgatttagagtatacatattgggtttgggggcagaagtctctctcagtcaggacacagcatggacatgagggtccctgctcagctcctgggactcctgctgctctggctcccagactaccagatgtgacatccagatcgaccctagtttccatccctccctgtctgcatctgtaggagacagactcaccatcacttggccgggnagtcaggacaattaacatcatttacgcctggtatcagcaacgaaaccgagggaacncctactaagctacctgtaactatatgtactagttactcatgtgactaagtcgacgggtcccagttcgtcggttcaggtcggactaggtgatagtacgggtacgtattaccacttcgtaccactatcagtcaacgtcctaggccacgctaagangttagtaccgtattaaccgtttatttacgtagttaacgtaaagtcttacgtaacgcggttccgccccgttcgttaaccgttaccgggtttaccggggaacccgggtaacggggtaacccgttaaaggggtacggtaacgtaaaccgttaccggtaaaaaccgg

SEQ ID NO: 158307 - DNA, 752 bp, Homo sapiens
  misc_feature: GYAE6OF01D6ENC.36.67.G01.1.454.CMB.1.raw
tcagtacgctgtctcacgaccggtgctcgatttagagtatacatattgggtttgggctcaaccgccatcctcgccctcctcctggctgttctccaaggagtctgtgccgaggtgcagctggtgcagtcgtggagcggaggtagaaaacggcccggggagtctctagaaatctctagtaagtcttcgtggactacctacctttacctacttcgtggtatcggtcgtgggtcgcgcagagtcggaccgggaacggcgtaggacgtggagtgggtactcgtctacgtcgtggtcgtctctgtaactacgaacggtacaccgtccggtccccgttaccgttaccgaacggtaccgtacggtaccacctacttccgacgtacgtacgaactacgtcctacgtcacgaccctaccgtaccctaccgtaccgacgtacggacgtacgccggtaacggaccggtccgtaccggaaccacccgtactaattacttacgttacgtggacgacggtaagactaaggtaggtaacgtacgttaaggtagggttacgggttacgttttaggggttccgggggacggggtcctggggtaccgggtccggggaacccggtacgggtaccggttccggtacccgttacccgttcctacccgacgacccgtccccggaaccgaaccggaccccgggtcttacccggttccccggtacccctttccccggactacccctaccccgtagacccgaggcccgtccgtccggg

SEQ ID NO: 158308 - DNA, 644 bp, Homo sapiens
  misc_feature: GYAE6OF01E1DHJ.36.67.G01.1.454.CMB.1.raw
  modified_base (222)..(222): a, c, t, g, unknown or other
  misc_feature (222)..(222): n is a, c, g, or t
  modified_base (324)..(324): a, c, t, g, unknown or other
  misc_feature (324)..(324): n is a, c, g, or t
  modified_base (356)..(356): a, c, t, g, unknown or other
  misc_feature (356)..(356): n is a, c, g, or t
tcagtacgctgtctcacgaccggtgctcgatttagagtatacatattgggtttgggggggaagaggaagactgacggtccccccaggagttcaggagtctgtgccgaggtgcagctggtgcattctggagcggaggtgaaaaagcccggggagtctctgaaaatctcctgtaaggcttctggatactacctttaccaacttctggatcggctgggtgcgccngatgcccgggaaaggcctggactggatggggatcgtctatccgtggtcgactctgataccagactacacgccccgtccttccaaggcccaggtccaccatcncagtcacaagtccatcagccacccgcctaccnccacgtggacgtacgcctagaacggcctcggaccaccgcatacttacttactgtcgcgagacagtcggaagtcttaagtaaggtcgggtaacgtttaggttttcgggggtcgggggggtcctggacgtcgggggccgaacggggtacccttgggtacccacccggtcctcccgtacacggtccctacccgacccgaacgggtcccagttcccggtcccttcccccgtcggtccctaccccttcccacccaacggacgtacctacccgtggtccggggcacggtaccgg

SEQ ID NO: 158309 - DNA, 683 bp, Homo sapiens
  misc_feature: GYAE6OF01AIFTG.36.67.G01.1.454.CMB.1.raw
tcagtacgctgtctcacgaccggtgctcgatttagagtatacatattgggtttggggggaagaggaagactgacggtccccccaggagttcaggagtctgtgccgaggtgcagctggtgcattctggagcggaggtgaaaaagcccgggggagtctctgaaaatctcctgtaaggcttctggatacacctttaccaacttctggatcggctgggtgcgccagatgcccgggaaaggcctggactggatggggatcgtctatcctggtgactctgataccagatacagcccgtcttccgaaggccaggtcaccatctcagtcacaacgtccatcagccacccgcctaccctccacgtggacgtacgcctggaacggccctacggaccaccgccatatattactgtgacgagacagtaggaacgctagtaggtaggtaacgttaggttttggggtcggggggtcctggtcggtcggggaccgacggggtaacccgtgggtacccgtacccggttccgtcccgtccgaccggtcccctacccgaacccgaaccggggcccctacggttccccgggttcccctttccccccggtcgggtccccctacccccgttccccgttacccgaacggtacccgtacccgttacccggttcccggtacggggggtcccaacgggtaccccgggg

SEQ ID NO: 158310 - DNA, 660 bp, Homo sapiens
  misc_feature: GYAE6OF01CLPNC.36.67.G01.1.454.CMB.1.raw
tcagtacgctgtctcacgaccggtgctcgatttagagtatacatattgggtttgggggcagaagtctctctcagtcaggacacagcatggacatgaggtccctgctcagctcctgggactcctgctgctctggctcccagataccagatgtgacatccagatcgacccagtttccatccctccctgtctgcatcgtgtaggagacagagtccaccatccacgttcggccgggcgaggtcgaggctaacttaacaatactaatttacgccgtaggttatacgagacaacggaaaaccgaagggaaacgtctaacctaaacgcctacctgaatatatgtcgtgtacttcactcgtgaactaacgtacggtacggggtaccctagtccgttacgggttcgtaggtacggctaagggtaggtagtacggtagggtaaccgtaagttacgttttacacgttaccctacgaacctagtccgtaagacctacggcctcggtacgaacgtccgttaagaacgttcgtagtttacggaacttttaaacttagtttaacgttattaaacgtaaaagtttacaaacgttcgtacccgtacccgttacttacgtacccggttacgggacgggtacggtacgtaacggtagaacggtacgtaaccgtaaacgg

SEQ ID NO: 158311 - DNA, 181 bp, Homo sapiens
  misc_feature: GYAE6OF01EK1OJ.36.67.G01.1.454.CMB.1.raw
  modified_base (181)..(181): a, c, t, g, unknown or other
  misc_feature (181)..(181): n is a, c, g, or t
tcagtacgctgtctcacgaccggtgctcgatttagagtatacatattgggtttgggttttggggggaagaggaagactgacggtcccccaggagttcaggtgctgggcacagcggccctgggctgcctggtcaaggactacttccagacagcgtactgagcgggctggcaaggcgcatagn

SEQ ID NO: 158312 - DNA, 596 bp, Homo sapiens
  misc_feature: GYAE6OF01CPFUO.36.67.G01.1.454.CMB.1.raw
  modified_base (200)..(200): a, c, t, g, unknown or other
  misc_feature (200)..(200): n is a, c, g, or t
  modified_base (226)..(226): a, c, t, g, unknown or other
  misc_feature (226)..(226): n is a, c, g, or t
  modified_base (283)..(283): a, c, t, g, unknown or other
  misc_feature (283)..(283): n is a, c, g, or t
tcagtacgctgtctcacgaccggtgctcgatttagagtatacatattgggtttgggggcagaagtctctctcagtcaggacacagcatggacatgagggtccctgctcagctcctgggactcctgctgctctggctcccagataccagatgtgacatccagatgacccagtttccatcctcctgtctgcatctgtagganacagagtcaccatcacttggccgggnagtcaggcaattaacaatctatttagcctggtatcagacaagaaaccgagggaaacnctaccgtaagcctaccgtagacttatatgtctgtacttctactgtgactaagtccgacgggtccctagtcgttcggttcaggtggacgtaggtagtatagtgggtacgtatttacactctacactatcgacgcacgccgtgacgacgtcctagaacgtgttagttacgtaaccttaacgtttaattacgtttacgtaacgtaaaagttactacgtaaccgtacggtacccgtccccgtactaccggttacggttccgggaccgggtaacggtaaccggtaagggtcggaaacgtaacgtaaccgtaaaaccgg

SEQ ID NO: 158313 - DNA, 749 bp, Homo sapiens
  misc_feature: GYAE6OF01D0J6M.36.67.G01.1.454.CMB.1.raw
  modified_base (314)..(314): a, c, t, g, unknown or other
  misc_feature (314)..(314): n is a, c, g, or t
tcagtacgctgtctcacgaccggtgctcgatttagagtatacatattgggtttgggggcagaagtctctctcagtcaggacacagcatggacatgagggtccctgctcagctcctgggactcctgctgctctggctcccagataccagatgtgacatccagatgacccctagtttccacttccctccctgtctgacatctggtaggagacagacgtcaaccatcacgtcggaccgggcgagtcgagggacaagttaaacaatactaatttacgccttaggtactacaggacaaacggaaaaccgagggtaaacnccgttacctaagcctaccgtagaataatagtacgtctagttacttcaaccgttggtactaccaaagttaccggtaacggggtacccctaagttccggttaccggttaccgtaggggtacggtaccgtagggttaagggtacgttaaacgggttgggggtaaccggttacgttttaccgtaccctttaacttaacccgtaaccctcgttaacccgaggtaccgtaccggtacccttcgacgtaccgtaccgtaaggaaattcgttacggttaacggtacttaaacgtttagttaagtttaacgtaacttaaaaggtactacgtaaacgtcggttaccccgtacccgtacttacccgttacgggtttacccggggaacgggttaacccgggtaaaccggaagggttacgggaaagtaccctaaacggtaaaacccgg

SEQ ID NO: 158314 - DNA, 786 bp, Homo sapiens
  misc_feature: GYAE6OF01BPJ8M.36.67.G01.1.454.CMB.1.raw
  modified_base (337)..(337): a, c, t, g, unknown or other
  misc_feature (337)..(337): n is a, c, g, or t
  modified_base (353)..(353): a, c, t, g, unknown or other
  misc_feature (353)..(353): n is a, c, g, or t
tcagtacgctgtctcacgaccggtgctcgatttagagtatacatattgggtttgggggaagaggaagactgacggtcccccaggagttcaggagtctgtgccgaggtgcagctggtgcagtctggagcggaggtagaaaaagcccggggagtctctagaaaatctcctgtaaggcttcgtggatacacctttaccaacttctggatcggcgtgggtcgccgccagagtcggacccgggaaaggcctggacgtggagtggggatcgtctatccgtggtgactctgactaccgagactacgacggtcccgtccttaccgaaggccaggtccaccactcncagtcgacacgtccancacgccacccgtcctacctccacgtggaacgtacgcctaggaacggcctcggaaccaccgacctaattaacttacgttaccgtggtacgacgtacgaactagtacggaagtcttaaggtagggtacgggttaaacgtttgggtttttacgggggcgggggtaccttacggggtaccggttacgggggacccgtaacgggggtaaaccccgttcgggttacccgtaacccgggttccctacccggttacccgacccggttaccccgttaaccccgaacccgggtaaccgggtcccctaaccgggtttccccggttacccccgttaccccccgggttccggacccccttacccccgtccccggtaacccgaaacggtaccccggtacccgtacccggttcccggggtacgggggaccctaccgggtaccccgggg

SEQ ID NO: 158315 - DNA, 580 bp, Homo sapiens
  misc_feature: GYAE6OF01ESD3H.36.67.G01.1.454.CMB.1.raw
  modified_base (452)..(452): a, c, t, g, unknown or other
  misc_feature (452)..(452): n is a, c, g, or t
tcagtacgctgtctcacgaccggtgctcgatttagagtatacatattgggtttgggggcagaagtctctctcagtcaggacacagcatggacatgagggtccctgctcagctcctgggactcctgctgctctggctcccagataccagatgtgacatccagatgacccagtttccatcctccctgtctgcatctgtaggagacagagtcaccatcacttcgccgggcgagtcgagggcaattaacaatctatttagcctggtatcgagacaacgaaccgaagggaacgcctaccgtaagcctacctgtatatatgtctgtattcactgtgacacggtccggggtcctagtcgtcggttcaggtcggacgaggtgtagtagtggacgtagtagttacacttctacctacgattacgacgcacgtcctagcacgtcctagaacgtgttaggtanacgttaactttattacttagtaacgtaaagtactaaaccgtcggtaccgtcccgtacctacgttaccggttcgggaccgggtacgggaccggtaagggtagaacggtaactaacgtaaacggtaacgg

SEQ ID NO: 158316 - DNA, 848 bp, Homo sapiens
  misc_feature: GYAE6OF01AWLYQ.36.67.G01.1.454.CMB.1.raw
tcagtacgctgtctcacgaccggtgctcgatttagagtatacatattgggtttggggggaagaggaagactgacggtcccccaggagttcaggagtctgtgccgaggtgcagctggtgcattctggagcggaggtgaaaaagcccggggagtctctgaaatctcctgtaaggcttctggatactacctttaccaacttctggatcggctgggtgcgccagatcggacccgggaagcctggactggatggggatcgtctatccgtggtgactctgataccgagactacacgtcccgtccttaccgaaggccaggtccaccgtatctacagtcgacaagtccatcacgaccaccgtccctaacctccgacgtggaacgtacgccgtaggaaccggcccgttaccgggaaccctaacccggtcctaacgtttaacttaacgtttaaccgtaggttacgggaacccggtaagaacgtacggttaacgggaacgttaacgttaaggttaaacggggttacggggttaaaacgttttaacgggtttttacggggggttaccggggggggttacccttcggggtaccgggttaccggggggtaacccggtaaccgggggtaaaccccgttcggggttaccccgtaacccggtttcccgttaccccgtacccgtaacccggtaccccgtacccggaacccggtaaccgggtacccccggtacgttaccccgggttcccccgtttacccccccggtccggttacccccgtacccccgttccccgttacccggtaaaccggaccgtaccccgtaacccggttaccggtccggggggtacccacccgggtaccccgggg

SEQ ID NO: 158317 - DNA, 686 bp, Homo sapiens
  misc_feature: GYAE6OF01B93F5.36.67.G01.1.454.CMB.1.raw
tcagtacgctgtctcacgaccggtgctcgatttagagtatacatattgggtttggggggaagaggaagactgacggtccccccaggagttcaggagtctgtgccgaggtgcagctggtgcattctggagcggaggtgaaaaagcccggggagtctctgaaaatctcctgtaaggcttctggatacacctttaccaacttctggatcggctgggtgcgccagatcggcccgggaaagcctggactggagtggggatcgtctatcctggtgactctgatacagatacacgcccgttccttaccgaaggccaggtccaccatcctcagtcgacaacgtccatcacgccaccgccctacctccacgtggagtacgccgtaggaacggcctacgggaccaaccgccataattacttacgtgtgacgagacagtggaagctagtacgtagggtaacgttaggttttggggtcggggggtcctggtcggtacggggcccggtaacgggacccgttcgggtccgtacccgttccgttcccgtaccgcggtacccctaccgaacccggtaaccggccccgtaacgttcccgggttaccccgtttcccccgtcgggcccctacccccgtccccgtacccgtaacggacccgtccctaacccgtccggttccgggggcccgtacccggtacccgggg

SEQ ID NO: 158318 - DNA, 711 bp, Homo sapiens
  misc_feature: GYAE6OF01CGFE4.36.67.G01.1.454.CMB.1.raw
  modified_base (145)..(145): a, c, t, g, unknown or other
  misc_feature (145)..(145): n is a, c, g, or t
  modified_base (156)..(156): a, c, t, g, unknown or other
  misc_feature (156)..(156): n is a, c, g, or t
  modified_base (214)..(214): a, c, t, g, unknown or other
  misc_feature (214)..(214): n is a, c, g, or t
  modified_base (433)..(433): a, c, t, g, unknown or other
  misc_feature (433)..(433): n is a, c, g, or t
tcagtacgctgtctcacgaccggtgctcgatttagagtatacatattggggtttgggggcagaagtctctctcagtcaggacacagcatggacatggacgggtccctgctcagctccgtgggactcctgctgctctggcctccanataccagatgngacataccagactcgaccctagtttccactccgtccctagtctgcatcgtaggagganacgagactcaacctatacgtacgttcgggacccggagacgtacggacggtactaaacttaacaattactaagttacgaccgttagtacacgacgaaccgaaacggaaacggaaggtaactaccttaccgaacgtcctacgtataactatagtacgtacttagtacttacgactagttacgaacgtaacgtcggacgggtacctcgttacgttccggtanaggtacgatagggtaggtacgtaagggtaggtacgttaccttcgtaaccttcctaacgtaaccactacgtacgtaccggacttacccgacgaccgtaacgttacgtaacggtaagtccgtttaagttaccggttaacctttaaagttagtttaacgtaacgtaaagtaaacgttacgtaacgtaccgtacggttaccccgcccgtaagttaccggtaccgggttacggacgggtaaacgggtaccgaaagggttacgaactaacggtaaacgtaacgg

SEQ ID NO: 158319 - DNA, 588 bp, Homo sapiens
  misc_feature: GYAE6OF01D0IA0.36.67.G01.1.454.CMB.1.raw
  modified_base (293)..(293): a, c, t, g, unknown or other
  misc_feature (293)..(293): n is a, c, g, or t
  modified_base (305)..(305): a, c, t, g, unknown or other
  misc_feature (305)..(305): n is a, c, g, or t
  modified_base (312)..(312): a, c, t, g, unknown or other
  misc_feature (312)..(312): n is a, c, g, or t
  modified_base (408)..(408): a, c, t, g, unknown or other
  misc_feature (408)..(408): n is a, c, g, or t
tcagtacgctgtctcacgaccggtgctcgatttagagtatacatattgggtttgggggcagaagtctctctcagtcaggacacagcatggacatgagggtccctgctcagctcctgggactcctgctgctctggcctcccagactaccagatgtgacatccagatgaccctagtttccatccctccctgtctgcatctggtagagacagacgtccaccactcacgttcggccgggcgagtcgagggcaattaacaatctatttagcctagtatcagacaacgaaacgaggaanctactagctctnatatatntctgtattcagtgtgacagtccgacgggtccctagttcgtcgtgagtcggatggtagtagtaagcgggacgttacttcactactcaccatcgaacncgacgtcctgaccgtcgtacctagagtattcggttacgtacttaatttagttaattagtaactaaagtactacgacgtcgtcccggtcccgtaccgttacgttaccgggttaccgggacggggtaaacccgggtaaacggaacgggtagggtaaacgtacgtaaaccggtaaaacccggg

SEQ ID NO: 158320 - DNA, 666 bp, Homo sapiens
  misc_feature: GYAE6OF01A0UT0.36.67.G01.1.454.CMB.1.raw
tcagtacgctgtctcacgaccggtgctcgatttagagtatacatattgggtttgggctcaaccgccatcctcgccctcctcctggctgttctccaaggagtctgtgccgaggtgcagctggtgcagtctggagcggaggtgaaaaagcccggggagtctctgaaaatctcctgtaaggcttctggatacacctttaccaacttctggatcggctgggtgcgccagatgcccgggaaaggcctggacgtggatggggatcggtctatcctggtgactctgataccagaataaacgcccgtccttaccaaggccaggtccaccatctcagtcgacaacgtccatcagccaccgcctacctccactggacgtacgcctcgaacggcccgtacggacacccgactaattaacttacttacttgtcgacgaagaaataggaagtacgtaagtaggtagggtaacgttggtttagggtggggggtaccgtgggtcggtcggggtccggtaacgggtaaccggtcgggttaccgtacccggttccgtccctcgtaccgtccgtacccgaaccgaaccgggccccgtaacggtcccggttaccccgttccccgtcccggaccctaccccgttaccctacccgaacgaccgtacccgtaccgtccggtaccgggg

SEQ ID NO: 158321 - DNA, 750 bp, Homo sapiens
  misc_feature: GYAE6OF01AGE66.36.67.G01.1.454.CMB.1.raw
  modified_base (166)..(166): a, c, t, g, unknown or other
  misc_feature (166)..(166): n is a, c, g, or t
  modified_base (524)..(524): a, c, t, g, unknown or other
  misc_feature (524)..(524): n is a, c, g, or t
tcagtacgctgtctcacgaccggtgctcgatttagagtatacatagttggggtttgggggcagaagtctctctcagtcaggacacagcatggacatggacgggtccctgctcagtcctccgtgggactcctgctgctcgtggcctacccagactaccagtatggtnacatccgagatcgacctagtttccactccctccgtgtctcgctactcgtaggacggacacgacgactaccacctactcgtaccgttacgggcccgggtagacgtacggacggtacaattaaccgtatacctagttccgccgtagactacgacgacgtaacgaaaccggaggaactcctaccgtaacgtccgttacctaaggttaattacttacggtaccttagtacgtttactaccgttaagtcgtaacgacgtaaccgtccgggaaccggttcctacgttcgttacgggtatcgggtaacgtgtagggtacgtaagtcggtacgggtacttccgttaccacgttaccacgtaacctntaccgacgggtacctccggtaccgtgaaccgtcgtaacggaacgtaacgttagtttacggaactttaaccgttaaatttcgttaagttaacggtaacaaggttacctacgggtaccgtaccgttaccccggttaccgttccggttaaccggttcccgggttacgggggacccggaaaccgggttaacggaccgggtaaaggacccttaaaggaaccgttaacgggg

SEQ ID NO: 158322 - DNA, 628 bp, Homo sapiens
  misc_feature: GYAE6OF01AYEOJ.36.67.G01.1.454.CMB.1.raw
tcagtacgctgtctcacgaccggtgctcgatttagagtatacatattgggtttggggggaagaggaagactgacggtccccccaggagttcaggagtctgtgccgaggtgcagctggtgcattctggagcggaggtgaaaaagcccggggagtctctgaaaatctcctgtaaggcttctggatacacctttaccaacttctggatcggctgggtgcgccagatgcccgggaaagcctggactggatggggatcgtctatcctggtgactctgataccagatacagcccgtccttccaaggccaggtccaccatctcagtcgacaattccatcagcaccgcctacctcactggatagcctgaacgcctcggacaccgcatatattactgtgcgagacataggaagctagtaggtagggtaactttaggtttggggtcggggggtctggtcggtcggggccgacgggtaacccgtggtccgaccgttcctccgtcgaccgccctacccgaccaaccgggtccctacgtccggttccccttcccccgtcggtacccctacccccgttcccgtaccccgaaccggaccgtacccgtacccggttccggtaccgggggcctaccggtaccggg

SEQ ID NO: 158323 - DNA, 956 bp, Homo sapiens
  misc_feature: GYAE6OF01B56HJ.36.67.G01.1.454.CMB.1.raw
tcagtacgctgtctcacgaccggtgctcgatttagagtatacatattgggtttggggggaagaggaagactgacggtcccccaggagttcaggagtctgtgccgaggtgcagctggtgcattctggagcggaggtaggaaaaagcccggggagtctctagaaaatctcctgtaaggcttctggatactacctttacaacttctgatcggcgtgggtcgcgcagagtcggacccgggaaaggtcctaggactgggtagtgggggtactccggttctacgttcccgtgggtgaaccgttcgtagaactaaccgagaattaccgaccgtccccgttccttaccgaacggtccgtaacggtccaactacgttctacgtacgtaccgaacgtaacgttaccaacgttacgacgtaccccgtaaccccgtccccttaaaccccgttacccggtaacgttaccgggggtaacgttaaccgggtacccgttaacggggtaaaacccgggtccccggtaccccgggaaacccctaaccccggtaaccctaaaacgtttaaactttaaccgtttaaccgttccggggtaacggaacccgggttaaacggaaaccgttacgggttaaacggggtaaccttaaccgtttaaagggttaaaggggttacgggtttaaaccggttttaggggtttttcggggggtaccggggggttccgttacgggtccgggtaccggggtacccggtaacgggttaaccccggtcgggttacccgttacccggttaccgtcccgtaccgtaccgtaccccggttacccgaaccggtacccgggcccttaacccggttccgtttccccccggttacccccgtacgggtccccctaacccccgttcccgtaaacccggtaacggaccccgttcccggtaacccgttccggggtccgggtaaccccgaacgggtccccgggg

SEQ ID NO: 158324 - DNA, 851 bp, Homo sapiens
  misc_feature: GYAE6OF01EH3Z3.36.67.G01.1.454.CMB.1.raw
  modified_base (210)..(210): a, c, t, g, unknown or other
  misc_feature (210)..(210): n is a, c, g, or t
tcagtacgctgtctcacgaccggtgctcgatttagagtatacatattgggtttggggggaagaggaagactgaccggtccccccaggagttcaggagtctgtgccgaggtgcagctggtgcattctggagcggaggtagaaaaacggcccggggtagtctactagaaaatcctcctagtaaggcttcgtgatactaccttaccacttcgnggatcggcgtggtgccgccgagacgtcggacccgggaaacgccgtggtacgtggagtgggactcgtctacgtccgttggtcgacgtctacgtactaaccgaagtaactaaccgaccgtccccgttaccgttacccgaacggtcccgtaacggtacccaaccctctaccgtaccgtaacggttacccgaaccgtaacgtaccctacgtaccgaccgacccgtaacccccgtacccttacccgtcccgtacgtacgggaacgttaccgaccgtaggaaccgcccgtaggacccccccagacctaagttacttacgttacgtcgtaggaccgagtaaccgtaggtacggtaacgacgttaagtaacgggtacggttaacgttttcggggtttggggttacgggggtaccgtcgggtcgggtaccggggaccggtaacggtacccggtcgggtaccctacccggttcctaccggtaccgtaccgtacccgtaccccgaacccgggacccggtaccccggtacgttcccccggttccccgttacccccggtcccggtaccccctaccccgttcccaacccggtaaccgacccggtacccctacccgggtttaccggggacgggtaccccgtaaccggcccccgggg

SEQ ID NO: 158325 - DNA, 771 bp, Homo sapiens
  misc_feature: GYAE6OF01BWULE.36.67.G01.1.454.CMB.1.raw
  modified_base (231)..(231): a, c, t, g, unknown or other
  misc_feature (231)..(231): n is a, c, g, or t
  modified_base (377)..(377): a, c, t, g, unknown or other
  misc_feature (377)..(377): n is a, c, g, or t
tcagtacgctgtctcacgaccggtgctcgatttagagtatacatattgggtttgggggaagaggaagactgacggtcccccaggagttcaggagtctgtgccgaggtgcagctggtgcagtctggagcggaggtaggaaaaacggcccggggagtctctagaaaatcctccgtagtaacggcttcgtggactacctacctttaccaacttcgtggacgtcggcgtgggtcncgcagacgtcggaccggaaaggcgtggacgtggagtggggatcgtcgtactccgtggtacacgttcagacgtaaccgagactacgcggtcccgttacctacgaacggccaacggtctaccatctactacgacaactaacgtcctanaccacggtcccacccgtacctacctacgtaacgtcgggaaggttaaccgccgtaagggaaccggtacctaccggaaccacccgtacctataattaaccgtttacgcgggtacgaccggaagtacgtaacgtaggtaacgattaaggtaagtaacgggaacgtttaggggtttgggggtccggggacttcgggcgggtacgggccgtaacggggtacccttcgggtccgtaccgttccgtaccgtccgtaaccgtacccgtacccaccggtaccggacccgttaccggttcccggttacccctccccggtccggtcccctaaccccggtcccttaacccgtaaacggcccgtaacccggtcccggtaggtacccgggggcccacggtaccccggg

SEQ ID NO: 158326 - DNA, 722 bp, Homo sapiens
  misc_feature: GYAE6OF01C3X6Y.36.67.G01.1.454.CMB.1.raw
tcagtacgctgtctcacgaccggtgctcgatttagagtatacatattgggtttgggggaagaggaagactgaccggtcccccaggagttcaggagtctgtgccgaggtgcagctggtgcattctggagcggaggtagaaaaagcccggggagtctctagaaaatctctgtaaggcttctggatactacctttaccaacttcgtgatcggctgggtgcgccagatcggaccgggaaagcctggactggagtggggatcgtctacgtccgtaggtcactcgtagaactaccgagtactacgacgtcccgtcctacgaacggccaggtccaacctatcctacgagtacgaactaacgtccaactccaacgcccaacccgtaccctaccgtaccgaacgttcggaacgttacgacccgtaggaaaccggtcctaccggaacctaaccgacctaaataaacttaacgttaaccgtggtacggaccgaagaaccgtaagtaggaagtacgtaagtaaggtaagggtaacgtttaggtttcggggtcgggggtacttggcggtacgggaccgtaacgggtaaccgtcggtacctaaccggtcctaccgtacgaccgtacccgaccgaaccggaaccgggtccctacgttcccggtcccttccccgtcggacccctaccccgtccaccgaaacgccgtaccgaccgtacggtcggggccaacggacccgg

SEQ ID NO: 158327 - DNA, 662 bp, Homo sapiens
  misc_feature: GYAE6OF01B0RSX.36.67.G01.1.454.CMB.1.raw
  modified_base (538)..(538): a, c, t, g, unknown or other
  misc_feature (538)..(538): n is a, c, g, or t
tcagtacgctgtctcacgaccggtgctcgatttagagtatacatattgggtttgggggcagaagtctctctcagtcaggacacagcatggacatgaggtccctggctcagctcctgggactcctgctgctctggctccagataccagatgtgacatccagactcgaccctagtttccatccctccctgtacctgctatcgtgtacggagtaccagacgtcaccatcacgttgaccgggtctagtcgaggcaattaacaatctatttacgcctaggtactacagtacctacgaaaccgaggggtaaactccttaccgtaaacggtccttaccgtaggtaacttacgttaactcggttactaggtttaaccttacgaaccgttggtacgtacctaaagttcccggtaagggtaccccctagttccgtacggttccaggtcggacgtagtaggacgttaggtacgggtaacgtaactttccgaaccgttctaccgtaacctagtaccagtaccaacgtctacgactacgtacagtaacgtnttacgtacgacttaacgttattaacgttaggtaaactaaacgtctaacggtcgaccgtacccgtactaccgttacggttaccggacggtaggacctaaggtacgtaacagttaacgacgtaacg

SEQ ID NO: 158328 - DNA, 781 bp, Homo sapiens
  misc_feature: GYAE6OF01DWPYC.36.67.G01.1.454.CMB.1.raw
  modified_base (272)..(272): a, c, t, g, unknown or other
  misc_feature (272)..(272): n is a, c, g, or t
tcagtacgctgtctcacgaccggtgctcgatttagagtatacatattgggtttggggggaagaggaagactgacggtccccccaggagttcaggagtctgtgccgaggtgcagctggtgcattctggagcggaggtgaaaaagcccggggagtctctgaaatctcctgtaaggcttcgtggatactacctttaccaacttctggatcggctgggtgcgccagatcggacccgggaagccgtggactggagtggggatcgtctatccgtggtnctctgactaccagactaccacgcccgttcctacgaacggccaggtccaccatcctcacggtacgaacaacgtccatccacgccacccgtccctacctccgaacgtcggacgtacgccgttaggaaccggcccgtaaccgggaaccacccggtaccctaattaacgtttacgttaccgttgtacgggtaccgaacgtaaccgtaggtaacgggtaacgtacgttaaggttaggtaacggggttaaacgttttgggtttttacggggggtcggggggtccctgggtccgggtaccgggggtacccgaaccggggtaccccgtcggggtaccccgtacccggttcctcccgtaccgtaccggtccccgttacccgaacccggtaaccggtccccgtacggttccccgttaccccgtttcccccggtccggtaccccctacccccgttcccgaaccccgtaacggacccgtcccgtaccccgttaccgggccgggggcctaaccgggcccggg

SEQ ID NO: 158329 - DNA, 700 bp, Homo sapiens
  misc_feature: GYAE6OF01AZGUU.36.67.G01.1.454.CMB.1.raw
tcagtacgctgtctcacgaccggtgctcgatttagagtatacatattgggtttggggggaagaggaagactgacggtcccccaggagttcaggagtctgtgccgaggtgcagctggtgcagtctggagcggaggtgaaaaagcccggggagtctctgaaaatctcctgtaaggcttctggatacacctttaccaacttctggatcggcgtgggtgcgccagatcggacccggggaaaggccgtgggacgtgggagtgggggatcggtctatccgtggtcgactctgataccaagatacagcccgttccttccgaaggccaggtcaccgtatctcagtcgacacgtccatcacgcaccgcctacctccacgtcggagtacgcctagacggcctcggaccaccgactatattacttacgtggtacgacgagacgagtagggagtctaagtagtacgggtaaacgtttacggttttagggggtcggggggtccgtcggtcgggtcggggacccggtacgggtaaacccgttgggtcctaacccggttccgtcctccgaccgtccctacccgaaccggaaccgggtccctacgttcccggttaccctttccccccgtcggtaccccctaccccgtttcccctaacccggaacgacccgtacccgtacccgttccgggtacgggggtccccacgggtaccccggg

SEQ ID NO: 158330 - DNA, 831 bp, Homo sapiens
  misc_feature: GYAE6OF01CHT05.36.67.G01.1.454.CMB.1.raw
tcagtacgctgtctcacgaccggtgctcgatttagagtatacatattgggtttggggggaagaggaagactgaccggtcccccaggagttcaggagtctgtgccgaggtgcagctggtgcattctggagcgggaggtagaaaaacggcccggggagtctctagaaaatcctccgtagtaacggcttcgtggactacctacctttaccaacttcgtggatccggcgtgggtcgccgccgagacgtcggacccgggaaagccgtaggacgtaggagtggggatcgtctactccgtggtcgactcgtgaactaccgagtactacgcgtcccgttacctaccgaacgccgaggtaccacctatctacgacgtacgaactacgtaccactacgacgcccacccgtcctaccgaccgaggtacggacgtacgccggtaacggaacccggtcgtaacccggaccgtaaccgtacctaaagtttaaccttaacgtttaccggtaggtaccggtaaccggtaacgtaacgtaacggttaacgggaaaccgttcggttaaagggtttaacggggttaacgggtaaaccggttttgggggttttcggggggaccgggggttccttcgggggtaccgggtaccggggtacccggtaaacgggtcccgtgggtacccctaccgggttccctacccgtcgaacccgtcccgttacccggaaccgtacccggtccttaccgtccccggttcccttacccccggtacggccccctaacccgttcccgtaacccgtaacggacccgtccgtacccggttacgggacccgggctacccggtcccggggg

SEQ ID NO: 158331 - DNA, 854 bp, Homo sapiens
  misc_feature: GYAE6OF01CCZNJ.36.67.G01.1.454.CMB.1.raw
  modified_base (341)..(341): a, c, t, g, unknown or other
  misc_feature (341)..(341): n is a, c, g, or t
tcagtacgctgtctcacgaccggtgctcgatttagagtatacatattgggtttgggctcaaccgccatcctcgccctcctcctggctgttctccaaggagtctgtgccgaggtgcagctggtgcagtctggagcggaggtgaaaagcccggggagtctctagaaaatctcctgtaaggcttctgatactacctttaccaacttctggatcggcgtgggtgcgccagactcggacccgggaaaggtccgtggacgtggagtggggactcgtctactccgtggtcgactctgactaccagactacgccgtccccgttcctaccgaacggccgacggtccaccnctcctcgtacgtaccggaacaacgtccatccgacgcccgacccgtaccctaccctaccgtacgtacgggaacgtaccggtaccgtacggaaaccgggtccccgtaccgggaacccaccccggtacctaacgtttaagttaacgtttaaccgttggtacggtaccgaacgtaacgtaacggtaaggtaaacgtacgttaacgggttaagggttaacggggttaaccgtttttaggggttttacggggggtaccggggggttccgttcggggtaccgggtccgggggtaacccggtaaccggggttaaccccggttcgggttacccgttacccggttacccgttacccgtccccgtaccggtacccccgtaaccccggaaaccccgggtaaacccggggtcccccttaacccgggtttcccccgggtttccccccgtttaccccccgggtcccggtacccccctacccccgtttaccccgaaccgtaacccggcccggtaccccgttacccgggg

SEQ ID NO: 158332 - DNA, 833 bp, Homo sapiens
  misc_feature: GYAE6OF01DACI1.36.67.G01.1.454.CMB.1.raw
tcagtacgctgtctcacgaccggtgctcgatttagagtatacatattgggtttgggggaagaggaagactgacggtcccccaggagttcaggagtctgtgccgaggtgcagctggtgcattctggagcggaggtgaaaaacgcccggggagtctctgaaaatctcctgtaaggcttctggatacacctttaccaacttcgtgatcggctgggtcgcgccagatcggacccgggaaagcctggactggagtcggggatcgtctatccgtggtcgactcgtgactaccgagataccgacgcccgttaccttaccgaacggccaacggtccaaccgtacttctccgacgtccgaactaaaccgtcctatccgaacgccctaacccgccctaaccctccacggtacggacgttacgccgttaggaaccggcccgttacgggaaccacccgtacctaattaacttacttacgttcgtacggaccgtaacggaactaggtaacgggtaactacgttaacggttacgggtacggggttaaacgtttgggtttttaggggggaccggggggttcccgtcgggtccgggtacggggggacccggtaacgggtaacccccggttgggttaccccgtaacccggttcccgttacccgtcgtacccggtaccccttaccccgaaccggaaacccggggtcccctacggttaccccgggttttccccttcccccccgggttacgtacccccgtaccccccgttcccggtaaacccctaacgggtaacccgtaccccggtacccggttaccggggttcccgggggaaccctaacccgggtcccgggg

SEQ ID NO: 158333 - DNA, 764 bp, Homo sapiens
  misc_feature: GYAE6OF01ENT9E.36.67.G01.1.454.CMB.1.raw
  modified_base (395)..(395): a, c, t, g, unknown or other
  misc_feature (395)..(395): n is a, c, g, or t
tcagtacgctgtctcacgaccggtgctcgatttagagtatacatattgggtttggggggaagaggaagactgacggtccccccaggagttcaggagtctgtgccgaggtgcagctggtgcattctggagcggaggtagaaaaagcccggggagtctctgaaaatctcctgtaaggcttctggatacacctttaccaacttctggatcggctgggtgcgccagatgcccgggaaaggcctggactggatggggatcgtctatcctgtgactctgactaccagatacacgcccgtcttccaaggccaggtccaccatctcagtcgactagtccatcacgccaccgtcctacctccacgtggacgtacgcctaggacgcctacggaccaccgcaagtntactactgtcgacgacgactagtaggaacgtcttaagtagggtacggtaaacgtttagggttttcgggggtacgggggggttcctcggggtccgggtccgggggaacccgtaaccgggggtaaccccgttcgggtaccctacccgggttacccgttcccgtacggtaaccccggttacccgttaccccggaacccggtaaacccggggccccctaccggttttaacccccggggttccccttttaccccccccggttcggggaccccccttaccccccggttaccccctaaccccggtaaacccgtaccggtacccctaaccccggttcccggggtaacgggggtcccgaaccggttaacccccggggg

SEQ ID NO: 158334 - DNA, 917 bp, Homo sapiens
  misc_feature: GYAE6OF01B7DCE.36.67.G01.1.454.CMB.1.raw
tcagtacgctgtctcacgaccggtgctcgatttagagtatacatattggggtttgggggcagaagtctctctcagtcaggacacagcatggacatgagggtccctgctcagctcctgggactcctgctgctctggcctcccagactaccagatgtagacatccagatcgaaccctagtttccactcccttccctgtctcgctactcgtagtaggacgaacagacgtaccaccatctacgttcgggaccgggcgtacggtcggacgggtacctaatttaaaccaagttccttaaggttaccgtaccggttacgggttaccacggaacgaaccgaaacggtaaaccggaaacggggtaacctccgttaaccgtaacgtcgtaccgttaagttaatacgttagttcgttacgttacgttacctttactaacgttcgtacacgtaaccgggtacccggttacccggggtacccttacgtttaccgggtaccgggtttaccggacgggttaacgggtccggttaacggggtacggttaacgggggtttacggggaacgggtttacccggtttaaccggtttacccttaacccgtttaccccgtaaaccttaaccccgtaggttaaacccgtcccggtaccgtaccccggttaccgttaccgaccggttacccggtttaaccggaaggtacgtttcgttaccgggtactttaacgttttaaacggttttacttttaaacgtaaccgttaaacgttaaacgttcggttaaccgtaacccggttacccggttaccccccgacggtttaaccccggttaaccgggtttcccggggggtttaacccggggaaacccgggggtaaccggggtaaccggggttaaacgggttgggtaaaaccccgtttaagtaaaccgggttaaaccgg

SEQ ID NO: 158335 - DNA, 852 bp, Homo sapiens
  misc_feature: GYAE6OF01DQNB1.36.67.G01.1.454.CMB.1.raw
tcagtacgctgtctcacgaccggtgctcgatttagagtatacatattgggtttgggggcagaagtctctctcagtcaggacacagcatggacatgagggtccctgctcagctcctgggactcctgctgctctggcctcccagataccagatgtgacactccagatgacccagtttccatccctcctgtctgcatctgtaggagacagcgtccacctatctacgttcggccgggcgagtcgaggactaacttaaacacttactagtttacgccgttagtactcgacgacaaacggaaaaccgtaaggggaaacgtcccgttaccgtaacgcccgtttaccgtagtaactttaagttacgttcggttaccgttagtttactttaccgtaaccgttggttaccgtaaccgtaaagtacccgggtaaccggggtttccccctacgttcccggtttaccggttacgtacgggttcggacgtagggttacgggtaagttagggttaacgggggaccgtttacttttccgaccttaccccgttaccaacctacgtaccgaagcccgttacgacccgtttcgaccgtccgtaccgttaaggtaacggttactttacgggtttaccgtaaaccggttttaaaactttttacgttttaacgttaacggttaaaccgtaaaagggttttccaaacgggtaaccggttaccccggtccccgggttaccccctttacggttacccggttttaacccgggggtttcccggggaaccgggggttaaaaccgggggtaaccccgggttaaaggggttaaggggtaaaccccgtttaaaaggtaaaacccccggggtttaaaacccggg

SEQ ID NO: 158336 - DNA, 187 bp, Homo sapiens
  misc_feature: GYAE6OF01BWAA1.36.67.G01.1.454.CMB.1.raw
  modified_base (182)..(187): a, c, t, g, unknown or other
  misc_feature (182)..(187): n is a, c, g, or t
tcagtacgctgtctcacgaccggtgctcgatttagagtatacatattgggtttgggttttggggggaagaggaagactgacggtccccccaggagttcaggtgctgggcacagcggccctgggctgcctggtcaaggactacttccagacagcgtactgagcgggctggcaaggcgcatagnnnnnn

SEQ ID NO: 158337 - DNA, 861 bp, Homo sapiens
  misc_feature: GYAE6OF01B83U0.36.67.G01.1.454.CMB.1.raw
tcagtacgctgtctcacgaccggtgctcgatttagagtatacatattgggtttgggctcaaccgccatcctcgccctcctcctggctgttctccaaggagtctgtgccgaggtgcagctggtgcagtctggagcggaggtgaaaagcccggggatctctgaaatctcctagtaaggcttctggatacacctttaccaacttctggatcggcgtgggtgccgccagactcggacccgggaaaggccgtaggactagggagtagggggacttcggtctacgtccgtggtcgacgttcctagactaaccgagtaactacgaccggtaccccgttcccgttaccgaaacgggccctaagggttcccaaccgtacttcctacgacggtaccggaactaaaccggttcccaacgttaccgaacgtaccgaccccggtaccccttacccgtacccaacggtcgggtaacgtaccggtacccgtaggaaccgggtcccgtacggggaaccctaacccggccctaaagttaactaactttaccgtaggtaccggtacgaacgttacgaagttagggaacgtacgttaagttacgggttaaggggtaaccgttttacgggttttggggggtaccgggggggtcccttacgggtaccgggtccgggggtaacccgggtaaccgggggtacccccgttaggggtacccttacccgggttaccgtcccgttccgaccggtacccccgttaccggaaccccgggttaacccgggcccgtaacgggttccccggtttcccccgttaccccccgggttcggaccccttacccccgttacccgaaccccggtaacgtaccggaccccgttacccgggg

SEQ ID NO: 158338 - DNA, 816 bp, Homo sapiens
  misc_feature: GYAE6OF01BOD78.36.67.G01.1.454.CMB.1.raw
tcagtacgctgtctcacgaccggtgctcgatttagagtatacatattgggtttggggggaagaggaagactgacggtccccccaggagttcaggagtctgtgccgaggtgcagctggtgcattctggagcggaggtagaaaaaggcccggggagtctctgaaaatctcctgtaaggcttcgtggatacacctttaccaacttctggatcggtcgtgggtcgcgccagagtcggacccgggaaagcctggacgtggagtggggatcggtctatccgtgggtcgtactctagaactaccgagtactaccacgtcccgtaccttaccgaaggccacggtccacctagtcctacgagtccgaacgaacgtccaagtccaacgcccgaaccccgtcccttaccccgtaccgtacggtacgggtaacgttacggaccgttagggaaacccgggccctaccgggaacccacccggtaacctagtttaaccttaacgtttacccgtggttacggacccggtacgaacgtagtacgggaaactaccgttaaggttacgggtaacgggttaacgttttagggttttcggggggtaccggggggtccgtgggtccgggttacggggtacccgggtaacccgggtacccggttcgggttcccgtaacccggttcccgttacccttacggacccgtaccccgtaccgaaaccccggaaccggtccccgtaacgttccccggtaccccgtttccccgcggtaccccctcccgtcccgaaccgacggtccgacccgtacccggttcgggccgggtaccgccggtacccggg

SEQ ID NO: 158339 - DNA, 901 bp, Homo sapiens
  misc_feature: GYAE6OF01AORD7.36.67.G01.1.454.CMB.1.raw
tcagtacgctgtctcacgaccggtgctcgatttagagtatacatattgggtttggggggaagaggaagactgacggtccccccaggagttcaggagtctgtgccgaggtgcagctggtgcattctggagcggaggtagaaaagcccggggagtctctagaaatctcctgtaaggcttctggatactacctttaccaacttatggatcggtcgtgggtcgcgccgagagtcggacccggggaaaggccgtaggacgtggagtggggatcgtctacgtccgtggtcgactctgaactaaccagataccgaccgtccccgttaccttacccgaacggcccacggttaccaccctactttccgtacgacgtaccgaactaacgtaccaacgttcacgacccaccccgtaccctacccctaccgtaaccgttagggtaacggttaaccgcccggttaacgggaaccggtccccgtaccgggtaacccacccgtaaccctaattaacgtttaacttaccgttggtcggaaccgtaagaaccgtaggtaacgggtaacgtacgttaagtacgggttaacgggttaacgttttacggggttttcggggggttaccgggggggttcccgttcgggtaccgggttaccgggggtacccggtaaccggggtaacccccggttacgggttacccggtaccccggttcccgttaccccgttaccgtacccgtaccccgttacccccgaaacccggtacccgggtaccccgtaccggtttccccgggtttaccccccgtttcccccggtcccggtaccccctaacccccggttccccgtaaccccgtaacccgacccgtacccccgttaccccgttacccggggtaccggggaccccgtacccggtaccccgggg

SEQ ID NO: 158340 - DNA, 841 bp, Homo sapiens
  misc_feature: GYAE6OF01BXVDN.36.67.G01.1.454.CMB.1.raw
tcagtacgctgtctcacgaccggtgctcgatttagagtatacatattgggtttgggggaagaggaagactgacggtcccccaggagttcaggagtctgtgccgaggtgcagctggtgcagtctggagcggaggtagaaaagcccggggagtctctagaaatctcctgtaagcttctggatacactttaccaacttctggactcggctgggtacgccgccagatcggacccgggtaaaggccgttaggaccttgggaagttacgggggaacttccggttacctatcccgttgggttacgtacctcgttagactaacccgtaaggaacttaccgaaccgtccccggttaccttacccgaaagggtccccagggttaccccaactacgtttcctacgaacgttacccggaaaccgtaacggtccctagtaccgacggtaccctaccggtaccctacccctcgtacgttagggaacgtacgtccgtaagggaccggtccctacgggaaacccacccggtaacctaacgtttaacttacgttacgttaggtacgaccggtaagaaccgtacgttaacgggaacgtacgttaaagttagggtaacgggttaaaccgtttagggttttacggggtccgggggttacttcgggtacggtaccgggtccggtaaaccgggtccgtacggtacccgttaccggtctacccgtaccgacggtcccctaaccgaaccggacggtacccctacggttcccggttaccccttccccgtccggtccctaaccccgttccgaaccgtaacgcccgtacccgtaccggtccgggtacgggtcccaaccgttcccgggg

SEQ ID NO: 158341 - DNA, 744 bp, Homo sapiens
  misc_feature: GYAE6OF01DB78G.36.67.G01.1.454.CMB.1.raw
  modified_base (138)..(138): a, c, t, g, unknown or other
  misc_feature (138)..(138): n is a, c, g, or t
  modified_base (145)..(145): a, c, t, g, unknown or other
  misc_feature (145)..(145): n is a, c, g, or t
  modified_base (155)..(155): a, c, t, g, unknown or other
  misc_feature (155)..(155): n is a, c, g, or t
  modified_base (164)..(164): a, c, t, g, unknown or other
  misc_feature (164)..(164): n is a, c, g, or t
  modified_base (192)..(192): a, c, t, g, unknown or other
  misc_feature (192)..(192): n is a, c, g, or t
  modified_base (195)..(195): a, c, t, g, unknown or other
  misc_feature (195)..(195): n is a, c, g, or t
  modified_base (209)..(209): a, c, t, g, unknown or other
  misc_feature (209)..(209): n is a, c, g, or t
  modified_base (219)..(219): a, c, t, g, unknown or other
  misc_feature (219)..(219): n is a, c, g, or t
  modified_base (227)..(227): a, c, t, g, unknown or other
  misc_feature (227)..(227): n is a, c, g, or t
  modified_base (325)..(325): a, c, t, g, unknown or other
  misc_feature (325)..(325): n is a, c, g, or t
  modified_base (505)..(505): a, c, t, g, unknown or other
  misc_feature (505)..(505): n is a, c, g, or t
tcagtacgctgtctcacgaccggtgctcgatttagagtatacatattgggtttgggggcagaagtctctctcagtcaggacacacgcatggacatgacgggtccctgctcagcctccgtaggctctgctgctctcgcnccagtanccagactgtnacatcaagntacgccctagtttccactcctccgtgtnacnctatacgtgagacnctaaggtacnccacgtancgttacggcgcggacagtacgacggctaaatactaatctaagtttccgtcttaggaactcaacggacgaaagaaaccgaaaggactaccaccgtaacncgtctaagtaacttagtctacggtactaaggttaccttagcgtataccgaagttaacgaccggtaacggttaactccgtacggtttacggaacgtgggttaggaaccgttaggtaacgtacggtaggtacgggtaactttcgttaacgtacttactaccacgtaactcgacgacggtacnctacgaccgtagtaccgaagtaacgtattaaccggtacctttaacgttaaaccgttttaagttacgttaaacgtaacgttaaaacgtacgtttaaaccgacggtttaaacccgaccccgtaaccggttaacgttaacccgggttttcgggtaaaaacccgggggtaccggtaaacccggggttaaacgtaaccgggggtaaataaacgggtttaaaccgggttaacggtaaaaaccggg

SEQ ID NO: 158342 - DNA, 831 bp, Homo sapiens
  misc_feature: GYAE6OF01CX6W6.36.67.G01.1.454.CMB.1.raw
  modified_base (173)..(173): a, c, t, g, unknown or other
  misc_feature (173)..(173): n is a, c, g, or t
  modified_base (210)..(210): a, c, t, g, unknown or other
  misc_feature (210)..(210): n is a, c, g, or t
  modified_base (266)..(266): a, c, t, g, unknown or other
  misc_feature (266)..(266): n is a, c, g, or t
  modified_base (270)..(270): a, c, t, g, unknown or other
  misc_feature (270)..(270): n is a, c, g, or t
  modified_base (278)..(278): a, c, t, g, unknown or other
  misc_feature (278)..(278): n is a, c, g, or t
  modified_base (285)..(285): a, c, t, g, unknown or other
  misc_feature (285)..(285): n is a, c, g, or t
  modified_base (454)..(454): a, c, t, g, unknown or other
  misc_feature (454)..(454): n is a, c, g, or t
  modified_base (464)..(464): a, c, t, g, unknown or other
  misc_feature (464)..(464): n is a, c, g, or t
tcagtacgctgtctcacgaccggtgctcgatttagagtatacatattgggtttgggggaagaggaagactgacggtccccaggagttcaggagtctgtgccgaggtgcagctggtgcagtctggagcggagtgaaaagcccgggagtctctgaaaatctcctgtaaggcttcnggtatacacctttacaacttctggatcggcgtgggtncggccaggactggcccgggaaagtcctggactggatggggatcgtctatcctggtnactntgataccngtatacngtcccgtactcgaacggtccaggtcactagtcctacgacgtcacgaagtccaatcaacgccaaccgcccttaacctccactacgggtactacggtcccgtaggtaaaccgcccttaacggcctaaccggccagtttaacttacgtttaactgtacgacgtacgtaacgngtacgggaanacgttaagtacgggtacgggtaaactttacggggttttttgggggaccggggggtccttaacgggtccggtacggggggtaccccgtaaacggggtaacccccggttcggggttacctaacccgggggtttaccttaccccggtacgtaaccgggtcccctaaccccggtaacccgggtaaccggggttacccccgtaaacggttttcccccggggtttccccgttacccccccggggtttaaggacccccccgttaaccccccgggtttacccgtaaaccccggaaaacgggttccccgtaaccccggtttaaccccgttaccggggttacccgggggaacctaaaccccggggttaaccccgggg

SEQ ID NO: 158343 - DNA, 729 bp, Homo sapiens
  misc_feature: GYAE6OF01E2OS0.36.67.G01.1.454.CMB.1.raw
tcagtacgctgtctcacgaccggtgctcgatttagagtatacatattgggtttgggggaagaggaagactgacggtccccccaggagttcaggagtctgtgccgaggtgcagcctggtgcagtcctggagcggaggtgaaaaacgcccggggagtctctgaaaatctcctgtaaggcttctggatactacctttaccaacttctggatcggctcgggtgccgccagagtcggacccgggaaagccgtggactggagtggggatcggtctagtcctggtgtactctgactaccgagactaccgaccgtccccgttccttaccgaacgggccctacggtaccaccctatccgtacacggtccgaaccgaacgtacccagtccgaacggccccaccccggtacccttaaccgacccaaccgttgggacgttaccggcctaacgggaccggtacccgtaccggaaccaacccggtctaaacttacgttacttaacgtcgtacgtacgaacgacgtacgtacgggtagtacctagttaacggtaggtaacgttaggtttggggacggggtcctgggcgtcggggccgaacgggtaccgttgaccgaccgttccgtcccgtcaccgccgtaccgaccgaaccgggtccctaccggttccgtccccttccccggaccgtccctaacccgccgtaccgaaccgcgttacccacggtccggacgggccctaccgcggg

SEQ ID NO: 158344 - DNA, 901 bp, Homo sapiens
  misc_feature: GYAE6OF01DI9ZP.36.67.G01.1.454.CMB.1.raw
  modified_base (179)..(179): a, c, t, g, unknown or other
  misc_feature (179)..(179): n is a, c, g, or t
tcagtacgctgtctcacgaccggtgctcgatttagagtatacatattgggtttggggggaagaggaagactgaccggtccccccaggagttcaggagtctgtgccgaggtgcagctggtgcagtctggagcggaggtagaaaaacgcccggggagtctctagaaatctctagtagcttntgatactacctttaccaacttcgtgatcggcgtagggtcgcgccagagtcggacccgggaaagccgtggacgtgggagtggggacttcgtctacgttccgtggtacgtacttacgtacgtactaaacccgagtaaacttaacccgaaccggttcccccggtttacccgtttaacccggaaaccgggtacccgtaaccggggttacccctaaccggtacgtttacccgttaaaccgtaccggttaccgaaacccgtaaaccggtttcccaacgtacccaaaccggtaccccgtaacccccgtacccccttaacccctacccgtaggttacggtaacggtaccggtcccgtaaggggaacccgtaccccggtacggaacccacccggtaccttaagtcgtttaaacgtttaccgtgggtaccgaaggaacacgtagtaacggtactacgtaaggttacggtacgggttaacgtttgggtttcggggggaccggggttcctagggtaccgggtccggggaccggttaaccgggtaccgttcgggtaccccgttaccttcccggtaccttccggaacccttcccgtacccggaaccgaccgggtccccttaagggttccccgttccccggttccccgtcccggaccccttcccccgttaaccgacccggaacgtaccccggtacccgttaccccgggtcggtaacccggccgtacggtaccccggg

SEQ ID NO: 158345 - DNA, 681 bp, Homo sapiens
  misc_feature: GYAE6OF01AZY4D.36.67.G01.1.454.CMB.1.raw
  modified_base (597)..(597): a, c, t, g, unknown or other
  misc_feature (597)..(597): n is a, c, g, or t
tcagtacgctgtctcacgaccggtgctcgatttagagtatacatattgggtttgggctcaaccgccatcctcgccctcctcctggctgttctccaaggagtctgtgccgaggtgcagctggtgcagtctggagcggaggtagaaaaacggcccggggagtctctagaaaactcctccgtgtaaggtcttcgtggactacctacctttaccaacttcgtggatcggctggggtgccgccagagtcggacccgggaaagccgtggactggacgtggggactccgtactagtccgtggtactactcgtagactaaccgagaactacgccggtccccgttacctaccgaacggccgtacggtaccacctagtcctagacggtaccgaactaacgtccaatccgtacgcccgtaccgtccctacctccgtacgtaggactacggtcgtaacggacgtcccaccggtaccaccgtactactatacttacgtgtacgacgtacgactagtacggaacgtacgtaagttaggtacggtagtttggttcggggtggggtcctggcggtcgggtacggacggtacccgtggtaccgtacgtccgtcncgtacgccctacgaccggaccggtcctacggtccgttcccgtacccgtctacccgtaccctccgtaccgacgtcgccctaccgg

SEQ ID NO: 158346 - DNA, 680 bp, Homo sapiens
  misc_feature: GYAE6OF01BW0XX.36.67.G01.1.454.CMB.1.raw
  modified_base (129)..(129): a, c, t, g, unknown or other
  misc_feature (129)..(129): n is a, c, g, or t
  modified_base (211)..(211): a, c, t, g, unknown or other
  misc_feature (211)..(211): n is a, c, g, or t
  modified_base (217)..(217): a, c, t, g, unknown or other
  misc_feature (217)..(217): n is a, c, g, or t
  modified_base (301)..(301): a, c, t, g, unknown or other
  misc_feature (301)..(301): n is a, c, g, or t
  modified_base (431)..(431): a, c, t, g, unknown or other
  misc_feature (431)..(431): n is a, c, g, or t
  modified_base (446)..(446): a, c, t, g, unknown or other
  misc_feature (446)..(446): n is a, c, g, or t
tcagtacgctgtctcacgaccggtgctcgatttagagtatacatattgggtttgggctcaaccgccatcctcgccctcctcctggctgttctccaaggagtctgtgccgaggtgcagctggtgcagtcnggagcggaggtagaaaaagcccggggagtctctagaaaatctcctagtaagcttctggatacaccttacaattctggatcgntgggtnacgcagatcggaccggaaagtcctaggactggagtgggatcggtacttagtccttggtcacgtctagaattaccaagataaccncgccccgttcttccgaaacggccagttccacactctacagtccactaacgtcaagtcacgtcacccgcctacgccagtcgatacgctggaacgcctacgacctacgcctagtactagtctagtcgacganacagtacgaacgtanaacgtaggtaggtaactttaggttcgggttacgggggcttggggtccgtaagggggtccccgtaacggggtaaccgttccgggtaccgttaacccggttccgtacccgttacgaccggtttaccccgacccgtaacccgggacggtacccgtaacgggttccccggttccttaacccccggtccgtaccccttacccgaccccgtaaccgtaacgcccggtaacttaccccggg

SEQ ID NO: 158347 - DNA, 901 bp, Homo sapiens
  misc_feature: GYAE6OF01EI1TI.36.67.G01.1.454.CMB.1.raw
  modified_base (214)..(214): a, c, t, g, unknown or other
  misc_feature (214)..(214): n is a, c, g, or t
  modified_base (276)..(276): a, c, t, g, unknown or other
  misc_feature (276)..(276): n is a, c, g, or t
tcagtacgctgtctcacgaccggtgctcgatttagagtatacatattgggtttggggggaagaggaagactgacggtcccccaggagttcaggagtctgtgccgaggtgcagctggtgcattctggagcggagttagaaaaagcccggggagtctctagaaatctctgtaaggcttctggatacacctttaccaacttctggatcggctgggtncgcagatcggacccgggaaagcctggacgtggagtggggactcgtctatccgtggtcacttntgactaccgagtactacacgtccccgtaccttaccgaaagggtcccaaggtacccaccctagttcctccgaaggttaccgaaacctaacgttccaattaccaacggaccctaacccgtaccctaccctaccgacggtaacgggtaacgtaccgtccgtaacgggaaaccgggtccctaaccgggaaccctacccggactaaactttaacgttaacgtttaccgtagggtacgtacggaacgtaacgaagttacgggaagttacgttaacggttaaaggggtaaccggtttaaacgttttaagggtttttcgggggggtaccggggggtacccgttaggggtaccgggttaccgggggggaaccccggttaacccggggggtaaaccccgtttcggggtaaccccgtttaaccccgggtcccgtttaccccggttaaccgtaacccgggtttaccccccgacccggtaaccccggtaaacccggggtcccttaaacccggtttcccggttaccccccgttccccccgtcggggtaaccccccttacccccgtaccgtaacccgaaaccgggaccttaacccccggaccgtaccggggttaccggggaaccctaacccgggtccggg

SEQ ID NO: 158348 - DNA, 965 bp, Homo sapiens
  misc_feature: GYAE6OF01CZIV5.36.67.G01.1.454.CMB.1.raw
  modified_base (392)..(392): a, c, t, g, unknown or other
  misc_feature (392)..(392): n is a, c, g, or t
tcagtacgctgtctcacgaccggtgctcgatttagagtatacatattgggtttgggggaagaggaagactgacggtcccccaggagttcaggagtctgtgccgaggtgcagctggtgcattcgtggagcggaggtagaaaaagcccggggagtctctagaaaatctcctaggtaaggcttcgtggatactacctttaccaacttcgtggagtcggcgtgggtgcgaccagagtccggaccgggaagccgtaggacgtggagtgggtatcgtactacgtccgtggtactacgtcgtagacttaaccagtactaaccgccgtcccgttaccttcgaaacggtccacggtaccaaccgtactccgtacgacggtaccgaactaaccgtacctacncgaaccgtaccctaccccgtaccctacccgtacccgacggttacggacgtaaccgtacccggtaacgggtaaccgttacccggacccggtaaaccacccggtacctaaacgttttaacgtaaccgtttaccggtaggtaccgaacggtactaaccggtaacggttaagggtaacgtacgttaacggttaacgggtttaacgggtttaaaacgttttcgggggttttaccggggggaccgggggttacccggtttacggggtaccggggtttacccgggggaacccggttacccggggtaaccccggtttacccgggttaccccgtttaaccccgggtttccccgtaaccgtacccggttaccccgtaaccccgggtaaaccccggtacccgggttaccccggttaccccgttccccgggtttaccccccgttcccccggttaccccggttaccccccgtaccccccgtttaacccggtaaaccccgaaccgggttaaccccgtaccccggttaccccgggttaacggggacccgggttaacccgaacccgggtcccggggttaacccccgggg

SEQ ID NO: 158349 - DNA, 872 bp, Homo sapiens
  misc_feature: GYAE6OF01BXVPO.36.67.G01.1.454.CMB.1.raw
tcagtacgctgtctcacgaccggtgctcgatttagagtatacatattgggtttgggctcaaccgccatcctcgccctcctcctggctgttctccaaggagtctgtgccgaggtgcagctggtgcagtctggagcggaggtagaaaaacggcccggggatctctagaaaatctcctagtaaggtcttctaggtactaacctaacccttttaaccgtaactttcgtagggacttccgggcggttggggtcgaccgcccgaaggtacgtccgggaaccccgggggaaaaggtccgtgggtaaccgtagggtaagggttcgggggtaacttcggtcgtacttccgtggtactactcgtagactaaccgagaactaccgaccgtccccgttaccttaccgaacggccgtaacggtaccaaccgtactcctacgtacgtaccgaaactacgtacctaataccgaccgtaccctaaccccggtaccctaaccccttaccgtaacgggtacgggtaactaccggtaccgttacggaaacccgggtccccgtaacggaccccgtacccgaacctaaattaacgtttaacgttaccgtacggtgggtaacgaaggtacttaagggacggtaacgtacgttagtaacgggtaggttaacgttttggggttcgggggtacgggggtcgtcggacggggtccgggaaccggtacgggttacccggtcgtaacccggtccgtaccgtaccgtcgacggtacccccgtaccgaaacccgggttacggacccgtacccggttccccggtttccccgttaccccccggtcgtaccccccgttaccccttacccggtaaacccgaaccggtaccgccccgttaaccgggg

SEQ ID NO: 158350 - DNA, 808 bp, Homo sapiens
  misc_feature: GYAE6OF01BU6VQ.36.67.G01.1.454.CMB.1.raw
  modified_base (225)..(225): a, c, t, g, unknown or other
  misc_feature (225)..(225): n is a, c, g, or t
  modified_base (410)..(410): a, c, t, g, unknown or other
  misc_feature (410)..(410): n is a, c, g, or t
tcagtacgctgtctcacgaccggtgctcgatttagagtatacatattgggtttgggctcaaccgccatcctcgccctcctcctggctgttctccaaggagtctgtgccgaggtgcagctggtgcagtctggagcggaggtagaaaaaggcccggggagtctacgtagaaaatctaccgtagtaaggcttcgtggactaccacctttaaccaacttctggatcggngtgggtgcgcagagtcggaccgggaaaggccgtaggacgtggagtggggactcgtactacgtcgaggtacgtatcagtactacgaagtactacgacgtccccttacgttaccgaaaggtccacggtccaaccgtatcgtacaaggtccgaaactaacgtcaatccgagaccacccgtcctaaccnccgtaacgtcggtaagtacgaccgttaagggaaccggtaccgtaccggaaaccgtcccgaacgttaacttacgttaactttaccggtgtacgggacgtaacgaacgaaggttacggaaagtccttaaggttaaggtacggtttaaacgttacgggtttttggggggaccggggtaccgttagggtaccgggtaccgggggaaccgtaaccggggtaaccccgttacggggaacccttaacccgggttcccgtaccgttaccggaaaccgtccccggttaacccgaaaccccgggttaaccgggggaaccccttcgggttaccccggtccccgttaaccccccggtcgtaacccccgtacccctaccggtaacccaacggttcccgaccgttacccggg

SEQ ID NO: 158351 - DNA, 879 bp, Homo sapiens
  misc_feature: GYAE6OF01A7BXA.36.67.G01.1.454.CMB.1.raw
tcagtacgctgtctcacgaccggtgctcgatttagagtatacatattgggtttgggggaagaggaagactgaccggtccccccaggagttcaggagtctgtgccgaggtgcagcgtggtgcagtcgtgggagcgggaaggtaaggaaaaaacggccccgggggagtcgttacgtagaaaactccgttccgtaggtaacgggtcctttcgtacgggtaacttaaccgtaaccccttttaaacccgaaacgtttccgtagggaacgttccgggtacggttcggggtacgcccggaccgagtacggtacccgggaacccggggaaacggtcccgttagggaccgttaagggacggtagggggtaacttcccggttgtaacgttccggtagggtacgtacgttcgttagaacgttaaccgaagtacctaaccgtacccggtaccccttaccgttaaccggaacggtacccgtaacgtacccgtaaccgtactaccgtacgtaacgtaccgaaacgtaacgtccaactacgaccgtcccaaccgcccttacccggtactaaccggtaggtacgtacccgtacgaggtaacccgtcccggtaacgaacccgtaccgaacttagttacttaacgttacgtcgtacgaacgacgtacgagtaggaactacgttaggtaggtagtacgtttagggtcggggtcgggtagcggtggtaccggacggtaaccggtaccgtcggaacccgtaacgtcccgtacgtcccgacgtcctaacccgaccggtaccgaccggtcccgtacccgttacccgtcccgttcccggacccctacccgtcctaccgaccgaccttacgacccggtacggtccggacccggacgtacccggg

SEQ ID NO: 158352 - DNA, 798 bp, Homo sapiens
  misc_feature: GYAE6OF01AUG84.36.67.G01.1.454.CMB.1.raw
  modified_base (259)..(259): a, c, t, g, unknown or other
  misc_feature (259)..(259): n is a, c, g, or t
  modified_base (535)..(535): a, c, t, g, unknown or other
  misc_feature (535)..(535): n is a, c, g, or t
  modified_base (593)..(593): a, c, t, g, unknown or other
  misc_feature (593)..(593): n is a, c, g, or t
  modified_base (600)..(600): a, c, t, g, unknown or other
  misc_feature (600)..(600): n is a, c, g, or t
  modified_base (670)..(670): a, c, t, g, unknown or other
  misc_feature (670)..(670): n is a, c, g, or t
  modified_base (774)..(774): a, c, t, g, unknown or other
  misc_feature (774)..(774): n is a, c, g, or t
tcagtacgctgtctcacgaccggtgctcgatttagagtatacatattgggtttgggggcagaagtctctctcagtcgaggacacgagcagtggactagtggacgggtccctgctcagctcgtggactccgtgctgcctcgtcggacctccagtactaccgagacgttgacaacactccgagactcgtacccttagttccacttcctcccgtgtacgtcactcgttgttacggacggacaacgtgtacttacccaacctnttacccgtacggtttccggggaccgggtcgtaacgttaccggtaaggtactaaacttttaaacgaacttacgttaacggtttacggaccgtttgtaaccgtcgaacggaacctaaaacggtaaaacggacggggttaacctcctttaaccgtagtcccgaacgtttacgtaaagttatttcgacgttacttcgtacctttacggcgtttagacccgtagtaacgttcccggggaccgtttacgttcgtacggtttccgtataacggggttacggtnaaggtacggtttaggtaccgggttaattccttacgacttcggtaaacgctggtacacncgttacncccgtatcggccgtaagttacggacgttacttcgtaaaccggcttaaagtttcgtaacgtacggttaaanaccgggttagtacgtccgtaaccgttacccgtacccggttatttacccccgggagggttaaacccgggaccggtaaaacgtacggttaggaacccggtttaacnccgggtaacccttaaaggggtacc

SEQ ID NO: 158353 - DNA, 966 bp, Homo sapiens
  misc_feature: GYAE6OF01C6LGG.36.67.G01.1.454.CMB.1.raw
  modified_base (952)..(952): a, c, t, g, unknown or other
  misc_feature (952)..(952): n is a, c, g, or t
tcagtacgctgtctcacgaccggtgctcgatttagagtatacatattgggtttggggggaagaggaagactgaccggtcccccaggagttcaggagtctgtgccgaggtgcagcgtggtgctattcgtggaggcgggaaggtaaggaaaaacggccggggtaagtcgtctaagaaaatctaccgtagtaaaggtcttcgtaggtaactaaccctaacccttttaaaccctaaaccgtttcgtacggagttccgggcggttacggggtacgccgaccaaggacgtacgggaacccggggtaaaggccggtacggacggtagggaaggttcggggtaattcggttactaacgttcgtggtagtacctctagactaacgagtaacacgtaacctcccgttaccgtaccgaacggtaccgaacgtaccaaccaacttcgacgacgtacgtaacgaacgttacactaccgaaccgcctaaccccgtaccctaaccgaccgttaacggacggtaacggtacgaacgtaacggaacccgtacccgtaacgaacccgaccgtaactaaactttaacttaacgtttacgagtacggaacgaacggtaacctagggttaaagggactttaaaggttaggttaaacgggttaacgggttaaaccgtttgggggtttacggggggtaccgggggttctaaccggggccggtaacggggggtaacccctacggggtaacccgggttacttaaccccggtaccggggtcccctttaaaccgacccggtaacccctacccggaaccccgtaaaccggggtacccccgggtaacttaccccgggttaccccggtttaccccccttacccccggggaaaccttaccccccaaaccccggttacccttaaaccggaacggtaccccgttaaacccggaacccggttaccggggtaccgggaaccccccgngtaaacccccgggg

SEQ ID NO: 158354 - DNA, 851 bp, Homo sapiens
  misc_feature: GYAE6OF01DTSWG.36.67.G01.1.454.CMB.1.raw
  modified_base (130)..(130): a, c, t, g, unknown or other
  misc_feature (130)..(130): n is a, c, g, or t
  modified_base (309)..(309): a, c, t, g, unknown or other
  misc_feature (309)..(309): n is a, c, g, or t
  modified_base (503)..(503): a, c, t, g, unknown or other
  misc_feature (503)..(503): n is a, c, g, or t
tcagtacgctgtctcacgaccggtgctcgatttagagtatacatattgggtttggggggaagaggaagactgaccggtccccccaggagttcaggagtctgtgccggaggtgcagcgtgggtgctattcnggagcgggaggtaggaaaaacggcccggggagtctactagaaaactctccgtagtaggcttcgtggatacctacctttacctaacgttctggagtcggtcgtcgggtgccgcgagacgtcggaccgggtaaagccgtagacgtggagtgggtacttcgtctacgtcgtggtacgacgtntacgactaaccgagtaactacgtaccgtccccgttacgtaacggacgtaccgacgtccaacgtactccgtagacgtacgaacgtacctaccagtaccgacgcccacccgtaccctacgtaccaggtacggactacggccgtaaggaccgtcccgtaaccggaaccgtaccctaacagtttaaactacgttacgnggtagacgaacgtacgaacgttagggtaacgtacgttaaacggtagggttaacgttaagggtttaccgggttttgggggtaccggggggtacccttggggtaccgggttaccggggaaacccggtaaccgggttaacccccggttgggtacccccgtacccgttaccccgttcccgttaaccggtaaccccggttcccccaaacccggtaacccgggtacccggttacccgtaccgggttccccgttaccccgtccccccgtacggtccccctaacccggttccccgaaacgtaccggtccccgaaccgttaacccggtggtcccggggaaacttcccgggaccgggg

SEQ ID NO: 158355 - DNA, 189 bp, Homo sapiens
  misc_feature: GYAE6OF02GDO31.36.67.G01.1.454.CMB.1.raw
  modified_base (174)..(189): a, c, t, g, unknown or other
  misc_feature (174)..(189): n is a, c, g, or t
tcagtacgctgtctcacgaccggtgctcgatttagagtatacatattgggttggtttgggaagaggaagactgacggtccccaggagttcaggtgctgggcacagcggccctgggctgcctggtcaaggactacttccagacagcgtactgagcgggctggcaaggcgcatagnnnnnnnnnnnnnnnn

SEQ ID NO: 158356 - DNA, 618 bp, Homo sapiens
  misc_feature: GYAE6OF02JNUYT.36.67.G01.1.454.CMB.1.raw
tcagtacgctgtctcacgaccggtgctcgatttagagtatacatattgggtttgggggaagaggaagactgacggtcccccaggagttcaggagtctgtgccgaggtgcagctggtgcagtctggagcggaggtgaaaaagcccggggagtctctgaaaatctcctgtaaggcttctggatacacctttaccaacttctggatcggctgggtgcgccagatgcccgggaaaggcctggactggatggggatcgtctatcctggtgactctgataccagatacagcccgtcttccaaggccaggtcaccatctcagtcgacaagtccatcagcaccgcctacctcactggaagtcgcctggaacgcctcggaccaccgtccatatacgttactgtgcgagacagtggaagctaatagtgggtaacttagttttgggtggggggtcctggcgttcgggggcctaggggaacccgttgggtaccgacccggttccgtcccgtaccgacgtcccctcccaacccgaacgggccctacgtccggtccttcccccgtacgggccctaccccggttccctacccgaaggccgtcccgacccgtcggtccggggaccacgcccggg

SEQ ID NO: 158357 - DNA, 556 bp, Homo sapiens
  misc_feature: GYAE6OF02HJ915.36.67.G01.1.454.CMB.1.raw
tcagtacgctgtctcacgaccggtgctcgatttagagtatacatattgggtttgggggaagaggaagactgacggtccccccaggagttcaggagtctgtgccgaggtgcagctggtgcattctggagcggaggtgaaaaagcccggggagtctctgaaaatctcctgtaaggcttctggatacacctttaccaacttctggatcggctgggtgcgccagatgcccgggaaaggcctggactggatggggatcgtctatcctggtgactctgataccagatacagcccgtccttccaaggccaggtcaccatctcagtcgacaagtccatcagcaccgcctacctccactggatagcctgaaggcctcggacaccgccatatattactgtgcgagacatggaagctatagtgggaactagttttgggtggggggcctggcgtggggccgagggaaccctggtcgaccgtctcctcacgcctccaccaacggcccagtccggtccttcccccgtggccgcccgtcgccgtccacggacgccaccctccgagacgccg

SEQ ID NO: 158358 - DNA, 551 bp, Homo sapiens
  misc_feature: GYAE6OF02GLILT.36.67.G01.1.454.CMB.1.raw
tcagtacgctgtctcacgaccggtgctcgatttagagtatacatattgggtttgggctcaaccgccatcctcgccctcctcctggctgttctccaaggagtctgtgccgaggtgcagctggtgcagtctggagcggaggtgaaaaagcccggggagtctctgaaaatctcctgtaaggcttctggatacacctttaccaacttctggatcggctgggtgcgccagatgcccgggaaaggcctggactggatggggatcgtctatcctggtgactctgataccagatacagcccgtccttccaaggccaggtcaccatctcagtcgacaagtccatcagcaccgcctacctccactggagtacgcctgaacggcctcggaccacccgccatactattactgtgcgagacatggaagctagtagtggaacttagtttgggtggggggcctggcgtggggccagggaccctggtcaccgtctcctcagcctccaccgacgggcccagtccggtccttccccgtggccctaccctccctaccacgcgcctacccg

SEQ ID NO: 158359 - DNA, 569 bp, Homo sapiens
  misc_feature: GYAE6OF02GBKZG.36.67.G01.1.454.CMB.1.raw
tcagtacgctgtctcacgaccggtgctcgatttagagtatacatattgggtttgggctcaaccgccatcctcgccctcctcctggctgttctccaaggagtctgtgccgaggtgcagctggtgcagtctggagcggaggtgaaaaagcccggggagtctctgaaaatctcctgtaaggcttctggatacacctttaccaacttctggatcggctgggtgcgccagatggcccgggaaaggcctggactggatggggatcgtctatcctggtgactctgataccagatacagcccgtcctccaaggccaggtccaccatctcagtcgacaacgtccatcagccaccgcctacctccactggatagcctgaacgcctcggacaccgccatactattactgtgcgagacataggaacgctaatggtaggaacttaggtttgggcgggggtctggcgtggggccgacgggtacccgtggtcctaccgtctccgtcgacgtcctccaccgacgggcccagttcccggtcccttccccgtaggcccacccctccctaccaacgacgcctacccgg

SEQ ID NO: 158360 - DNA, 589 bp, Homo sapiens
  misc_feature: GYAE6OF02GLMVX.36.67.G01.1.454.CMB.1.raw
tcagtacgctgtctcacgaccggtgctcgatttagagtatacatattgggtttggggggaagaggaagactgacggtccccccaggagttcaggagtctgtgccgaggtgcagctggtgcattctggagcggaggtgaaaaagcccggggagtctctgaaaatctcctgtaaggcttctggatacacctttaccaacttctggatcggctgggtgcgccagatgcccgggaaaggcctggactggatggggatcgtctatcctggtgactctgataccagatacagcccgtccttccaaggccaggtcaccatctcagtcgacaagtccatcagcaccgccctacctccactggagtacgcctaggaacggcctcggacaccgccatatattactgtcgcgagacatggaagctagtagtaggaacttagtttgggtgggggtctggcgtggggccgacgggacccgtcggtccgaccgtcctccgtcgtacgcctaccaccgaacgggccctacgtccggtcccttccccgtcggccctacccctcccgtaccgaacgacgccgtacctcggtcggggaccacgacgg

SEQ ID NO: 158361 - DNA, 573 bp, Homo sapiens
  misc_feature: GYAE6OF02GRD3N.36.67.G01.1.454.CMB.1.raw
tcagtacgctgtctcacgaccggtgctcgatttagagtatacatattgggtttgggggaagaggaagactgacggtccccccaggagttcaggagtctgtgccgaggtgcagctggtgcattctggagcggaggtgaaaaagcccggggagtctctgaaaatctcctgtaaggcttctggatacacctttaccaacttctggatcggctgggtgcgccagatgcccgggaaaggcctggactggatggggatcgtctatcctggtgactctgataccagatacagcccgtccttccaaggccaggtcaccatctcagtcgacaagtccatcagcaccgcctacctccactggatagcctgaagcctcggacaccgcatatattactgtgcgagacatgaagctatagtggaactagttttgggtggggggtctggcgtggggccagggaacccgtggtccgaccgtcctcctccgacgccctccaccgaacgggcccacgtccggtccttccccgtcggccctacccctccctacccgaacgacgccacccgtccgtcggggtccacgaccgg

SEQ ID NO: 158362 - DNA, 576 bp, Homo sapiens
  misc_feature: GYAE6OF02F8CS9.36.67.G01.1.454.CMB.1.raw
tcagtacgctgtctcacgaccggtgctcgatttagagtatacatattgggtttgggggaagaggaagactgacggtccccccaggagttcaggagtctgtgccgaggtgcagctggtgcagtctggagcggaggtgaaaaagcccggggagtctctgaaaatctcctgtaaggcttctggatacacctttaccaacttctggatcggctgggtgcgccagatgcccgggaaaggcctggactggatggggatcgtctatcctggtgactctgataccagatacagcccgtccttccaaggccaggtcaccatctcagtcgacaagtccatcagcaccgcctacctccactggagtagcctgaacggcctcggacaccgccatatacttactgtgcgagacatggaagctagtagtagggaacttagtttgggtgggggcctggcgtggggccgacgggacccgtggtccaccgtcctcctcgacgtcctccaccgaacgggcccacgtccggtccttcccccgtcggccctaccctccctccgaacgacgccaccgtccgtcggggccacgaccgg

SEQ ID NO: 158363 - DNA, 173 bp, Homo sapiens
  misc_feature: GYAE6OF02HUEL1.36.67.G01.1.454.CMB.1.raw
  modified_base (173)..(173): a, c, t, g, unknown or other
  misc_feature (173)..(173): n is a, c, g, or t
tcagtacgctgtctcacgaccggtgctcgatttagagtatacatattgggtttgggggaagaggaagactgacggtcccccaggagttcaggtgctggtcacagcggccctgggctgcctggtcaaggactacttccagacagcgtactgagcgggctggcaaggcgcatagn

SEQ ID NO: 158364 - DNA, 715 bp, Homo sapiens
  misc_feature: GYAE6OF02HZVSV.36.67.G01.1.454.CMB.1.raw
  modified_base (338)..(338): a, c, t, g, unknown or other
  misc_feature (338)..(338): n is a, c, g, or t
  modified_base (400)..(400): a, c, t, g, unknown or other
  misc_feature (400)..(400): n is a, c, g, or t
  modified_base (421)..(421): a, c, t, g, unknown or other
  misc_feature (421)..(421): n is a, c, g, or t
  modified_base (430)..(430): a, c, t, g, unknown or other
  misc_feature (430)..(430): n is a, c, g, or t
tcagtacgctgtctcacgaccggtgctcgatttagagtatacatattgggtttgggggtaaggagggaaggactgacggtccccccacggagttcaggagtctgtgccgaggtgcagctggtgcagtctggagcggaggtgaaaaggcccggggagtctctaggaaaatctcctgtaaggcttctggatactacctttaccaacttcgtggatcggcgtgggtgcgaccagagtcggacccgggaaaggcctgggactgggaatggggatcgtctatcctggtcgactctgactacagatacacgccccttcttccgaaggcccaggtccaccatccnctagcgacaagtccatcagccaccgcctctccactggatacgcctaggaagccctcggaacncccgcaagttataagttaccngtcgacganacagtagaagtacgtaagttacgggtaggtaaacgtttaggttttggggtacgggggtccggtggtccggtcggggtaccgaacggggtaacccgttcgggtacccgtaacccggttcctcccgtaccgtacccgacccgtacccgaaaccggtaaacccgggtccccgtaaccggtcccggtttaccccgttccccgtcccggtccccgtacccgttccccgttaacccgaaccggtaccgacccgtacccgtacccgggtcggggtacccgaccggtaacggg

SEQ ID NO: 158365 - DNA, 581 bp, Homo sapiens
  misc_feature: GYAE6OF02F7JGN.36.67.G01.1.454.CMB.1.raw
tcagtacgctgtctcacgaccggtgctcgatttagagtatacatattgggtttggggggaagaggaagactgacggtccccccaggagttcaggagtctgtgccgaggtgcagctggtgcattctggagcggaggtgaaaaagcccggggagtctctgaaaatctcctgtaaggcttctggatacacctttaccaacttctggatcggctgggtgcgccagatgcccgggaaagcctggactggatggggatcgtctatcctggtgactctgataccagatacagcccgtccttccaaggccaggtccaccatcctcagtcgaacaagtccatcagccaccgcctacctccactggacgtagcctagaacggcctcggacaccgccaatatacttactgagcgagacatggaagctataggtaggtaacttagtttggggtcgggggcctggcgtggggccgtacgggaaccctggtccaccgtctccgtcgacgcctccaacgacggcccacgtccgtccttccccgtcgccctacccgtccctacgaacgacgccgtaccgtcggtcgggccacgacgg

SEQ ID NO: 158366 - DNA, 545 bp, Homo sapiens
  misc_feature: GYAE6OF02HKAW9.36.67.G01.1.454.CMB.1.raw
tcagtacgctgtctcacgaccggtgctcgatttagagtatacatattgggtttgggggaagaggaagactgacggtccccccaggagttcaggagtctgtgccgaggtgcagctggtgcagtctggagcggaggtgaaaaagcccggggagtctctgaaaatctcctgtaaggcttctggatacacctttaccaacttctggatcggctgggtgcgccagatgcccgggaaaggcctggactggatggggatcgtctatcctggtgactctgataccagatacagcccgtccttccaaggccaggtcaccatctcagtcgacaagtccatcagcaccgcctacctccactggagtagcctgaaggcctcggacaccgccatatattactgtgcgagacatggaagctatagtggaactatttggtggggggctggcgtggggcagggaaccctggtccaccgtctcctcagcctccaccaaggcccagtccgtcttcccccgtggccaccctcctacccaagacgccacctcgtcgggcacacgg

SEQ ID NO: 158367 - DNA, 662 bp, Homo sapiens
  misc_feature: GYAE6OF02H9J8V.36.67.G01.1.454.CMB.1.raw
  modified_base (319)..(319): a, c, t, g, unknown or other
  misc_feature (319)..(319): n is a, c, g, or t
tcagtacgctgtctcacgaccggtgctcgatttagagtatacatattgggtttgggctcaaccgccatcctctccctcctcctggctgttctccaaggagtctgtgccgaggtgcagctggtgcagtctggagcggaggtgaaaaagcccggggagtctctgaaaatctcctgtaaggcttctggatacacctttaccaacttctggatcggctgggtgcgccagatcgacccgggaaaggcctggactggatggggatcggtctatcctggtgactctgataccagatacagcccgtccttcaagccaggtcacatcncagtcgacaacgtccatcagccaccgcctacctccactggacgtacgcctagacggcctacggacaccgacatatactactgtgcgagactagtaggaagtctaagtaggtacgggtaactttaggttttacggggtgggggggtcctgggccggttacgggggacccgtaacggggtaaccccgttgggtacccgtaacccggttcccgttccgtaccgaccgtccccttaccccgaacccggtaaccggggcccctaacggttccccgggttcccctttaccccccgtgggtaccccctaccccgtcccgttaaccccgaacggtccgaccctaaccccgg

SEQ ID NO: 158368 - DNA, 190 bp, Homo sapiens
  misc_feature: GYAE6OF02GY4XD.36.67.G01.1.454.CMB.1.raw
  modified_base (181)..(190): a, c, t, g, unknown or other
  misc_feature (181)..(190): n is a, c, g, or t
tcagtacgctgtctcacgaccggtgctcgatttagagtatacatattgggtttgggttttggggggaagaggaagactgacggtcccccaggagttcaggtgctgggcacagcggccctgggctgcctggtcaaggactacttccagacagcgtactgagcgggctggcaaggcgcatagnnnnnnnnnn

SEQ ID NO: 158369 - DNA, 523 bp, Homo sapiens
  misc_feature: GYAE6OF02GLN6V.36.67.G01.1.454.CMB.1.raw
  modified_base (226)..(226): a, c, t, g, unknown or other
  misc_feature (226)..(226): n is a, c, g, or t
tcagtacgctgtctcacgaccggtgctcgatttagagtatacatattgggtttgggggcagaagtctctctcagtcaggacacagcatggacatgagggtccctgctcagctcctgggactcctgctgctctggctcccagataccagatgtgacatccagatgacccagtttccatcctccctgtctgcatctgtaggagacagagtcaccatcacttgccgggnagtcagggcattaacaatcatttagcctggtatcagcagaaaccagggaaagctcctaagctcctgatatatgctgtattcactgtgcaatcggggtccatctcgttcagtggcagtggatagtgggacagtatttcgtactcgtcacactcagtcagcctgcacgcctgaagatgttgactaactttattagttacgtaactaaaagttaataactagtacgtaccccgtcttacctacgtttacggacggtaacgggaccgtaacggtacggaagtacgtacgaaacgtaaccgg

SEQ ID NO: 158370 - DNA, 568 bp, Homo sapiens
  misc_feature: GYAE6OF02JHXML.36.67.G01.1.454.CMB.1.raw
  modified_base (348)..(348): a, c, t, g, unknown or other
  misc_feature (348)..(348): n is a, c, g, or t
  modified_base (399)..(399): a, c, t, g, unknown or other
  misc_feature (399)..(399): n is a, c, g, or t
  modified_base (408)..(408): a, c, t, g, unknown or other
  misc_feature (408)..(408): n is a, c, g, or t
  modified_base (433)..(433): a, c, t, g, unknown or other
  misc_feature (433)..(433): n is a, c, g, or t
tcagtacgctgtctcacgaccggtgctcgatttagagtatacatattgggtttgggctcaaccgccatcctcgccctcctcctggctgttctccaaggagtctgtgccgaggtgcagctggtgcagtctggagcggaggtgaaaagcccggggagtctctgaaaatctcctgtaaggcttctggatacacctttaccaacttctggatcggctgggtgcgccagatgcccgggaaaggcctggactggatggggatcgtctatcctggtgactctgataccagatacagcccgtccttccaaggccaggtcaccatctcagtcgacaagtccatcagcaccgcctacnccactggatagcctgaacggcctcggacaccgccatatattactgtgcganacatggaanctataggtggaacttagttttgggnggggggtacctggcgtggggaccacggggtaacccgtgggtccgaccgttcgtcctcgacgcctccaccgacgggccctagtccggtccttcccccgtggccctaccccgtccctaccgaacgacgcctacccgg

SEQ ID NO: 158371 - DNA, 588 bp, Homo sapiens
  misc_feature: GYAE6OF02GUEI7.36.67.G01.1.454.CMB.1.raw
tcagtacgctgtctcacgaccggtgctcgatttagagtatacatattgggtttgggggaagaggaagactgacggtccccccaggagttcaggagtctgtgccgaggtgcagctggtgcagtctggagcggaggtgaaaaagcccggggagtctctgaaaatctcctgtaaggcttctggatacacctttaccaacttctggatcggctgggtgcgccagatgcccgggaaaggcctggactggatggggatcgtctatcctggtgactctgataccagatacagcccgtcttccaaggccaggtcaccatctcagtcgacaagtccatcagcaccgcctacctccactggatagcctgaacggcctcggacaccgccatactattactgtcgcgagacagtaggaagctataggtagggtaacgttagttttgggtcggggggtccgtggcgtcggggccgtacgggaacccgtggtccgaccgtctcctcgacgccctccgacccgaacggcccacgtccggtccttccccgtcggccctacccctccctacccaacgacgccaccgtccgtcggggccacgacgg

SEQ ID NO: 158372 - DNA, 181 bp, Homo sapiens
  misc_feature: GYAE6OF02IKTJ7.36.67.G01.1.454.CMB.1.raw
  modified_base (181)..(181): a, c, t, g, unknown or other
  misc_feature (181)..(181): n is a, c, g, or t
tcagtacgctgtctcacgaccggtgctcgatttagagtatacatattgggtttgggttttgggggaagaggaagactgacggtccccccaggagttcaggtgctgggcacagcggccctgggctgcctggtcaaggactacttccagacagcgtactgagcgggctggcaaggcgcatagn

SEQ ID NO: 158373 - DNA, 490 bp, Homo sapiens
  misc_feature: GYAE6OF02IMWTZ.36.67.G01.1.454.CMB.1.raw
  modified_base (201)..(201): a, c, t, g, unknown or other
  misc_feature (201)..(201): n is a, c, g, or t
  modified_base (206)..(206): a, c, t, g, unknown or other
  misc_feature (206)..(206): n is a, c, g, or t
  modified_base (289)..(289): a, c, t, g, unknown or other
  misc_feature (289)..(289): n is a, c, g, or t
  modified_base (357)..(357): a, c, t, g, unknown or other
  misc_feature (357)..(357): n is a, c, g, or t
  modified_base (389)..(389): a, c, t, g, unknown or other
  misc_feature (389)..(389): n is a, c, g, or t
tcagtacgctgtctcacgaccggtgctcgatttagagtatacatattgggtttgggggcagaagtctctctcagtcaggacacagcatggacatgagggtccctgctcagctcctgggactcctgctgctctggctcccagataccagatgtgacatccagatgacccagtttccatcctccctgtctgcatctgtagganacagngtcaccatcacttgccgggcgagtcagggcaataacaatcatttagcctggtatcagcagaaacaggaaagctccaagctccngatagtatgctgtatcatgtagcaatcgagggtcccatctcggtcagtgcagtgagtagtggacggtnttcactctcacctatcagcagcctgcagccgngaagatgtacactaacttattattagtataaagtatagacagtcgcccgtctacgacgtttacggagggacggtaacgagggtacggagacgtataaacgg

SEQ ID NO: 158374 - DNA, 565 bp, Homo sapiens
  misc_feature: GYAE6OF02JDTK1.36.67.G01.1.454.CMB.1.raw
tcagtacgctgtctcacgaccggtgctcgatttagagtatacatattgggtttgggctcaaccgccatcctcgccctcctcctggctgttctccaaggagtctgtgccgaggtgcagctggtgcagtctggagcggaggtgaaaaagcccggggagtctctgaaaatctcctgtaaggcttctggatacacctttaccaacttctggatcggctgggtgcgccagatgcccgggaaaggcctggactggatggggatcgtctatcctggtgactctgataccagatacagcccgtccttccaaggccaggtcaccatctcagtcgacaagtccatcagcaccgcctacctccactggagtagcctgaaggcctcggacaccgccatatattactgtgcgagacatggaagctatagtgggaacttagttttgggtggggggtcctggcgtggggccagggaaccctgggtccaccgtctccctcgacgccctccgaccgaacgggccccaatccgggtcccttcccccgtggccctaccctccctaccgaacgacgcctaacccg

SEQ ID NO: 158375 - DNA, 744 bp, Homo sapiens
  misc_feature: GYAE6OF02IAWMT.36.67.G01.1.454.CMB.1.raw
  modified_base (340)..(340): a, c, t, g, unknown or other
  misc_feature (340)..(340): n is a, c, g, or t
tcagtacgctgtctcacgaccggtgctcgatttagagtatacatattgggtttgggctcaaccgccatcctcgccctcctcctggctgttctccaaggagtctgtgccgaggtgcagctggtgcagtctggagcggaggtgaaaaagcccggggagtctctgaaaatctcctgtaaggcttctggatacacctttaccaacttctggatcggctgggtgcgccagatcggacccgggaaggcctggactggagtggggatcgtctatccgtggtgactctgactaccagactacacgcccgtccttacgaacggcccaggtccacctatctacagtcganaacgtccaatcagccaccgcctacccgtcaactggaacgttacgccgtaaggaacggtccctacggaacccacccgaccgtaactttaactttaactttaaccgttcggttacggaccggtaaacgaacgtaagtacgggaaacgtccgttaaagttaacgggttaggggttaaaccgtttagggttttttacggggggcggggggggttaccctgggtaccggttcgggggaccccggtaaaggggtaaaccccgttgggtacccgtaacccgggttcctcccggtacctacggtccccttacccgaaccggtacccgggccctaccggttcccggttccccgtttcccccgacgggtcccttacccccgtcccgtacccgaacgtaccggcccttaacccgg

SEQ ID NO: 158376 - DNA, 599 bp, Homo sapiens
  misc_feature: GYAE6OF02IRLH5.36.67.G01.1.454.CMB.1.raw
  modified_base (409)..(409): a, c, t, g, unknown or other
  misc_feature (409)..(409): n is a, c, g, or t
tcagtacgctgtctcacgaccggtgctcgatttagagtatacatattgggtttggggggaagaggaagactgacggtccccccaggagttcaggagtctgtgccgaggtgcagctggtgcagtctggagcggaggtgaaaaagcccggggagtctctgaaaatctcctgtaaggcttctggatacacctttaccaacttctggatcggctgggtgcgccagatgcccgggaaaggcctggactggatggggatcgtctatcctggtgactctgataccagatacagcccgtccttccaaggccaggtcaccatctcagtcgacaagtccatcagcaccgcctacctccactggatagcctgaacggcctcggacacccgaccatatacttactgtgcgagacatggaanctagtagtaggtatagtttgggtgggggctgcgtgggccgagggaccctggtcgaccgttctcctcacgcctccaccgaacgggcccagttccggtccctttacccccgtgggtccccctaccccgttcccgtacccgtaaaccggacggacccgtacccttccgggtcgggggccctaacggacccggg

SEQ ID NO: 158377 - DNA, 625 bp, Homo sapiens
  misc_feature: GYAE6OF02IY4NB.36.67.G01.1.454.CMB.1.raw
tcagtacgctgtctcacgaccggtgctcgatttagagtatacatattgggtttgggctcaaccgccatcctcgccctcctcctggctgttctccaaggagtctgtgccgaggtgcagctggtgcagtctggagcggaggtgaaaaagcccggggagtctctgaaaatctcctgtaaggcttctggatacacctttaccaacttctggatcggctgggtgcgccagatggcccgggaaaggcctggactggagtggggatcgtctatcctggtgactctgataccagatacacgcccgtccttccaaggccaggtcaccatctcagtcgacaacgtccatcacgccaccgcctaccctccactggagtacgcctaggaacgccctacggaccaccgccaatactacttactgtgcgagacagtaggaagctagtaggttaggtaacgtttagttttcggggtcgggggtcctggtcggtcggggaccgtacgggtacccgtcgggtccgaccgttcctccgtcgaccgtccctcccgaaccgacccgggtcccacggttcccggttaccccgttccccgtccggcccctacccctcccgtaccgaaccggtaccgaccctacccgg

SEQ ID NO: 158378 - DNA, 183 bp, Homo sapiens
  misc_feature: GYAE6OF02FP6C7.36.67.G01.1.454.CMB.1.raw
  modified_base (182)..(183): a, c, t, g, unknown or other
  misc_feature (182)..(183): n is a, c, g, or t
tcagtacgctgtctcacgaccggtgctcgatttagagtatacatattgggtttgggttttggggggaagaggaagactgacggtccccccaggagttcaggtgctgggcacagcggccctgggctgcctggtcaaggactacttccagacagcgtactgagcgggctggcaaggcgcatagnn

SEQ ID NO: 158379 - DNA, 544 bp, Homo sapiens
  misc_feature: GYAE6OF02HA8G3.36.67.G01.1.454.CMB.1.raw
  modified_base (480)..(480): a, c, t, g, unknown or other
  misc_feature (480)..(480): n is a, c, g, or t
tcagtacgctgtctcacgaccggtgctcgatttagagtatacatattgggtttgggggcagaagtctctctcagtcaggacacagcatggacatgagggtccctgctcagctcctgggactcctgctgctctggctcccagataccagatgtgacatccagatgacccagtttccatcctcctgtctgcatctgtaggagacagagtcaccatcacttgccgggcagtcagggcataacaatctattacgcctggtatcagacacgaaaccgagggaacgctaccgtaagcctcctgatatatgtctgtacttcactgtcgactaatcgacgggtcccagtccgtcgttcgagtggactaggtacgataggtgggtacgtatttcactcctacacctatacagcagcctgacacgtccagagtgttgtatactaattattattcgtaacaaagtgtacgtacgacggttccgaccccgtnttaccgtacgtttacgggacggtaacggtacgtaagggtacggaacgtacgtaacgtaaaccgg

SEQ ID NO: 158380 - DNA, 578 bp, Homo sapiens
  misc_feature: GYAE6OF02IK30Y.36.67.G01.1.454.CMB.1.raw
tcagtacgctgtctcacgaccggtgctcgatttagagtatacatattgggtttgggctcaaccgccatcctcgccctcctcctggctgttctccaaggagtctgtgccgaggtgcagctggtgcagtctggagcggaggtgaaaaagcccggggagtctctgaaaatctcctgtaaggcttctggatacacctttaccaacttctggatcggctgggtgcgccagatgcccgggaaaggcctggactggatggggatcgtctatcctggtgactctgataccagatacagccccgtccttccaagggcccagggtcaccatcctcagtcgacaagtccatcagcaccgcctacctccactggagtagcctgaacgcctacggacaccgccatatacttactgtgcgagacataggaagctagtagtagggtaacttagtttgggtggggggtcctggcgtcggggaccgacgggtaaccctgggtccgaccgttcctccgtcgacgccctccgaccaacgggcccacgtccggtccgttccccgtggccctaccctccacccgaagaccgctacccgg

SEQ ID NO: 158381 - DNA, 865 bp, Homo sapiens
  misc_feature: GYAE6OF02I0102.36.67.G01.1.454.CMB.1.raw
tcagtacgctgtctcacgaccggtgctcgatttagagtatacatattgggtttggggggaagaggaagactgacggtccccccaggagttcaggagtctgtgccgaggtgcagctggtgcattctggagcggaggtgaaaaagcccggggagtctctgaaaatctcctgtaaggcttctggatactacctttaccaacttctgatcggctgggtgcgccagagtcggacccgggaaaggcctggacgtggagtggggatccgtactacgttccgtggtacgactctagaactaccagtaactacacgtccccgttaccttaccgaacggccaggtccacctaagtctacaggtaccaacgtacgtccaatcagcccaccgtcctaaccctccagtggacgtacgccgtaggaaccgcctacggacctaccgactaattaacttagttacgtaggtcgaccgaagtaacaagttagggaaacgtactaaaggttaacgggtaacgggttaaaccgtttagggtttttacggggggtcggggggttaccttcgggtaccggggttaccgggggtaacccggtaaaccggggttaaaccccgggttacggggttaccctaacccggggtttccctttaaccccgtccggtaacccggttacccctaaccccggtaaacccggtaaacccggggtacccccgtaaccggtttcccccgggtttaccccgtttttacccccccggtacgggttacccccccaaacccccggtttacccccggtaaccccggtaaaagggtccccgtaaccccgttaaccccgggttcccggggttaacccgggggaccctaaccccgggtaaccccgggg

SEQ ID NO: 158382 - DNA, 563 bp, Homo sapiens
  misc_feature: GYAE6OF02GX9KP.36.67.G01.1.454.CMB.1.raw
  modified_base (319)..(319): a, c, t, g, unknown or other
  misc_feature (319)..(319): n is a, c, g, or t
  modified_base (412)..(412): a, c, t, g, unknown or other
  misc_feature (412)..(412): n is a, c, g, or t
  modified_base (436)..(436): a, c, t, g, unknown or other
  misc_feature (436)..(436): n is a, c, g, or t
tcagtacgctgtctcacgaccggtgctcgatttagagtatacatattgggtttgggctcaaccgccatcctcgccctcctcctggctgttctccaaggagtctgtgccgaggtgcagctggtgcagtctggagcggaggtgaaaaagcccggggagtctctgaaaatctcctgtaaggcttctggatacacctttaccaacttctggatcggctgggtgcgccagatgcccgggaaaggcctggactggatggggatcgtctatcctggtgactctgataccagatacagcccgtccttccaaggccaggtcaccatcncagtcgacaagtccatcagcaccgcctacctccactggagtacgcctgaacggcctcggacaccgcatatattactgtgcgagacataggaanctatagtggaacttagttttgggnggggggtctggcgtggggccgaggggaccctgggtccaccgtcctcctcgacgcctccaccgacgggcccagtccggtccttcccccgtggccctacccgttccctacccgaacgtacgcctacccg

SEQ ID NO: 158383 - DNA, 509 bp, Homo sapiens
  misc_feature: GYAE6OF02HWVBZ.36.67.G01.1.454.CMB.1.raw
  modified_base (441)..(441): a, c, t, g, unknown or other
  misc_feature (441)..(441): n is a, c, g, or t
tcagtacgctgtctcacgaccggtgctcgatttagagtatacatattgggtttgggggcagaagtctctctcagtcaggacacagcatggacatgagggtccctgctcagctcctgggactcctgctgctctggctcccagataccagatgtgacatccagatgacccagtttccatcctccctgtctgcatctgtaggagacagagtcaccatcacttgccggcgagtcagggcattaacaatcattagcctggtatcagcaagaaaccagggaaacgctcctaagctcctgatatatgctgtattcactgtgcaatcgacgggtcccatcgtcgttcagtggcgtagtggatagtgggacgtatttcacttctcaaccatcagcagcctgcagcctagaagtattgttcgacttaacttattattagtaacaaagttanagactagtcgccccgtacttcctacgttcggcggtacgggaccgaagggtgaacgtatacgtaaacgg

SEQ ID NO: 158384 - DNA, 673 bp, Homo sapiens
  misc_feature: GYAE6OF02IUTLT.36.67.G01.1.454.CMB.1.raw
tcagtacgctgtctcacgaccggtgctcgatttagagtatacatattgggtttggggggaagaggaagactgacggtccccccaggagttcaggagtctgtgccgaggtgcagctggtgcattctggagcggaggtgaaaaagcccggggagtctctgaaaatctcctgtaaggcttctggatacacctttaccaacttctggatcggctgggtgcgccagatggacccgggaaagcctggactggagtggggatcgtctatccgtggtgactctgactaccagactacgacgcccgtccttaccgaaggccaggtccaccatctcagtccgacaacgtccatcagccacccgcctacctccacgtggacgtacgcctaggaacgccctacggaaccacccgactatattacttactggtcgacgagactagtacggaagcgtaagtaggtagggtaacgtttaggtttggggtcgggggtaccgtggtccggtcggggccgtaacggggtacccgttcggtaccgtaccgttcctacccgtcgaccgtccctcccgaaccgaaccgggcccctacggttcccggttcccttcccccgtcggtacccctaccccgtccccgtaccgaaccgccgtacctacccggttcggtaccggggaccacggtacccggg

SEQ ID NO: 158385 - DNA, 640 bp, Homo sapiens
  misc_feature: GYAE6OF02GOBHB.36.67.G01.1.454.CMB.1.raw
tcagtacgctgtctcacgaccggtgctcgatttagagtatacatattgggtttggggggaagaggaagactgacggtccccccaggagttcaggagtctgtgccgaggtgcagctggtgcagtctggagcggaggtgaaaaagcccggggagtctctgaaaatctcctgtaaggcttctggatacacctttaccaacttctggatcggctgggtgcgccagatcggacccggggaaaggcctggactgggagtgggggatcgtctatcctggtgactctgataccagatacacgcccgtccttaccgaaggccaggtccaccatcctcagtccgaacaagtccatccgagccacccgccctacctccacgtggactacgcctaggacgcctcggaccaccgcctatattacttacgtgtcgacgagactagtaggaatcgttagtaggtacgggtaattaggttttggggtcggggggtctcggtcggtcggggaccgacgggtacccgtggtccaccggttctccctcgaccgtccctacccgaccgaaccggccctacgttccggttcccttccccgtcggccctacccgtcctaccgaacgccgacccgtccgtcgggtacgggcccacggacccgg

SEQ ID NO: 158386 - DNA, 656 bp, Homo sapiens
  misc_feature: GYAE6OF02JV05X.36.67.G01.1.454.CMB.1.raw
tcagtacgctgtctcacgaccggtgctcgatttagagtatacatattgggtttgggctcaaccgccatcctcgccctcctcctggctgttctccaaggagtctgtgccgaggtgcagctggtgcagtctggagcggaggtgaaaaagcccggggagtctctgaaaatctcctgtaaggcttctggatacacctttaccaacttctggatcggctgggtgcgccagatcgacccgggaaaggcctggactggagtggggatcgtctatcctggtgactctgataccagatacagcccgtccttaccgaacggccaggtccaccatcctcgagtcgacaacgtcatcagccaccgcctacctccacgtcggagtacgcctaggaacgtcctaccggacacccgcctaatactacttacgtgtacgacgaagacctaagtacggaagtcctaagtacggttagggtaactttaggttttgggggtacggggggtcctcggtcggtcggggaccgtacgggtaacccgttggtaccaccgtccgtaccgtcgacgtccctaccgaccgtaaccgggtccctaacgtttcccgggtacccctttccccgcggtacccgtacccccgtccgtacccgtaacggtacccgtaccgttacccgg

SEQ ID NO: 158387 - DNA, 181 bp, Homo sapiens; identical to SEQ ID NO: 158372
  misc_feature: GYAE6OF02HM4XX.36.67.G01.1.454.CMB.1.raw
  modified_base (181)..(181): a, c, t, g, unknown or other
  misc_feature (181)..(181): n is a, c, g, or t

SEQ ID NO: 158388 - DNA, 590 bp, Homo sapiens
  misc_feature: GYAE6OF02GJRE0.36.67.G01.1.454.CMB.1.raw
tcagtacgctgtctcacgaccggtgctcgatttagagtatacatattgggtttggggggaagaggaagactgacggtccccccaggagttcaggagtctgtgccgaggtgcagctggtgcagtctggagcggaggtgaaaaagcccggggagtctctgaaaatctcctgtaaggcttctggatacacctttaccaacttctggatcggctgggtgcgccagatgcccgggaaaggcctggactggatggggatcgtctatcctggtgactctgataccagatacacgcccgtcttccaaggccaggtcaccatctcagtcgacagtccatcagcaccgcctacctccactggagtagcctgacgcctcggacaccgcatatattactgtgcgagacagtagaagtctagtaggtggtaacgttagttttggggtggggggtcctggcgtcggggccgacgggaccctgggtccgaccgttccgtcctcgacgccctccaccgaacggccctacgtaccggttcctccccgtcggaccctaccccgtaccctccgaacgaccgcctacccgtcggtcggggccacgtccgg

SEQ ID NO: 158389 - DNA, 550 bp, Homo sapiens
  misc_feature: GYAE6OF02IE9S8.36.67.G01.1.454.CMB.1.raw
  modified_base (201)..(201): a, c, t, g, unknown or other
  misc_feature (201)..(201): n is a, c, g, or t
tcagtacgctgtctcacgaccggtgctcgatttagagtatacatattgggtttgggggcagaagtctctctcagtcaggacacagcatggacatgagggtccctgctcagctcctgggactcctgctgctctggctcccagataccagatgtgacatccagatcgacccagtttccatcctccctgtctgcatctgtaganacagagtcaccatcacttgccgggcagtcgagggcattaacatcattacgctggtatcagcaagaaccaggaaagctacaagctacctgactatatgtctgtatcatgtgcaagtcgacgggtcccagtccgtcggttcaggtcggcaggtcggagtagtgggtacgtatttcacgtctacacatcagcacgcctgccacgcctagaatgttacgttcgacttaaactttatttacgttagtaaactaaaagttacgtagaacctaggtccgtaaccccggtcttacgttacccgtttcgggaccggtacgggtaaccgtaagggtacggaagtactaacgtaaaccgg

SEQ ID NO: 158390 - DNA, 633 bp, Homo sapiens
  misc_feature: GYAE6OF02HCCLF.36.67.G01.1.454.CMB.1.raw
  modified_base (328)..(328): a, c, t, g, unknown or other
  misc_feature (328)..(328): n is a, c, g, or t
tcagtacgctgtctcacgaccggtgctcgatttagagtatacatattgggtttgggctcaaccgccatcctcgccctcctcctggctgttctccaaggagtctgtgccgaggtgcagctggtgcagtctggagcggaggtgaaaaaggcccggggagtctctgaaaatctcctgtaaggcttctggatactacctttaccaacttctggatcggctgggtgcgccagatggcccgggaaaggcctggactggagtggggatcgtctatccgtggtgactctgactaccagactacacgtccccgttcttaccaaggccaggtccaccntcctcagtcgaacaacgtccatcacgcacccgcctacctccacgtggagtacgcctaggaacgtccctacggaccacccgcctatacttacttacgtgtcgacgagaactagtagggaatctagttaggagggtaactttggtttggggcgggggtcctggcggtcggggaccgtacggggacccgtgggtcccaccgttccgtccgtcgccgtaccctcccgacccgaccggggtcccaggttcccggttccccttccccgtcggcccttaccccgtcctacccgaacgtcgacccgtacccgg

SEQ ID NO: 158391 - DNA, 702 bp, Homo sapiens
  misc_feature: GYAE6OF02JZ5JW.36.67.G01.1.454.CMB.1.raw
  modified_base (697)..(697): a, c, t, g, unknown or other
  misc_feature (697)..(697): n is a, c, g, or t
tcagtacgctgtctcacgaccggtgctcgatttagagtatacatattgggtttggggggaagaggaagactgacggtccccccaggagttcaggagtctgtgccgaggtgcagctggtgcagtctggagcggaggtgaaaagcccggggagtctctagaaaatctcctgtaaggcttcgtggatacacctttaccaacttctggatcggcgtgggtcgcgccagagtcggaccccgggaaaggccgtaggacgtgggagttcggggatccgtcgtacgttccgtgggtcacgttcgtcggtactaaccgagtaacgtaacctacggtcccccgttaccttaccgaacggccgtaacggccaaccctagtcctacgtacgtaccgaactacgtaccgataccacgtacccacccgtccctaccgccaacgtggaactcgctagaaccgcctacggaccaccgactatattaacttactagcgtacgaacgtacagtaggacgtctaaagtggtaacggttaattcgggttttacggggcggggtacctgggacggtccggggccgtaacgggtacccgttggacccgtaccgtccctaccgtaccgacgtccctaaccacggaaccggccacccggttcgttcccgtacccgcgtcccaccgtccaacgacgacctccgtaccgtcggcgggtacccncgccg

SEQ ID NO: 158392 - DNA, 769 bp, Homo sapiens
  misc_feature: GYAE6OF02J05HO.36.67.G01.1.454.CMB.1.raw
  modified_base (183)..(183): a, c, t, g, unknown or other
  misc_feature (183)..(183): n is a, c, g, or t
  modified_base (413)..(413): a, c, t, g, unknown or other
  misc_feature (413)..(413): n is a, c, g, or t
tcagtacgctgtctcacgaccggtgctcgatttagagtatacatattgggtttgggtcgtcaaccgccatcctcgccctcctcctcgctgttctccaagagtctgtgccgaggtgcagctggtgcagtctggagcggaggtagaaaagcccggggagtctctgaaatctcctgtaaggcttcnggatactacctttaccaacttctgatcggctggtgcgccagatcgcccgggaagcctggactggagtggggatcggtcttacgcctgggtagaccttctgaactaccgtaggactacagccccgttccttacccgaaaggtcctaacgggtccacactctccgacgtcgactaacgtcccatacacggcctaccggaacccttccgtacccacgttcggaacggttaacnccccttgaaacggggtcccctcggaacccggacccgtcctaacttacttataccttacgttccgacgtacgacgtaacgtaggtaacggactaacgtaggttacggtaacgttagtttcggggttacggggggtccgtacggcgggttcgggtacggtaaccggggtacccgtacgggtcccgtaaccggttccttacccgtaccgtaccgtcccgtacccgtaacccgtaccggggtacccccgtaacggtttacccgggtccccgtttttaccccgggaccccggttaccccgttacccccgttacccccggttacccggttaaccggaccccgttaccgttaaccccccgggg

SEQ ID NO: 158393 - DNA, 1044 bp, Homo sapiens
  misc_feature: GYAE6OF02IC6XO.36.67.G01.1.454.CMB.1.raw
tcagtacgctgtctcacgaccggtgctcgatttagagtatacatattgggtttggggggaagaggaagactgacggtccccccaggagttcaggagtctgtgccgaggtgcagctggtgcattctggagcggaggtgaaaaagcccggggagtctctgaaaatctcctgtaaggcttctggatacacctttaccaacttctggatcggctgggtgcgccagatgcccgggaaaggcctggactggatggggatcgtctatcctggtcgactctgaactaccagataaccgacgtccccgttcctttaccgaaacgggccctaacgggtacccaaccgtacttacccgttacctaacgggttacccgaaaccgtaaacggttaccccaattaccgaaccggtacccctaaaccccggtcccccttaaccccgttacccccgtaacggttccgggggtaaacggttaaccgggccccgtttaagggaaaccccggggtccccgtttacccgggggaacccctaacccccgggtaccctaaaactttaaccgtttaaacgttttaacccgtttacgggttttaaccgggaacccgggtaaacggaacccggttaaaggtttaaccgggggtaaaacgtacccggtttaaagggttaaacggggtttacggggggttaaaaaccggtttttacggggttttttttacggggggggtaaccgggggggggttcccgtttacggggtccggggtttaccggggggaccccgggtaaaccggggggtaacccccgtttacgggggttacccgtaacccccggttcccgttaccccgttaccggtacccgttaacccgttacccccgaaacccgggtaaaccggggtccccgtaaccgttttccccgggtttacccccgtttaccccccggttccgggttaacccccgtaacccccgtttacccccgtaaccccgtaaaccggtacccggtaccccgttaacccccggttacccgggttaccggggggaccccaaccgggtacccccggggg

SEQ ID NO: 158394 - DNA, 636 bp, Homo sapiens
  misc_feature: GYAE6OF02FR9NW.36.67.G01.1.454.CMB.1.raw
tcagtacgctgtctcacgaccggtgctcgatttagagtatacatattgggtttggggggaagaggaagactgacggtccccccaggagttcaggagtctgtgccgaggtgcagctggtgcagtctggagcggaggtgaaaaagcccggggagtctctgaaaatctcctgtaaggcttctggatacacctttaccaacttctggatcggctgggtgcgccagatgcccgggaaaggcctggactggatggggatcgtctatcctggtgactctgataccagatacagcccgtccttccaaggccaggtcaccatctcagtcgacaagtccatcagccaccgcctacctccactggacgtagcctagaacggcctacggacaccgccaatactattactgtgcgagacagtaggaagtctagtagtagggtaacttagtttgggtcggggggtctggcgtcggggaccgacggggtaacccgtcggtccgacccggtccgttacccgtcgacgtccccgtacccgacccgaacgggtcccgtacgttcccggttcccttcccccgtcggtccctaccccgttccctacccgtaacgtacctacccgacccgttccggtacggggtaccaccgtaccgg

SEQ ID NO: 158395 - DNA, 839 bp, Homo sapiens
  misc_feature: GYAE6OF02HQAYC.36.67.G01.1.454.CMB.1.raw
tcagtacgctgtctcacgaccggtgctcgatttagagtatacatattgggtttgggctcaaccgccatcctcgccctcctcctggctgttctccaaggagtctgtgccgaggtgcagctggtgcagtctggagcggaggtgaaaagcccggggagtctctgaaaatctcctgtaagcttctggatacacctttaccaacttctgatcggctgggtgcgccagagtcggacccgggaaaggccgtggacgtggagtggggatcgtctatccgtggtgacgtctgactaccgagatacgccgtcccgttaccttaccgaacggaccgtacggtccacctacttcctcgaacggtacgaccaacggtaccactaccacgaccacccgtaccctaccctacccgacgtcggaacgtacggacctacggaaccggtacccgtacggtaacccgaaccccggtacctaagttaaccttaacgtttaccgtagggttaccgacggaacgacgtaaggttaacgggaaacgttaccgttaaggttaggttaaacggggttaaacgttttacgggttttcggggggtacggggggtcccttgggtaccgggtccggggggtacccggtaaaccgggtacccgggttaccgggtaccgttaaccccgggttacccttacccggtacgtaacccgccccgttaaccccgtaacccgggtaacccgggtaccccggttaaccccggtttcccgggtttacccccccgtttacccccggtacccggttcccccctaacccccggtttaaccccgaacccggtttaaaccggacccgtacccccgttacgggg

SEQ ID NO: 158396 - DNA, 739 bp, Homo sapiens
  misc_feature: GYAE6OF02HF0PX.36.67.G01.1.454.CMB.1.raw
tcagtacgctgtctcacgaccggtgctcgatttagagtatacatattgggtttgggctcaaccgccatcctcgccctcctcctggctgttctccaaggagtctgtgccgaggtgcagctggtgcagtctggagcggaggtgaaaaagcccggggagtctctgaaaatctcctgtaaggcttctggatactacctttaccaacttctggatcggctgggtgcgccagatcggacccgggaaaggcctgggactggagtggggatcgtctatcctggtgactctgactaccagactacacgtccccgtccttaccgaacggccacggtccaaccctactcctcacgtccgaacaacgtccatcacgcacccgaccctacctccacgtggacgtacgcctggaacgtcctacgggaccacccgtacctaacttaactttaactttaccgttcggtacggaccggaacgaaccgtaagttacggggtaacgtaccgttaagtaacgggttaggggttaaaccgtttagggttttaggggggtacggggggggtaccttggggtaccggttacggggggaccggtaaccgggggtaacccgtcgggttacccgtacccggttccgtaccctccgtaccggccctacccgaccggaaccggggtcccctacggtccccggttcccgttcccccggacggtcccctaccccgttaccctacccggaacggaccgtccctacccggg

SEQ ID NO: 158397 - DNA, 684 bp, Homo sapiens
  misc_feature: GYAE6OF02JCKVR.36.67.G01.1.454.CMB.1.raw
  modified_base (216)..(216): a, c, t, g, unknown or other
  misc_feature (216)..(216): n is a, c, g, or t
  modified_base (371)..(371): a, c, t, g, unknown or other
  misc_feature (371)..(371): n is a, c, g, or t
tcagtacgctgtctcacgaccggtgctcgatttagagtatacatattgggtttggggggaagaggaagactgacggtccccccaggagttcaggagtctgtgccgaggtgcagctggtgcattctggagcggaggtgaaaaagcccggggagtctctagaaaatctcctgtaaggcttctggatacacctttaccaacttctggatcggctgggtncgccagatgccgggaagcctggactggatggggatcgtctatccgtggtgactctgactaccgagactacacgtcccgtccttaccgaaggtccaggtcaccatcctacagtcaacaacgtccaatcagccaccgcctacctccactggagtacncctagaacggcctcggacaccgcaatatactatggtagacgagaacagtaggaagtctaagttaggtacgggtaaacttagggtttcggggtcggggggtactcggtacggttacggggaccgtaacggggtaacccgtggtaccgtaacccggtcgtaccccgtacgtaccggtccctacccggaaacccggtaacgggtcccctaagttcccgggttacccttaccccccggtcggtaccccaccccttaccgacccgtaaacggccgtacccgtaaccgtccgggtacgggggaccctacggtacccggg

SEQ ID NO: 158398 - DNA, 671 bp, Homo sapiens
  misc_feature: GYAE6OF02HIM8V.36.67.G01.1.454.CMB.1.raw
  modified_base (349)..(349): a, c, t, g, unknown or other
  misc_feature (349)..(349): n is a, c, g, or t
  modified_base (400)..(400): a, c, t, g, unknown or other
  misc_feature (400)..(400): n is a, c, g, or t
tcagtacgctgtctcacgaccggtgctcgatttagagtatacatattgggtttgggctcaaccgccatcctcgccctcctcctggctgttctccaaggagtctgtgccgaggtgcagctggtgcagtctggagcggaggtgaaaagcccggggagtctctgaaaatctcctgtaaggcttctggatacacctttacaacttctggatcggctgggtgcgccagatgcccgggaagcctggactggatggggatcgtctatcctggtgactctgactaccagatacagccccgtccttccaaggccaggtccaccatctcagtcgacaagtccatcagcaccgcctaccnccatgagtacgctgaagcctcggaccaccgccatactattacgtgtgcganacgagtaggagtactagtaggtacgggtaacttaggttttagggggtcgggggggtacctgggtccggttcggggggtacccgtaacgggggtaaccccgttcgggttacccgtacccggttcccgttacccttaccgaccgtaccccgttaccccgaacccggtaacccggggaccccttacggttaccccgggttcccccgtttccccccgtcgggtaccccttacccccgtacccttaccccgaacggtacccgtacctaaccccggg

SEQ ID NO: 158399 - DNA, 669 bp, Homo sapiens
  misc_feature: GYAE6OF02HMB1V.36.67.G01.1.454.CMB.1.raw
  modified_base (402)..(402): a, c, t, g, unknown or other
  misc_feature (402)..(402): n is a, c, g, or t
tcagtacgctgtctcacgaccggtgctcgatttagagtatacatattgggtttggggggaagaggaagactgacggtccccccaggagttcaggagtctgtgccgaggtgcagctggtgcattctggagcggaggtgaaaaagcccggggagtctctgaaaatctctgtaaggcttctggatacacctttaccaacttctggatcggctgggtgcgccagatcggacccgggaaaggcctggacgtggagtggggatcgtctatccgtggtgactctgacttaccagaatacacgtcccgtccttccgaaggccaggtccaccatcctcagtcaacaacgtccatcacgcacccgcctacctccacgtaggactacgcctaggaaccggccgtacggaaccncccggacctaataacttactttcgtgtcgacgagaactagtaggaacgtctagttaaggtagggtaactttaggttttcgggggtcggggggtccttgggcggtcggggccgaacgggtacccggtcggtccgtacccggttcctcccgtcgtacgacccgtacccgaaccgaaccggtcctaccgtccggttacccttccccgtcggtaccctccccgtaccctaccgaacgcgaccctacccgtcggtacgggccacgtcccggg

SEQ ID NO: 158400 - DNA, 780 bp, Homo sapiens
  misc_feature: GYAE6OF02GLESA.36.67.G01.1.454.CMB.1.raw
  modified_base (274)..(274): a, c, t, g, unknown or other
  misc_feature (274)..(274): n is a, c, g, or t
tcagtacgctgtctcacgaccggtgctcgatttagagtatacatattgggtttgggggaagaggaagactgacggtcccccaggagttcaggagtctgtgccgaggtgcagctggtgcattctggagcggaggtggaaaaagcccggggagtctctgaaaatctcctgtaaggcttctggatactacctttaccaacttctggatcggctgggtgcgccagatcggacccgggaaagccgtggactggagtggggatcgtctagtccgtgggtnactctgataaccgtagatacacgtccgtaccttacgaacggcctacggtcaaccctagttccgtacaacggtaccgaactaacgtaccacgtacaacgccacccgtaccttaccgtccaacgtcggtaacgtacgtccgtagggtaaaccggccgttaccggaccgtacccgaccgttaattaaacttaacgtttaacgtcggtacgacgtaacgtaacgtagtacgggaactacgtaagttaacggtagggttaaacgtttagggtttttacgggggacgggggtccgttgggtaccggtcgggggaacccgtaacgggggtaaccctttggggtaccccgtaaccggtttccctacccgtcgaaccggttccccgtacccgaaaccgggtaacccgggtccctaaggttccccggttcccgttcccccgtcgggtacccctaccccgtcgttaacccgacggtacccgccgtacccgtcgggttccgggacctacggacccggg

SEQ ID NO: 158401 - DNA, 817 bp, Homo sapiens
  misc_feature: GYAE6OF02H1RMN.36.67.G01.1.454.CMB.1.raw
tcagtacgctgtctcacgaccggtgctcgatttagagtatacatattgggtttgggctcaaccgccatcctcgccctcctcctggctgttctaccaaggagtctgtgccgaggtgcagctggtgcagtctggagcggaggtagaaaaggcccggggagtctctgaaaatctcctagtaaggcttcgtggatactacctttaccaacttcgtggatcggtcgtgggtgcgccgagagtcggacccggggaaggccgtaggacgtgggagtggggatcgtctacgttccgtggtcgacttcgtgtactaaccgtagtactaccgtaccggtccccgtttaccgttaccgaacggtcccgaacggtccaaccgtacgtcctacgacgtcggtaacgtaacgttaccgagtccaccgcctacccgtcccttaccgtaccgtacggtacggtacgtacgtcccggtaagtaccgggtacccgttacgggaacctacccgtaccgtaattactttaacgttaccgtacgtaccggtaacgaacggtacgtaacggtaacggaacgtaccgttaaacgttacgggttaacgggttaaacgttttacggggtttttcggggggcggggggttcctacggggtcgggtaccggggtaccggacgggttaacccggttcgggtacccgtaccgttccgtaccgtaccgtaccggtcccctaaccgaacccggtcgggtaaccccttccggttccccggttcccttaccccggtccgtaccccgttaccccttaccgtaaccggaaccgtccgtaccccttaccgggg

SEQ ID NO: 158402 - DNA, 769 bp, Homo sapiens
  misc_feature: GYAE6OF02I6XU8.36.67.G01.1.454.CMB.1.raw
  modified_base (273)..(273): a, c, t, g, unknown or other
  misc_feature (273)..(273): n is a, c, g, or t
  modified_base (327)..(327): a, c, t, g, unknown or other
  misc_feature (327)..(327): n is a, c, g, or t
tcagtacgctgtctcacgaccggtgctcgatttagagtatacatattgggtttgggctcaaccgccatcctcgccctcctcctggctgttctccaaggagtctgtgccgaggtgcagctggtgcagtctggagcggaggtgaaaaagcccggggagtctctgaaatctctgtaaggcttctggatacacctttacaacttctggatcggctgggtgcgccagatcgacccgggaaagccgtgggactggagtggggatcgtctatccgtggtnactctagactaccagatacacggtccccgttctaccgaaggccaggtccaaccncttcctacgagtaccgactaacgtcccataccgacgacccgtacccgtacctaacccctacccgacgttagggtactaaccggtccgttaacggggaaaccggtcccgttaccgggaacccaacccggtaccctaattactttaactttaaccgttcggtcggtaccggtaacgtaccgtaacggttacgggaacgtaccgtaagttacgggttacgggtaaacgttttaggtttttcggggggtacgggggggtccttacgggtccgggtacggggtacccgaaccgggggtaacccgttcgggtacccgtaccggttccgtcccgtcgaccgttaccctacccgaaccgtaacccgggtcccacggttccccggttaccctttacccccggtacggtcccctacccgtttaccccgaccgaccggtaccgccttacccgg

SEQ ID NO: 158403 - DNA, 824 bp, Homo sapiens
  misc_feature: GYAE6OF02GV289.36.67.G01.1.454.CMB.1.raw
tcagtacgctgtctcacgaccggtgctcgatttagagtatacatattgggttgggggaagaggaagactgacgtcccccaggagttcaggagtctgtgccgaggtgcagctggtgccattctggagcggaggtgaaaaagcccggggagtctctggaaactcgtcctgtaacggcttctggatactacctttaccaacttcgtggagtcggcttgggtgccgccagagtcggacccgggaaaggccgtaggacgtggacgtaggggtattcgttactcgttccgtggttcgacttctaggaacttaccgaggtactaccaccggtcccccgttaccgttacccgaaacggtcccgaacggtaccaacctacgtcgtacgacgtacgaacgtacgtccagtcacgccgaccccgtccttacctcccgacgtcgggtaactaccggtcctaaggaccggtaccgtaccggaaccacccggtacctaagtttacgttagttaccgtacggtggaccggacgacgtaggtacggtaacgtcgtagttagggtaacgggttaacgtttagggttttgggggtcgggggtccttacgggtcggtacggggtaccgacggggtaacccgtgggtacccgtaacccggttccgttccgtaccgtaccgtccccgacccgaaccggtaaacccgggtccctaccggttacccgggttccccgttccccccgtcgggttaccccctacccccgttacccgttaacccgtaaccggaccccgtacccgttaaccccggttcggggttacccggggacgtaacccggtacccgggg

SEQ ID NO: 158404 - DNA, 831 bp, Homo sapiens
  misc_feature: GYAE6OF02IEN6P.36.67.G01.1.454.CMB.1.raw
  modified_base (200)..(200): a, c, t, g, unknown or other
  misc_feature (200)..(200): n is a, c, g, or t
tcagtacgctgtctcacgaccggtgctcgatttagagtatacatattgggtttggggggaagaggaagactgacggtccccccaggagttcaggagtctgtgccgaggtgcagctggtgcattctggagcggaggtgaaaaagcccggggagtctctgaaaatctcctgtaaggcttctgatacacctttaccaacttcnggatcggcgtgggtgccgcagagtggacccgggaaaggcctggactgggagtggggattcggtctagtcctggtcgacttcgtgaactaccagactacgacgtccccgtccttaccgaacggcccaggttacccaaccgtacttcccttacgacggttaccgaacgtaacgtcccctattaccgacgccaaccccgtaccccttaaccctacccgtaacgtacggtaacggtaccgtacccgtaaggaaccggtccctaccgggaaccaccccggactaattacgttaactttacgtacggttacgacggtaacgacgtaagtacgggaaacgtaccgttaaaggttacgggtaacggggtaacgttttaagggtttttcggggggtacgggggggttcccttagggccgggtacgggggtacccgaaccggggtaccgttcggtacccgtacccggttcctacccgttacgtacccgtccctaccgaaacccggaccggtaccccgtacggttccccgttaccccgtttacccccggtccggtacccccttacccccgtcccgtaacccgaacggtacccgtacccgtacccggttaccgggtccggggtaccctacccggtacccgggg

SEQ ID NO: 158405 - DNA, 831 bp, Homo sapiens
  misc_feature: GYAE6OF02GO1PZ.36.67.G01.1.454.CMB.1.raw
  modified_base (181)..(181): a, c, t, g, unknown or other
  misc_feature (181)..(181): n is a, c, g, or t
  modified_base (215)..(215): a, c, t, g, unknown or other
  misc_feature (215)..(215): n is a, c, g, or t
  modified_base (403)..(403): a, c, t, g, unknown or other
  misc_feature (403)..(403): n is a, c, g, or t
tcagtacgctgtctcacgaccggtgctcgatttagagtatacatattgggtttgggctcaaccaccatcctcgccctcctcctggctgttctccaaggagtctgtgccgaggtgcagctggtgcagtctggagcggaggtagaaaaggcccggggagtctctgaaatctcctgtagcttcngatacacctttaccaacttctggatcggctgggngccgccagatcggacccgggaaaggccgtaggacgtggagtggggactcgtctatcccgtggtgactctgactaccagactacgacgtccctaccttaccgaacggccgtacggtccacccaactcctacgtacggtccgaactaaccgtcctactaccgtacgacccctacccgtaccctttacccncccgtaacgtgggaacgttaaccgcccgttaggaaacggtccccgttaccgggacccctaacccggacctaagttaacgttaacttaccttgggttacgcggtaacgaacctaggtacgggtaacgttacgtaacggttaggttaacgggtaaccgtttttaaggtttttcgggggggtaccggggggggttcccttaggggttccgggttacggggggtaccccggtaaacgggggtaaccccggttccggggttacccgttaaccccggggtttccctccccggtaacgtaccccggttccccgttacccccggaacccggaaccgggtaaccccgttaccgttcccccggtttacccgtccccccgtacggaccccgttacccccttacccgtaaccccggaacgtcccgtacccttaacccggg

SEQ ID NO: 158406 - DNA, 685 bp, Homo sapiens
  misc_feature: GYAE6OF02IY0XD.36.67.G01.1.454.CMB.1.raw
  modified_base (253)..(253): a, c, t, g, unknown or other
  misc_feature (253)..(253): n is a, c, g, or t
  modified_base (269)..(269): a, c, t, g, unknown or other
  misc_feature (269)..(269): n is a, c, g, or t
tcagtacgctgtctcacgaccggtgctcgatttagagtatacatattgggtttgggggcagaagtctctctcagtcaggacacagcatggacatgagggtccctgctcagctcctgggactcctgctgctctggctcccagataccagatgtgacatccagatgaccctagtttccatcctcctgtctgcatctgtagagacagagtccaaccatcactcggccgggtcgcgtacgaggctaagttaacaatntaattacgccttgtancgtagactaacgaaacgaggaaacgtcctacgtaatcctacgagtactataacgtcgtagttacgtattcgtacgttgttacgaactaaaccgttcggtaaccgggttccaacgtttacgtcggtttaacgcggttcgggactaacgggttgagtaggtacgggtacgtacgttactactccgtaccaccgtactacgtacgtaccgtaacgtccgtcgaccgacgacccgtaggtaacgtaagttacgtacgttaacgtaaacgtttaacgtttacgttaacgtactaaaacggttagtaccggtactaccggtacccgtaacccggtacgtaccggttaacccggttacggtaaccggggtaacggtaccggtaacgggttaacgggtaacggtaaccgtaaccggtaaaccgg

SEQ ID NO: 158407 - DNA, 862 bp, Homo sapiens
  misc_feature: GYAE6OF02IK3R8.36.67.G01.1.454.CMB.1.raw
tcagtacgctgtctcacgaccggtgctcgatttagagtatacatattgggtttgggctcaaccgccatcctcgccctcctcctggctgttctccaaggaggtctgtgccgaggtgcagctggtgcagtcgtggagcgggaggtagaaaacggcccggggtagtctcgtagtaaaatctccgtaggtaaggtctttcgtggataacctaccctttaacctaacttcgtggatcggtcgtgggtcgcgccgagacgtcggacccggggaagccgtaggacgtgggagtggggtatcgttactacgtccgtaggtcgtactcgtacgtaactaccgaagtacgtacgccggttaccccgttcccctttaaccggaacgggtcccgtacgggttccaaccgtacttccgtacgtacggttaccgaactaaaccgtccgacttacgaccgacctaccccggtacccttacccgtaccgtaccggtaggggtactaccggtcgtacgggaaaccggtcccgtaccgggaacccgtacccggtaacctaagtaccgtttaaaccgtcgtttacggtcggacgtaaacgacggttaggaggaaccgttacgttaaaggtgggttaacggttaacggttttaggggtttaccggggggtccggggggtccctggggtacccggtacggggggacccggttaccgggttaacccggtccggttacccgtaccggtttcccgtccgtaccggtacttcccccggtacgacccgggtaaccgggtcccgtaaccggttccccgttaccccggttttccccgccggtaccccttacccccttaccggaaccgtacggtcccgtacccgtcccggg

SEQ ID NO: 158408 - DNA, 686 bp, Homo sapiens
  misc_feature: GYAE6OF02FPXRA.36.67.G01.1.454.CMB.1.raw
tcagtacgctgtctcacgaccggtgctcgatttagagtatacatattgggtttggggggaagaggaagactgacggtccccccaggagttcaggagtctgtgccgaggtgcagctggtgcagtctggagcggaggtgaaaaagcccggggagtctctgaaaatctcctgtaaggcttctggatacacctttaccaacttctggatcggcgtgggtgcgccagagtcggcccgggaaaggccctggactgggatgggggatcgtctactccgtggtgactctgataccagatacagtccccgtccttaccaacggccaggtccaccgatcctcagtacgacaacgtccatcagccacccgcctaccctccacgtggacgtacgccgtgaacggcctacggaccacccgcaattaatacttacgtgtcgacgagaacagtaggaacgtactagtaggtaggtaacgttaggtttgggtcggggggggggtctcggtcggtcggggaccgtacgggtaaccgtcggtaccgtaccgtccgtcccgtcgaccgtcccgtcccgaccgaaccgggtacccgtaccgttcccgttcccgttcccccgtccggtacccctacccccgtcccgtacccgaaccggtaccggacccgtacccggtccgggtacggggtaccgaccggtacccggg

SEQ ID NO: 158409 - DNA, 692 bp, Homo sapiens
  misc_feature: GYAE6OF02HFCYD.36.67.G01.1.454.CMB.1.raw
  modified_base (270)..(270): a, c, t, g, unknown or other
  misc_feature (270)..(270): n is a, c, g, or t
  modified_base (325)..(325): a, c, t, g, unknown or other
  misc_feature (325)..(325): n is a, c, g, or t
  modified_base (341)..(341): a, c, t, g, unknown or other
  misc_feature (341)..(341): n is a, c, g, or t
  modified_base (357)..(357): a, c, t, g, unknown or other
  misc_feature (357)..(357): n is a, c, g, or t
tcagtacgctgtctcacgaccggtgctcgatttagagtatacatattgggtttggggggaagaggaagactgacggtccccccaggagttcaggagtctgtgccgaggtgcagctggtgcagtctggagcggaggtgaaaaagcccggggagtctctgaaaatctcctgtaaggcttctggatactacctttaccaacttctggatcggctgggtgcgccagatcggacccgggaagcctggactggatggggatcgtctatccgtggtnacgtctagactaccagatacacgtccccgtccttccgaaggccaggtccacatcncgagtcgacagtccancagccaccgcctaccncacgtggacgtacgctaggaacgcctacggaccaccgcctaattacttacttacgtgtacgacgagacagtaggaactacgttagtaggtagggtaacgtttagggttttgggggacggggggtcctgggtccgggtggggacccggtacgggtaccgttcgggtcctacccggttcgtaccctccggtaccgtccctacccgaacccggaaccgggtacccgtacgttccccgggttcccttccccccggtcggtaccccctaccccgttacccgtacccgaaacggtccgacccgtacccggttcgggtacccggggtaccaccggtaccggg

SEQ ID NO: 158410 - DNA, 615 bp, Homo sapiens
  misc_feature: GYAE6OF02FG2CD.36.67.G01.1.454.CMB.1.raw
  modified_base (507)..(507): a, c, t, g, unknown or other
  misc_feature (507)..(507): n is a, c, g, or t
  modified_base (520)..(520): a, c, t, g, unknown or other
  misc_feature (520)..(520): n is a, c, g, or t
  modified_base (529)..(529): a, c, t, g, unknown or other
  misc_feature (529)..(529): n is a, c, g, or t
tcagtacgctgtctcacgaccggtgctcgatttagagtatacatattgggtttgggctcaaccgccatcctcgccctcctcctggctgttctccaaggagtctgtgccgaggtgcagctggtgcagtctggagcggaggtgaaaaagcccggggagtctctgaaaatctcctgtaaggcttctggatacacctttaccaacttctggatcggctgggtgcgccagatgcccgggaaaggccctggactggatggggatcgtctatcctggtgactctgataccagatacagcccgtcttccaaggccaggccaccatcctcagtcgacaagtccatcacgcacccgcctaccctccacttcgggagtacgcctgaaacgggtcctcgggaacccacccggaccatactaatttactgtgcgacgacagtcggagctataggtagggtacttagtttgggtggggggtcctggcggtgggccgacgggaacccgtcggtcctaccgtntcccccccccgtnaccgtcccnccgaacccgacgggacccctacgtcccggtcccgttcccccgtccggcctaccccgtcccttacccgacggaccgacctaccccgg

SEQ ID NO: 158411 - DNA, 717 bp, Homo sapiens
  misc_feature: GYAE6OF02IPJPP.36.67.G01.1.454.CMB.1.raw
tcagtacgctgtctcacgaccggtgctcgatttagagtatacatattgggtttgggggcagaagtctctctcagtcaggacacagcatggacatgagggtccctgctcagctcctgggactcctgctgctcgtggctcccagataccagatgtgacatccagatcgaccctagtttccatcctccctgtctgcatctggtacgagacagactcacctatcacgttggccggcgagtcgaggctaattaacaatctaattacgaccttggtatcgagtaccgaaagaaaccggaagggaaacgtcgttaacccgaagtcctactaggaacttataactgtactagttacttactcgtatcgactaagtccggtacgggtaccctagttcggttacgttccgtaagggtcggtacgttagggtaggtaagttaggttacgggtacggtttactttacctacgtcctacgacctaacgcgaacggtccaacgttcccgtacgaccgtacgtaccgtagtaacgtaggttacgttaccgtaactttacgtttaacgtttaacgtttaagtaaaacgtaaacggtttgtaaaccgttcggtaaccgtcccggtaaccccgttcccgttaaccgtttacccgggtttaccggggtaaccgggtaacggggttaaccgggtaagggttacggaaacggttaaccggtaaaccgttaaaaccggg

SEQ ID NO: 158412 - DNA, 778 bp, Homo sapiens
  misc_feature: GYAE6OF02HUR1D.36.67.G01.1.454.CMB.1.raw
  modified_base (203)..(203): a, c, t, g, unknown or other
  misc_feature (203)..(203): n is a, c, g, or t
  modified_base (521)..(521): a, c, t, g, unknown or other
  misc_feature (521)..(521): n is a, c, g, or t
tcagtacgctgtctcacgaccggtgctcgatttagagtatacatattgggtttggggggaagaggaagactgacggtccccccaggagttcaggagtctgtgccgaggtgcagctggtgcagtctggagcggaggtgaaaaagcccgggggatcgtctgaaaatctcctgtaaggcttctggatacacctttaccaacttcgnggatcggcgtgggtgccgccagtacgtcggacccggggaaacggccgtaggacgtaggtagtcggggatccgtctatccgtggtacgacttcgtagtaactaacccaagtaactaaccgaaccggtcccccgttaccctttaacccgaaacgggtacccgtaacggtacccaaccctacgtcctaccgaggtaaccaacgtaacgtaccatacgacgtaccaccccgtaccctaaccgtacccgacgtcggtaacgtacgcccgtaaggaaccggtcccgtaacggacccgacccgactaatttaactaactttacgnggtacgagaacgtactaggtaagaacgtacttagtaggtagggtaactttagggttttcggggcgggggtactcggtcggtacgggaccgaaccgggtacccgtggtacctccgtaccgtccacgaccgtcctaccgaccggaaaccgtcccgacgttcccgtacccgtttcccccgtacggtacccctacccggttaccctaaccgaacgtacgacccgtaccggtccgggtaccggggacctacccggtaccggg

SEQ ID NO: 158413 - DNA, 724 bp, Homo sapiens
  misc_feature: GYAE6OF02IT25H.36.67.G01.1.454.CMB.1.raw
  modified_base (125)..(125): a, c, t, g, unknown or other
  misc_feature (125)..(125): n is a, c, g, or t
  modified_base (545)..(545): a, c, t, g, unknown or other
  misc_feature (545)..(545): n is a, c, g, or t
tcagtacgctgtctcacgaccggtgctcgatttagagtatacatattgggtttgggctcaaccgccatcctcgccctcctcctggctgttctccaaggagtctgtgccgaggtgcagctggtgcngtctggagcggaggtagaaaaggcccggggagtctcgtagtaaaatcctccgtagtaaggtcttcgtggactacctacctttaaccaacttcgtggtagtcggtcgtgggtcgcgccagacgtcggaccgggtaaacggccgtacgggacgtagggagtggggtactccgttcttacgtccggttggtacgtaccgtcgtagtaactaccgaacgtaactaccgaccggtccccggttacccgttaccgaaccggccgtacggtaccaactactccgttaccgagtacccgtaacgaacgtcctaacgccgtaacgcccgtaacccgtccctacccgtacctacgtacggtaccgtacgccgttaacggacgtcccggtaccgacccgacgtactagtactacgttactggacgtacganacgagacgagtatacgtaggtacgtaagttgggtcgggtacgggctaggcgccgggtacgaccggtacgtcgtaccgtcgtccgtcgtccgacgccgtaccgaccgtacgcccgtagttcccggtaccctcccgtaccgtacctaccccgttccgaacccggtagtacccgcctccggg

SEQ ID NO: 158414 - DNA, 734 bp, Homo sapiens
  misc_feature: GYAE6OF02FNYKX.36.67.G01.1.454.CMB.1.raw
  modified_base (268)..(268): a, c, t, g, unknown or other
  misc_feature (268)..(268): n is a, c, g, or t
tcagtacgctgtctcacgaccggtgctcgatttagagtatacatattgggtttggggggaagaggaagactgacggtccccccaggagttcaggagtctgtgccgaggtgcagctggtgcagtctggagcggaggtgaaaaagcccggggagtctctgaaatctcctgtaaggcttctggatacacctttaccaacttctggatcggctgggtgcgccagatcgcccgggaaagcctggactggagtggggatcgtctatccgtggtnacgtctgactaccagactacacgccccgttcctacgaacggtccacggtccaccatcctacagtccgaacaagtccatcacgcacccgtcctacctccgacgtcggacgtagccctaggaacggtcctacggaccaacccggacctaacgtaattaacttacttcggtacgcgtaacgaacgtaagtacggaacgtaacgtagtaaacggttaacgggtaaggttaacggttttacggggtttcggggggccggttacggtccggtcgggaccgggtaccggtaaccgggtccgttacggtaccccgtccgttacctcccgtacgtacccgtacccgtaaccgaaccgggtacccgccgttaccgtcccgttaccccgtcccggacccggttaaccctcccccgtaaccgtaacccgaacgtcccggtacccgtaccgggttacgggacccgtaccggtaacccgg

SEQ ID NO: 158415 - DNA, 798 bp, Homo sapiens
  misc_feature: GYAE6OF02JF4S3.36.67.G01.1.454.CMB.1.raw
  modified_base (483)..(483): a, c, t, g, unknown or other
  misc_feature (483)..(483): n is a, c, g, or t
tcagtacgctgtctcacgaccggtgctcgatttagagtatacatattgggtttgggggaagaggaagactgacggtccccccaggagttcaggagtctgtgccgaggtgcagctggtgcagtctgggagcggaggtagaaaaagcccggggagtctctagaaaatcctcctagtaaggcttcgtggatacctacctttaccaactttcgtggatcgggcgtggggtgccgccgagagtcggacccggggaaaggccgtgggacgtgggaagtggggactcgtcttacgtccgtggtcactgtcgactaccgagactaccgcgtcccgttcctacgaacggcctaggtaccaaccgtacttccgtacgtacggtaaccgaacgtaacgtaccctataccgacgaccctaacccggtcctaaccccgtaccgaacggtacggtaacgtaccgacccgtagggaaccgtcccgtaaccgggaaccncccggtaacctaagttaacgttacgttaaccgtgggtacgacggtaactacgtagtacggtaacgtacttacggtaaggtacggtaacgttttaggggtttcggggacggggtaccttcgggtaccgggttcggggaccgtaacggggtcccttaggtaaccgtccgtccgtaccgtcgaccgttaccctacccgtaacggaacccgggtcctcggttacccgttacccgttaccccggcgtacccctacccgttaccgacccgttaagacccggttacctccccgggtacggtccggaccggaacgtcccgggg

SEQ ID NO: 158416 - DNA, 669 bp, Homo sapiens
  misc_feature: GYAE6OF02JEKBF.36.67.G01.1.454.CMB.1.raw
  modified_base (656)..(656): a, c, t, g, unknown or other
  misc_feature (656)..(656): n is a, c, g, or t
tcagtacgctgtctcacgaccggtgctcgatttagagtatacatattgggtttgggctcaaccgccatcctcgccctcctcctggctgttctccaaggagtctgtgccgaggtgcagctggtgcacgtctggagcggaggtgaaaaagcccggggagtctctagaaaatctcctgtaaggcttctgatactacctttaccaaccttctggatcggctgggtgcgccagatcggacccgggaagtccgtggacgtggagtggggatacgtctagtcctggtagctctgataccagtatacgacgcccgtcccttacgaacggccgtaggtccaccacgtctacagtcgaactacgtaccatcagcacccgcctaccctccacgtggactcgcgtagaacgcccgtacggaccaccgcgaattacgtattacgtgtcgagacgactagtaggaactgtaattacgggtaggtaacgtttcgggttttaggggcgggggtactcgggtacggttcggggaccgtacggggacccgttcggtaccgtaccgttccgtacccacggtacctccgaccgtacccggacggaccccgtaggtaccccggttcccgttaccccggtacggtcccccgtaccctcccgtaacccgacggtacccnccggttaccccgg

SEQ ID NO: 158417 - DNA, 782 bp, Homo sapiens
  misc_feature: GYAE6OF02GFLHX.36.67.G01.1.454.CMB.1.raw
tcagtacgctgtctcacgaccggtgctcgatttagagtatacatattgggtttgggctcaaccgccatcctcgccctcctcctggctgttctccaaggagtctgtgccgaggtgcagctggtgcagtctggagcggaggtagaaaagcccggggagtctctgaaaatctcctggtaaggcttctggatacacctttaccaacttctggatcggctgggtgcgccagatcggacccgggaaaggcctggactgggagtggggtatcgtctatccgtggtcgacttcgtgtactaccagactacgacgcccgtccttaccgaacggccaggtccaccactctacgagtccgactaacgtccatacgacgaccacccgtacctaccctccgacgttggactacgccgtacggaacgcccgtcggaccaccgacctaatactttagttaccgtaggtcgaccgtaacgacgtacggtagggaacgtcgttaaacgttagggttaacgggtaaacgtttttacggggttttaggggggtccgggggggtacctcggggtcgggtaccggggggtaccggaaccgggggttacccgttcggggtacccttacccgggttcccgtttacccgtccggtacccgtacccttaccccggaaccgggtaacccggggtaccccttaaccgggttcccccggttttacccgtttaccccccccggtccgggttaccccctacccccggttaccccgttaaccgtaaccgtacccggtacccgttaccccgggg

SEQ ID NO: 158418 - DNA, 871 bp, Homo sapiens
  misc_feature: GYAE6OF02F8YOA.36.67.G01.1.454.CMB.1.raw
  modified_base (863)..(863): a, c, t, g, unknown or other
  misc_feature (863)..(863): n is a, c, g, or t
tcagtacgctgtctcacgaccggtgctcgatttagagtatacatattgggtttggggggaagaggaagactgacggtccccccaggagttcaggagtctgtgccgaggtgcagctgggtgctattctggagcggaggtagaaaaagcccggggagtctctagaaatctcctgtaaggcttctggatacctacctttaccaacttctggactcggcgtgggtcgccgaccgagagtcggacccggggaaaggccgtgggaccgtagggaggtaggggtactcggtactacttccgtggtgtaccttacgtggtaactaccgaagtactaaccgtaccggtaccccgttaccccgttaccggaacggtcccgtaacggtaccctaacccttagtccctttaccggaacggttacccggaaaccgtaacgttaccccgtaagtacccggaccgtacccctaacccccgtacccttaacccccgttacctaaccgggtggtaaccgttacgggtacccgtaagggtaacccggtccggtaccccggaaccctaacccggtacccttaaagttacgttaacgtttaccgaggttaccgacggaacgttaaaccgtagttaacgggaacggttacgttaaggttacggggttaaacggttaacgtttacgggggtttcggggggtacggggggtcttcgggtcgggtaccgggggaccgtaaccgggtacccggtcggtacccgtacccgttctacccgacgttcccgacccgtacccgaaccgaaccgggcccttaggtacccgttcccgtacccgtccggaccccttcccgacctaccgactacggcctaccggcgacggggtaccncggaccgg

SEQ ID NO: 158419 - DNA, 813 bp, Homo sapiens
  misc_feature: GYAE6OF02JCS18.36.67.G01.1.454.CMB.1.raw
  modified_base (213)..(213): a, c, t, g, unknown or other
  misc_feature (213)..(213): n is a, c, g, or t
  modified_base (426)..(426): a, c, t, g, unknown or other
  misc_feature (426)..(426): n is a, c, g, or t
tcagtacgctgtctcacgaccggtgctcgatttagagtatacatattgggtttgggctcaccgccatcctcgccctcctcctggctgttctccaaggagtctgtgccgaggtgcagctggtgcagtcgtggagcggaggtagaaaaggcccggggagtctctagaaaactctcctagtaaggctttctggatacctaccctttacaactttcnggtatcggtcgtgggtcgcgccagtatgggacccgggaaagcccgtggacgtgggaggtaggggattcggtactacgtccgttaggtgtaccgtcgtgacctaccgaagtagacctaccgtccccgttcccgtaaccgaacgggtcccgtaaggtacccctaacctacgttccgtacgaacgttacccgaaactaccgtacactccggaaccncctaaccccgtcctaccctaccacgtggtaaccgcgtacgtcggaaccgtccgacggtacccacccgactattaacgtagttacgtcggtacgaccgtaggtaccgtaaggtcggtaacgtgtaaggttaggtacggtttaagtttcggggttacgggggtcgggtaccggtcgggtcccggggtacgggtacccggtaacccgggtaccggttccgggtacccgttacccgtttaccctcccggttacccgaccgggtacccccttacggtaacccggaacccggggttcccggttaaccgtccccggtttcccccgttaaccccgtccggtaccccgttacccccttaccccggacggtaacccgtaccgtaccccgtacccggg

SEQ ID NO: 158420 - DNA, 718 bp, Homo sapiens
  misc_feature: GYAE6OF02GY8VV.36.67.G01.1.454.CMB.1.raw
tcagtacgctgtctcacgaccggtgctcgatttagagtatacatattgggtttggggggaagaggaagactgacggtccccccaggagttcaggagtctgtgccgaggtgcagctggtgcattctggagcggaggtgaaaaagcccggggagtctctgaaaatctcctgtaaggcttctggatacacctttaccaacttctggatcggctgggtcgcgccagatcggacccgggaaaggccgtggactggagtggggatcgtctatccgtggtgactctagactaccgagatacgacgccccgttcctaccgaacggccgaggtaccaccgactcctcgaacgtacgaacaacgtaccataccgagcccaaccgtccctaccctccgacgtacggtaacgtcgaccgtaggacggtccaccggaaccgacccgactaagttacttaacttacgtgtcgacgagtacgagtaggactacgtagtaggttaggtaacgtttggtttcgggggtggggtcctaggtcgggtacgggtacggaaccgggtacccgttcggtacccgtaccgttcctaccgtacgtcccgaccctacccggaccgaaccgggtccctacggttccccgttccgttcccccggtcggtacccctacccccgtaccgtaaccccgaaggtacccaccgttcccggtacgggtcccgggacctaccggtacccggg

SEQ ID NO: 158421 - DNA, 821 bp, Homo sapiens
  misc_feature: GYAE6OF02I4IEA.36.67.G01.1.454.CMB.1.raw
  modified_base (217)..(217): a, c, t, g, unknown or other
  misc_feature (217)..(217): n is a, c, g, or t
  modified_base (332)..(332): a, c, t, g, unknown or other
  misc_feature (332)..(332): n is a, c, g, or t
tcagtacgctgtctcacgaccggtgctcgatttagagtatacatattgggtttggctcaaccgccatcctcgccctcctcctggctgttctccaaggagtctgtgccgaggtgcagctggtgcagtctggagcggaggtagaaaaagcccggggagtctctgaaaatctcctagtaagcttctgatacacctttacaacttctggatcggctgggtncgccagatcggacccgggaaacggcctggactggacgtggggactcgtctatccgtggtctactctgactaccgagataccgcgtccccgttccttacgacggccaggtccaccntctcacgtcgacgtacgtcctatcacgccacccgtccttaccctccgaacgtcgggtaattaccgacgtacgggaaacgtcccgtaccgggaacccgacccgtaccgtaattaacttaacgtttaccgtggtacgtacggaacgtaaccgtaggttaacggaaacggttactaaaggttacgggttaacgggtaaccgttttagggggtttttccggggggacggggggttcccgtcggggtaccgggttcgggggaccccggtaaaccgggggtaccccggtttagggtacccgtaaccccggtttacccggtttaccccgtacgggtacccgttaaccccgtaccccggtaaccgggtaaccccggggtacccctaaccggggttttcccccgttaacccccggtttccccccggtaccgggttaccccccctacccgtttaccccccggtaacccggaacgggttacccgacccgttaaccccggg

SEQ ID NO: 158422 - DNA, 863 bp, Homo sapiens
  misc_feature: GYAE6OF02HR5DA.36.67.G01.1.454.CMB.1.raw
  modified_base (221)..(221): a, c, t, g, unknown or other
  misc_feature (221)..(221): n is a, c, g, or t
  modified_base (752)..(752): a, c, t, g, unknown or other
  misc_feature (752)..(752): n is a, c, g, or t
tcagtacgctgtctcacgaccggtgctcgatttagagtatacatattgggtttgggggaagaggaagactgacggtcccccaggagttcaggagtctgtgccgaggtgcagctggtgcattctggagcggaggtagaaaagcccggggatctctagaaaatctcctgtaaggcttctggatacctacctttaccaacttccgtaggactcggcgtgggtcnccgaccagacgtcggacccgggaaagtccgaggtactggagtggggacttcgtactactccggttggtactactcgtacgaacttaccgaagtactacaccggtcccgttaccgttaaccgaacggtcctaacgggtacccacgtaacgttccgttaccgaacggttaccggaaaccttaccggtacctaacgtacgtaaccgtacccgtaccgttacccctaacccgttccgaaccggttacggtaacgtacggtcccgtaaggaaccggtcccgtacggaccaacccggactaagttaacttaacgttcggtacggacgtacggaacgtaaccctagggttaacgaacgtacgtaacgggtttaacgggtaacggttaaacgtttcggggttttagggggacccggggggtcttagggccgggttaaccggggtaccctaaaccggggttaccccgttggttacccggtacccgtttacctacccgggtcctaccggtaccccgaaccaaaccgggtaaccggtacccnccgtttaccgggtcccttaacccccggcgttaaccccgtccccgttaccgaacccgtacggtaccctacccgtaaccggttccggggtaacggacccgtagtaaccccggg

SEQ ID NO: 158423 - DNA, 972 bp, Homo sapiens
  misc_feature: GYAE6OF02IWZ3D.36.67.G01.1.454.CMB.1.raw
tcagtacgctgtctcacgaccggtgctcgatttagagtatacatattgggtttgggctcaaccgccatcctcgccctcctcctggctgttctccaaggagtctgtgccgaggtgcagctggtgcagtctggagcggaggtagaaaagcccggggagtctctagaaatctcctgtagcttctggatacacctttaccaacttctggatcggctgggtgcgccagacgtcggacccgggaaagccgtggacgtggagtgggatcggtactacgtccgtggtgacctctggtactaccgaagtactaaccgacggtaccccgttaccgttacccgaacgggacccgaacgggttacccaaccgtaacttcccgtacgaacggttaccggtaaaccaaacggtcccctaacgttaccgaacgaccccgtaaccccggtacccctttaaccccgtacccgtacccggttacgggtaaccggtttaaccggcccggttaaggaaaccggggttccccgtaaccccggggtaaacccgtaccccggtaaccctaaacgttttaacctttaacggttttaaacccttgggttaccgaaaccgggtaacgaacccggttaaggtaaacgggaaacgttacggtttaaaacggttacggggttaaacggggtttaaacgggttttagggttttttaacggggggggtcccgggggggggttaccctttaccgggggtccggggttaccggggggtaacccggttaaacccggggggtaaccccttcggggttaccccggttaacccggtttccgtaccccgttaccggtaccccggttacccgtacccccgaaaccgggtaccccgggtaacccccggttacggtttccccggttcccccgtttaccccccggtagggttaaccccctacccccggtttaccaacccccgggtaacggaccccgtacccggttaaccccggg

SEQ ID NO: 158424 - DNA, 786 bp, Homo sapiens
  misc_feature: GYAE6OF02FYPEK.36.67.G01.1.454.CMB.1.raw
  modified_base (203)..(203): a, c, t, g, unknown or other
  misc_feature (203)..(203): n is a, c, g, or t
tcagtacgctgtctcacgaccggtgctcgatttagagtatacatattgggtttgggggcagaagtctctctcagtcaggacacagcatggacatgagggtccctgctcagctcctgggactcctgctgctctggctcccagataccagatgtgacatccagatcgaccctagtttccatcctccctgtctgcatctgtagganacagacgtcaccatctacgttcggcccggggctagtcgagggctaattaaacaactctaagttttacgccgttagggtactcgacgacgtaacggaaaaccggaaggggaaactccgttaccgtaaacgtccgtaccgtaggtaacttacgttaacgtcggtccttaggttaacttaccgtaacgttggtacgaacgtaaacgttccggggtaaccggggtttcccctaacggtttccggtttacggttacggtaggggttaccgggacggttagggttacgggtaacgtttacgggtaccgggggtaacgtttacgttttacccgaccggtttactacccgaccgttaacgtaccgtaccgtcgtaaccggtcccgttacggccttaaccggtacgttacggtaagttacggtttcgttacgttaaaccgttttaactttacgttttaacgttaacgttaaactaaaggttacttaccggtacgtacggtaccccggtcccttacggttacccttaacggggtttcccggaccgggtacggtaacgggtaacgggtcgtaacggtacggtaccgtaaacggg

SEQ ID NO: 158425 - DNA, 188 bp, Homo sapiens
  misc_feature: GYAE6OF02FO7H8.36.67.G01.1.454.CMB.1.raw
  modified_base (174)..(188): a, c, t, g, unknown or other
  misc_feature (174)..(188): n is a, c, g, or t
tcagtacgctgtctcacgaccggtgctcgatttagagtatacatattgggtttgggggaagaggaagactgacggtccccccaggagttcaggtgctgggcacagcggccctgggctgcctggtcaaggactacttccagacagcgtactgagcgggctggcaaggcgcatagnnnnnnnnnnnnnnn

SEQ ID NO: 158426 - DNA, 945 bp, Homo sapiens
  misc_feature: GYAE6OF02I54KA.36.67.G01.1.454.CMB.1.raw
tcagtacgctgtctcacgaccggtgctcgatttagagtatacatattgggttgggggaagaggaagactgacggtcccccaggagttcaggagtcgtgtgccgaggtgcagctggtgcagtctggagcggaggtacgaaaagcccggggtagtcgtctaggaaatccgttccgttagtaacggtcttactggtactaacgtcctttacctaacgttcgtacggtattcggtcgtcgggtagtccgaccgtaaggtacgtaccgggacccggggtaaaggcccgttaacgggtaccgttacgggtacggtacggggggtaactttacccggttaccgttaacgttcccggttagggttaccgtaaacgttccggttacggtaaccgttaaacccggtaacggttaaccgttaaccggtacccggttaccccccggttaccgttttaaacccggaaccgggttaccccgtaaccggggttaccccgaaacctttaaccggttcccggtttaccggtaaccgggttaccggtaaccgttaaacccgggttccctaacggttacccggtaaccggtaccccggtaaccccggttacccgttaaccccgttaacccggtaaccgttacggggttaaccggtccgttacccgtaaagggacccgggttaccgtaacccgggttaaccgacccggttactaacgtttaacgttacgttaccggtacgtcggacggtacgaacgtacggttacgacgtacgtacgtaggtacgtacgttggttacgggtcgggtctcggcggtaccggtacgtacgggtaccgtgtacgtaccgtcgtacctcgtaccgtccgtaccgtcgaaaccgtcgtacgccgttccggtaccgtcgtacccgtcctacccgtaccgacggtacccgtcgtaaccgttcggacggtaccgagtaccggg

SEQ ID NO: 158427 - DNA, 656 bp, Homo sapiens
  misc_feature: GYAE6OF01DVOE8.39.82.H05.1.454.CMB.1.raw
tcagtcgcactagtcacgaccggtgctcgatttagtcgagctctctcgcgggctcagagagatgcctgagccctggattccaaggcatttccacttggtgatcagcactgaacacagaggactcaccatgcagttggggctgtcctgggttttccttgttgctattttagaaggtgtccagtgtgaggtgcaacgtgggtggagtcgtggggggaggtcgttggtacagccctaggaaacgtccctgagactctcctgtgcaggcctcgtggtacttcgacttcagtgaactatagtctggagcgtggggtcccgccgagggcctccggaaggggaaggggctagggaatgggtcctttacaattacgtagtttaaggtcggttacaaggttacgtaaactattacgtacttaatcgacgtaagtacttcgtaggtacggaaggggtccctaattcgaagtacctattccctaccgaaggaacgtaacaagtaccgaaccgtaaggacgtacctaacctaacccgtttacttaactccgttacgaaacgtaaacgttaccgggaaaccctaaaccgtaggaaacggaaaggtaaacggacggtaacgtacgggtcttaagttttactacgtggtacgacgtaggtgtacgtaaacg

SEQ ID NO: 158428 - DNA, 583 bp, Homo sapiens
  misc_feature: GYAE6OF01B9ZB2.39.82.H05.1.454.CMB.1.raw
tcagtcgcactagtcacgaccggtgctcgatttagtcgagctctctcgcgggctcagagagatgcctgagccctggattccaaggcatttccacttggtgatcagcactgaacacagaggactcaccatgcagttggggctgtcctgggtttctgtgctatttagagtgtcagtgtgaggtgcaactggtggagtcgtgggggaggcttggtacagcctaggaaacgtccctgagactctcctgtgcagcctctggattcgacttcagtgactatagtctgagctgggtcccgccaggctccgaggggaaggggctaggaatggtctttcatacagttagtggttacaagtacgtaacatatactatgacagtactcgtagtaggaacggggcctattcgaagctaattcctaccgaagagaacctaagtcgacccaagtacgcctacacgttactatcgtagaacctaaagtcggaaacctaaccgtaggaaacggaaaggaaacgggacggtaaccgaacgggttctttaaggttttaattaaccgtgggttacggtaggtaggttcggtaacgtaaaacg

SEQ ID NO: 158429 - DNA, 722 bp, Homo sapiens
  misc_feature: GYAE6OF01DNWX8.39.82.H05.1.454.CMB.1.raw
tcagtcgcactagtcacgaccggtgctcgatttagtcgagctctctcgcgggctcagagagatgcctgagccctggattccaaggcatttccacttggtgatcagcactgaacacagaggactcaccatgcagttggggctgtcctgggtttccttgttgctatttagaaggtgtccagtgtgaggtgcaactggtggagtcgtgggggaggcttggtacagcctaggaaagtccctgagactctcctgtgcagcctcgtggattcgacttcagtgactatagtctgagcgtgggtccgccgaggcctccggaggggaacggggctaggaagttcggtctttcgattactaagtttaggtggttactaaaggttacgtaaactaagttattaaccgttatcggactaaggtaccttcgttagggtagggaaaccggggtcctaatttccgaagtcctaattcccgtacccgaagtaacggaactaaagttccggaaccctaaaggtccgtacccttaaccgtaacccgtttccttaacgttaccgtacggtaaacctaaaaggtccgggaaaaccctaaacccggttagggaaacgggtaaaggaaaacgggaaccgggtaaaccccgtaacggggtttaccgttttaaggttttttaaaccttaaccgggtttgggttacggacccgggttaaaggtttcccgggaacgtttaaaaacccg

SEQ ID NO: 158430 - DNA, 543 bp, Homo sapiens
  misc_feature: GYAE6OF01B3689.39.82.H05.1.454.CMB.1.raw
  modified_base (175)..(175): a, c, t, g, unknown or other
  misc_feature (175)..(175): n is a, c, g, or t
  modified_base (377)..(377): a, c, t, g, unknown or other
  misc_feature (377)..(377): n is a, c, g, or t
tcagtcgcactagtcacgaccggtgctcgatttagtcgagctctctcgcgggctcagagagatgcctgagccctggattccaaggcatttccacttggtgatcagcactgaacacagaggactcaccatgcagttggggctgtcctgggttttccttgttgctatttagaaggtntccagtgtgaggtgcaactggtggattcgtgggggagcttggtacagcctagggaaacgtcccgtgagactctcctgtgcagcctctggattccgacttcagtgactatagtctgagcgttgggcccgcaggctccgaggggagggctggaatggtctttcgataacgtattaggtgttacaaagtcgtaaacatatactangacagtactcgtgtaggaagggcctattcagctatctacagtacgaacaatcgacaagagctcgactctatctagactaagtcggaacaacgtagaaggaaggaaggacggaacgtaacggttcttagtttaacgtacgttacggtcgacggaggtcgaggtaaac

SEQ ID NO: 158431 - DNA, 519 bp, Homo sapiens
  misc_feature: GYAE6OF02F8HFI.39.82.H05.1.454.CMB.1.raw
tcagtcgcactagtcacgaccggtgctcgatttagtcgagctctctcgcgggctcagagagatgcctgagccctggattccaaggcatttccacttggtgatcagcactgaacacagaggactcaccatgcagttggggctgtcctgggttttccttgttgctattttagaaggtgtccagtgtgaggtgcaactggtggagtcgtgggggaggcttggtacagcctggaaagtccctgagactctcctgtgcagcctctggattcgacttcagtgactatagtctggagcgtgggtcccgccgaggctccgaggggaagggctggaatggctttcatacattagtggttacaagtcgtaacatatactatgcagctctgtagaagggcctattcagctatcctaccagacgacaatgaccaagacgctcactctatctagacaaagtcggacaacgtgagagaaggacggaacgacggtcttagtttaattacgtggtacgacgtagtacgacgtaag

SEQ ID NO: 158432 - DNA, 698 bp, Homo sapiens
  misc_feature: GYAE6OF02JVV5I.39.82.H05.1.454.CMB.1.raw
  modified_base (289)..(289): a, c, t, g, unknown or other
  misc_feature (289)..(289): n is a, c, g, or t
tcagtcgcactagtcacgaccggtgctcgatttagtcgagctctctcgcgggctcagagagatgcctgagccctggattccaaggcatttccacttggtgatcagcactgaacacagaggactcaccatgcagttggggctgtcctgggtttccttgtgctatttagaaggtgtccagtgtgaggtgcaactggtcggagtcgtgggggaggcttggtacagcctaggaaacgtccctgagactctcctgtgcagcctctggacttccgacttcgagtgactatagtcngacgtcgtgggtccgccgaggcctaccggaggggaacggggtctagggtaactcgggtccttttcgaagttaaccgtaagttttaggttcggttacctaaaggttcccggtaaaatagtaactacttagtcggtactacgtacgttcgtcggtaggtaaacgggtcccgtagttacccgagtacctacgtccgtaaccgaggtaacgtaaccgtaacgtcgaacccgtaaaggacccggtactaaccgtaccttacgtttaacgtcccgttaggtaaccgttaaaacggtcggaaaccctaacgtaggaacggtacggaaacggtaaccgggaactaccggggttaactttacggttttaacggtacgtttacggaccgggtacggtaaggttccggtaacctaaacgg

SEQ ID NO: 158433 - DNA, 578 bp, Homo sapiens
  misc_feature: GYAE6OF02GCCV1.39.82.H05.1.454.CMB.1.raw
  modified_base (301)..(301): a, c, t, g, unknown or other
  misc_feature (301)..(301): n is a, c, g, or t
  modified_base (320)..(320): a, c, t, g, unknown or other
  misc_feature (320)..(320): n is a, c, g, or t
  modified_base (370)..(370): a, c, t, g, unknown or other
  misc_feature (370)..(370): n is a, c, g, or t
tcagtcgcactagtcacgaccggtgctcgatttagtcgagctctctcgcgggctcagagagatgcctgagccctggattccaaggcatttccacttggtgatcagctactgaacacagaggactcaccatgcagttggggctgtcctgggtttcctgttgctatttagaaggtgtccagtgtgaggtgcaactggtgagtcgtgggggagcttggtacagccctggaacgtcccctgacgacctctccgtggtgcagcctcgtggacttcgacttcagtgactatagtctgagctgggccncaggctccgagggagggcnggaatggcttcatactagttaggtggttacaagttcgtaacatatactangacagactcgtggaggaacgggccctattccgagtctaactccgtaccagacgactaaagtcgaccgtaaaggcgtctaccacgttcctaagttccgtagacctaaaaggtccggaaacctaaccgtgaacggtaagaacggtaacggaccgtacggtcttacggtttaacttacggtggtaccggacgtacggttcgacgttaaccg

SEQ ID NO: 158434 - DNA, 599 bp, Homo sapiens
  misc_feature: GYAE6OF02JDAHE.39.82.H05.1.454.CMB.1.raw
  modified_base (479)..(479): a, c, t, g, unknown or other
  misc_feature (479)..(479): n is a, c, g, or t
tcagtcgcactagtcacgaccggtgctcgatttagtcgagctctctcgcgggctcagagagatgcctgagccctggattccaaggcatttccacttggtgatcagcactgaacacagaggactcaccatgcagttggggctgtccttgggttttccttgttgctattttagaaggtgtccagtgtgaggtgcaactgggtggagtcgtgggggagtcttggtacaggcctaggaaacgtccctggacgacctctcctggtcgcagcctcgtggacttcgacttcagtagactaatgtctgagtcgtgggtcccgaccaggctccggaagggggaacggggctagggaatcgggtctttcgaattacgtagttttaggtcggttactaacgtaccgtaaatcttaaattctaatcggactaagtaccgtctaggtacggaacggggcctattcgagctagtccaccaaggtacaagtaanccgaacctaaggtctctaccacttactactctacgaactaaagtccgacaaccgttggacgagtaaggagaccgtaacggtcgttagtttaatcgttggaggtcgtaggtcgaagtaacg

SEQ ID NO: 158435 - DNA, 756 bp, Homo sapiens
  misc_feature: GYAE6OF02HNOI5.39.82.H05.1.454.CMB.1.raw
  modified_base (253)..(253): a, c, t, g, unknown or other
  misc_feature (253)..(253): n is a, c, g, or t
tcagtcgcactagtcacgaccggtgctcgatttagtcgagctctctcgcgggctcagagagatgcctgagccctggattccaaggcatttcccacttggtgatcagcactgaacacagaggactcaccatgcaggttgggctgtccgttgggttttccttgttgacttattttaggaaggtcgtaccaggttgtggaggtcgtaccgtaacgttgggtaggtaggttcggtggggggagtcgttagggtaacncggtccttaagggaaacgtcccgtaggacgtaccgttcgttccgttggcgccgacgtcccttgtgggtaacttccggtacttcgtaggtacgtaacttagtacgttcgtaggacggttccggtcgggtcccaccggtacggtaccggtaccgggaaaggggggtaggggtcccgttaagggggaactttcggggtacctttttaccgaagttaccgttaaggttacgggttacgttacgaaacggttacgtaaaacttgttaaactacgtagtcgacgtacgtacttcggtaggtaacgggaaccgggttacctacgttaaccgagtaccgtattacccggacgtaagaacgaaacgtagtacgaaaccggtagaaccttccaaccgttactcctatacgtacgaaactacgagaaccctaagtacggagtaacgaagggtaccgacgttacggtacgtttaattttacgacgttggcgttacgggtaatccggtaagtaacg

SEQ ID NO: 158436 - DNA, 825 bp, Homo sapiens
  misc_feature: GYAE6OF02HF9AW.39.82.H05.1.454.CMB.1.raw
tcagtcgcactagtcacgaccggtgctcgatttagtcgagctctctcgcgggctcagagagatgcctgagccctggattccaaggcatttccacttggtgatcagcactgaacacagaggactcaccatgcagttggggctgtcctggttttccttgttgtctagttttagaaggtgtccagtgtgaggtgcaacgtggtggagtcggtgggggaggtcgttagggtacgacggccgttagggaaacgttccccgtaggacgacctccgttccttggtcgccgacggtcctcgttacggtactttccgacctttcgaaggtcgtaacttaagttaacggttccgtaggacgtccgttcggggtccccgccgtacgggccgttacccggaaggggaacggggcgttagggaagtcgggtccttttacgaagttaaccgtagtttacggtacggtttaacgaacgttacggttaaactagttaaacttaacgttaagtacgaccaagttaccgttcgttaggttaacggaacggggtacccgtattaccgaacggtactaccgttaccgttacccgaaggaactaaaccgaaacgtttacgaaacccggaaacggtaaccgtacccttaccttaacccgtacgtttaacttaaccgttacggaaaaccgttaaacgtacgggaaacccttaaccgtaaagggaccggtaaaaggaaaccggggtacggtaaaaccccggtaacgggttaacgttttaaccgggtttttaaacgtttaccggtagggtttaccgaacgggtttacggttacgggtaacgttaaaacgg

SEQ ID NO: 158437 - DNA, 242 bp, Homo sapiens
  misc_feature: GYAE6OF01EHPSH.49.48.E04.1.454.CMB.1.raw
  modified_base (241)..(242): a, c, t, g, unknown or other
  misc_feature (241)..(242): n is a, c, g, or t
tcagagtcgagagacacgaccggtgctcgatttagagagcgtcacagagagaaggcacgaccggtgctcgatttagactcgcgcacagagagaaggcacgaccggtgctcgatttagctctacgctcagggcacgaccggtgctcgatttagtcacgcgagaaaggaaggggctggccctgacgtgtttctgttcccgcctcctctctctcgactctgagcgggctggcaaggcgcatagnn

SEQ ID NO: 158438 - DNA, 245 bp, Homo sapiens
  misc_feature: GYAE6OF01B0HH4.49.48.E04.1.454.CMB.1.raw
  modified_base (243)..(245): a, c, t, g, unknown or other
  misc_feature (243)..(245): n is a, c, g, or t
tcagagtcgagagacacgaccggtgctcgatttagagagcgtcacagagagaaggcacgaccggtgctcgatttagactcgcgcacagagagaagggcacgaccggtgctcgatttagctctacgctcagggcacgaccggtgctcgatttagtcacgcgagaaaggaaggggctggccctgacgtgtttctgttcccaccctcctctctctcgactctgagcgggctggcaaggcgcatagnnn

SEQ ID NO: 158439 - DNA, 246 bp, Homo sapiens
  misc_feature: GYAE6OF01BRQAM.49.48.E04.1.454.CMB.1.raw
  modified_base (243)..(246): a, c, t, g, unknown or other
  misc_feature (243)..(246): n is a, c, g, or t
tcagagtcgagagacacgaccggtgctcgatttagagagcgtcacagagagaaggcacgaccggtgctcgatttagactcgcgcacagagagaagggcacgaccggtgctcgatttagctctacgctcagggcacgaccggtgctcgatttagtcacgcgagaaagggaaggggctggccctgacgtgtttctgttcccaccctcctctctctcgactctgagcggctggcaaggcgcatagnnnn

SEQ ID NO: 158440 - DNA, 268 bp, Homo sapiens
  misc_feature: GYAE6OF01C96CM.49.48.E04.1.454.CMB.1.raw
  modified_base (254)..(268): a, c, t, g, unknown or other
  misc_feature (254)..(268): n is a, c, g, or t
tcagagtcgagagacacgaccggtgctcgatttagagagcgtcacagagagaagggcacgaccggtgctcgatttagactcgcgcacagagagaagggcacgaccggtgctcgatttagctctacgctcagggcacgaccggtgctcgatttagcacgcgaaggaaagggaagggggctcggccctgacgttgtttctcgtccccgccctcctctcctctacgactgtgaggcggctggacaagggcacatagnnnnnnnnnnnnnnn

SEQ ID NO: 158441 - DNA, 266 bp, Homo sapiens
  misc_feature: GYAE6OF01E2K15.49.48.E04.1.454.CMB.1.raw
  modified_base (247)..(266): a, c, t, g, unknown or other
  misc_feature (247)..(266): n is a, c, g, or t
tcagagtcgagagacacgaccggtgctcgatttagagagcgtcacagagagaagggcacgaccggtgctcgatttagactcgcgcacagagagaagggcacgaccggtgctcgatttagctctacgctcagggcacgaccggtgctcgatttagtcacgcgagaaagggaaggggctggccctgacgtgtttctcgttcccaccctcctctctctcgactctgagccgggctggcaaggcgcatagnnnnnnnnnnnnnnnnnnnn

SEQ ID NO: 158442 - DNA, 243 bp, Homo sapiens
  misc_feature: GYAE6OF02FP7YJ.49.48.E04.1.454.CMB.1.raw
  modified_base (241)..(243): a, c, t, g, unknown or other
  misc_feature (241)..(243): n is a, c, g, or t
tcagagtcgagagacacgaccggtgctcgatttagagagcgtcacagagagaaggcacgaccggtgctcgatttagactcgcgcacagagagaaggcacgaccggtgctcgatttagctctacgctcagggcacgaccggtgctcgatttagtcacgcgagaaagggaaggggtggccctgacgtgtttctgttcccacctcctctctctcgactctgagcgggctggcaaggcgcatagnnn

SEQ ID NO: 158443 - DNA, 247 bp, Homo sapiens
  misc_feature: GYAE6OF02IH6DK.49.48.E04.1.454.CMB.1.raw
  modified_base (243)..(247): a, c, t, g, unknown or other
  misc_feature (243)..(247): n is a, c, g, or t
tcagagtcgagagacacgaccggtgctcgatttagagagcgtcacagagagaagggcacgaccggtgctcgatttagactcgcgcacagagagaagggcacgaccggtgctcgatttagctctacgctcagggcacgaccggtgctcgatttagtcacgcgagaaaggaaggggctggccctgacgtgttctgttcccaccctcctctctctcgactctgagcgggctggcaaggcgcatagnnnnn

SEQ ID NO: 158444 - DNA, 248 bp, Homo sapiens
  misc_feature: GYAE6OF02FNSY4.49.48.E04.1.454.CMB.1.raw
  modified_base (246)..(248): a, c, t, g, unknown or other
  misc_feature (246)..(248): n is a, c, g, or t
tcagagtcgagagacacgaccggtgctcgatttagagagcgtcacagagagaagggcacgaccggtgctcgatttagactcgcgcacagagagaagggcacgaccggtgctcgatttagctctacgctcagggcacgaccggtgctcgatttagtcacgcgagaaagggaaaggggctggccctgacgtgtttctgttcccgccctcctctctctcgactctgagcgggctggcaaggcgcatagnnn

SEQ ID NO: 158445 - DNA, 516 bp, Homo sapiens
  misc_feature: GYAE6OF01BXYIX.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttgccgggccactcagagtgttagcaggtggttggcctggtatcagcagaaaccagggaaggcccctgaactcctgatctatgatgccagcagtttgaaaagtggggtcccatcaagattcagcggcaggtggatcgtgggacagagttcactctcaccatcagcagcctgcacgcctgatgtattttgctaacctattattcgaccaacgtagttaataagttagttataccgtaggtacgttcggaccgaacgggtaccgaggggtggactagtacgaaacgtaacgtggtaggactcgcaccgtacg

SEQ ID NO: 158446 - DNA, 534 bp, Homo sapiens
  misc_feature: GYAE6OF01BSDB1.16.4.A04.1.454.CMB.1.raw
  modified_base (330)..(330): a, c, t, g, unknown or other
  misc_feature (330)..(330): n is a, c, g, or t
  modified_base (354)..(354): a, c, t, g, unknown or other
  misc_feature (354)..(354): n is a, c, g, or t
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttgccggcactcagagtgttagcaggtggttggcctggtatcagcagaaaccagggaacggccccagaactcctgatctatgatgcagcagtttgaaaagtgggtccatcaagattcagcgganagtgatcgtggacagtatcactcncacatcagcagcctcgacgacgctgtagtagtatttagtactaacttaattattactactaactaagtaattaaattaagttaacgtacggtacggtacggttacggtaccggtaacggaacggtacgggtaggaacgacgaacgtaaacgaacgtacggtacggtacgtcgcgacgtac

SEQ ID NO: 158447 - DNA, 486 bp, Homo sapiens
  misc_feature: GYAE6OF01AK2SS.16.4.A04.1.454.CMB.1.raw
  modified_base (482)..(482): a, c, t, g, unknown or other
  misc_feature (482)..(482): n is a, c, g, or t
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttgccgggccactcagagtgttagcaggtggttggcctggtatcagcagaaaccagggaaggcccctgaactcctgatctatgatgccagcagtttgaaagtgggtcccatcaagattcagcggcagtggatctgggacagagttcactctcaccatcagcagcctgcagcctgatgtattttgctaacctattattgaccaacagtataatagttatccgtggacgttcggaccgaagggaccgagggtggacatacaaacgactgtggactgcnctac

SEQ ID NO: 158448 - DNA, 530 bp, Homo sapiens
  misc_feature: GYAE6OF01CIWXY.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttgccgggccactcagagtgttagcaggtggttggcctggtatcagcagaaaccagggaaggcccctgaactcctgatctatgatgcagcagtttagaaaagtggggtacccatcaagattcagcggcaggtggatcgtgggacagtagttcactctcacatcagcagcctgcagcctgatgtattttgactaaccttattacttcgacctaataacgtattaattagtttacgtccggtaggtacgttccgggacgaacggggaccgtaggggtagaactagtaccgtaaacgaacgttacggtacggctacgccaccgtacg

SEQ ID NO: 158449 - DNA, 508 bp, Homo sapiens
  misc_feature: GYAE6OF01DV2EZ.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttgccgggccactcagagtgttagcaggtggttggcctggtatcagcagaaaccagggaaggcccctgaactcctgatctatgatgccagcagtttgaaagtggggtcccatcaagattcagcggcagtggatcgtgggacagagttcactctcaccatcagcagcctgcagcctgatgtattttgactaaccttattatgaccaatatataatagttatccgtggtacgttcggaccgtaagggaccgtagggtaggaacactacgaaaacgacgttaggtacggactcggctaccgtacg

SEQ ID NO: 158450 - DNA, 530 bp, Homo sapiens
  misc_feature: GYAE6OF01BMHXB.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttgccgggccactcagagtgttagcaggtggttggcctggtatcagcagaaaccgagggaacggcccctgaactcctgatctatgatgccagctagtttagaaaaggtggggtacccagtacgaagtattacgaggcggacaggtaggagtcgtagggacagagttcactctcaccatcagcagcctgcagcctgatgtatttgactaactattatcgacctaactagttataattagttactacggtgtaacggttccgaccgaagggaccgtagggtaggaactagaccgtaaacgacgtggtacggatcgaccgtcgtacg

SEQ ID NO: 158451 - DNA, 518 bp, Homo sapiens
  misc_feature: GYAE6OF01CB5FT.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttgccgggccactcagagtgttagcaggtggttggcctggtatcagcagaaaccagggaaggcccctgaactcctgatctatgatgccagctagtttgaaaagtgggtccatcaagattcagcgcagtggatcgtgggacagtagttcactctcaccatcagcagcctgcagcctgatgtattttgactaacttattattcgacctaacgtagtaattaattagttacgtccgtaggtacgttcggaccgtaagggaccgtagggtaggaactatacgaaacgaacgttggtaggacgtcgcgtaccgtacg

SEQ ID NO: 158452 - DNA, 520 bp, Homo sapiens
  misc_feature: GYAE6OF01C9P75.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttgccgggccactcagagtgttagcaggtggttggcctggatcagcagaaaccaggaagcccctgaactcctgatctatgatgccagcagtttgaaaagtggggtcccatacagattcagcggcagtggatcgtgggacaggagttcactctcaccatacagcagcctgcagcctgatgtattttcgactaaccttattatcgacaactaagtataattagttactccgtaggtaccgttacggaccgtaaggggaccgaggggtaggaacgtataaccgaaaacgtacgtcggtacgctacgccaaccgtacg

SEQ ID NO: 158453 - DNA, 509 bp, Homo sapiens
  misc_feature: GYAE6OF01C9XLK.16.4.A04.1.454.CMB.1.raw
  modified_base (347)..(347): a, c, t, g, unknown or other
  misc_feature (347)..(347): n is a, c, g, or t
  modified_base (408)..(408): a, c, t, g, unknown or other
  misc_feature (408)..(408): n is a, c, g, or t
  modified_base (415)..(415): a, c, t, g, unknown or other
  misc_feature (415)..(415): n is a, c, g, or t
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttgccgggccactcagagtgttagcaggtggttggcctggtatcagcagaaaccagggaaggccctgaactcctgatctatgatgccagctagttgaaaagtcgggtccatcaagattcgagcggcagtggatcgtggganagagttcactctcaccatcagcagctgcagcctgactgtattttgactaacttattattanacctaanaagttataattagttatccgtaggtacgttcggaccgaagggaccgaagggtggaacgactacgaaacgtaacgtggtacggatcgcacgtacg

SEQ ID NO: 158454 - DNA, 548 bp, Homo sapiens
  misc_feature: GYAE6OF01BE1HR.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttgccgggccactcagagtgttagcaggtggttggcctggtatcagcagaaaccagggaacggcccctgaactcctgatcatgatgccagcagtttagaaaagtgggtcccagtcaagattcagcggcagtggatcgtagggacagtagttcactctcaccataagcagcctgcacgcctagattgtattttcgactaaccgttatttaacttcgacctaactagttaacttaattaagtttactccggtagggtaccgttccgggaccgtaaacgggaccgtaggggtacgaacaacgtacgaaacggtaactaggtacggctaggccaaccgtgttaccg

SEQ ID NO: 158455 - DNA, 551 bp, Homo sapiens
  misc_feature: GYAE6OF01DZQQT.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttgccgggccactcagagtgttagcaggtggttggcctggtatcagcagaaaccgagggaacggcccctagaactcctgatctatgatgccagctagttagaaaagtcggggtaccatacaagattcgagcggcagtggatcgtagggacagtagttcactctacacctatcagcagcctgcacgctgatgtattttcgactaaccttattacttacgacctaatagttaattaaattagtttactccggtaggtaccggttacggaccgaaaggggtaccgtaggggttacgacgtaacgtaaccgaaacgaacgtggtacggacgttacgccgaaccgttacg

SEQ ID NO: 158456 - DNA, 534 bp, Homo sapiens
  misc_feature: GYAE6OF01D0KLK.16.4.A04.1.454.CMB.1.raw
  modified_base (343)..(343): a, c, t, g, unknown or other
  misc_feature (343)..(343): n is a, c, g, or t
  modified_base (529)..(529): a, c, t, g, unknown or other
  misc_feature (529)..(529): n is a, c, g, or t
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttgccgggccactcagagtgttagcaggtggttggcctggtatcagcaagaaaccagggaacggcccctgaactcctgatctatgatgccagctagtttagaaaaggtcggggtacccatacaagtattcgagcggnaggtggatcgtgggacagtagttcactctacaccatcagcagcctgcacgcctgatgtattttcgactaaccttatttacttcgacctaactagttaattaattagttactccggtaggtaccgttacggaccgaagggaccgtaggggtacgaacgtactacgaaacgacgtggacggctcgccncgtac

SEQ ID NO: 158457 - DNA, 762 bp, Homo sapiens
  misc_feature: GYAE6OF01AEW0T.16.4.A04.1.454.CMB.1.raw
tcagtgtactactccacgaccggtgctcgatttagagtagtgatcaggggggagtcagacgtcaggtcagggacacagacatgggactatgagggtcccccgcgtcctagcttcctggggcttcctgctgctctggctccaggtggccaatgtgacatcccagatcgaccagtcctccgttccaccctgtctgcgatctggtacggacgacagacgtcaccaagtccgcttcgccgggctacgttacagtacgtcgttaagactaagggtggttcggtcccttagggtacttcgaacgacgaacgaaaacccaaggggaacggccccgtagaaccgtccctgtaactctagtcgtactagtccaggcctagtttacgaaaacgggtcgggtcccgactcgaaacgtattcgaaggcggacaggtcgggtacgtcggtacgggactaaggtacgttacctaccgttctaccaacctataccgacgccgacgtcctgaccgacgtcccgtaggtaattggtacgttttcgaccgtttaaaccttacgttttaacgttaccgtaaccctaaagttaacgtttaaacttaaacgtttaacgttttaaccgtacccggttttaaggggttaacccgggtttacccgggggtaaaccggtaaaccgggggtaacccgggttaaggggggttaacggaacctaaacgtaacccggtaaaaacggttaacggttcgggtacggtacccgtacgacccgtaacccttacgg

SEQ ID NO: 158458 - DNA, 563 bp, Homo sapiens
  misc_feature: GYAE6OF01BDZ06.16.4.A04.1.454.CMB.1.raw
  modified_base (332)..(332): a, c, t, g, unknown or other
  misc_feature (332)..(332): n is a, c, g, or t
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttgccggccactcagagtgttagcgaggtggttggcctggtatcagcagaaaccgagggaacggcccctagaactctgatctatgatgccagctaggtttagaaaaggtcgggtaccagtacaagnttacgagcggcagtggatcgtagggacagtagttaccacgtctaccacctatcgacgcagcccgtagctacgcctgtattagtattttcgacttaacttattacgtcgacctaacgtagttaattaattacgttacgtccggttacggtaccggttacggaccgaagggtaccgaggggtacgaacgtaacgtaacgaaacgtacgtcggacggtactacgcctacgtacg

SEQ ID NO: 158459 - DNA, 482 bp, Homo sapiens
  misc_feature: GYAE6OF01BJPS0.16.4.A04.1.454.CMB.1.raw
  modified_base (478)..(478): a, c, t, g, unknown or other
  misc_feature (478)..(478): n is a, c, g, or t
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttgccgggccactcagagtgttagcaggtggttggcctggtatcagcagaaaccagggaaggcccctgaactcctgatctatgatgccagcagtttgaaaagtggggtccatcaagattcagcggcagtggatctgggacagagttcactctcaccatcagcagcctgcagcctgatgtatttgctaacctattattgaccaacagtataatagttatccgtggacgttcggccaagggaccgagggtgacatacaaacgactgtggctgcnctac

SEQ ID NO: 158460 - DNA, 503 bp, Homo sapiens
  misc_feature: GYAE6OF01ECRVN.16.4.A04.1.454.CMB.1.raw
  modified_base (496)..(496): a, c, t, g, unknown or other
  misc_feature (496)..(496): n is a, c, g, or t
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccattgcttgccgggccactcagagtgttagcaggtggttggcctggtatcagcagaaaccagggaaggcccctgaactcctgatctatgatgccagcagtttgaaaagtggggtcccatcaagattcagcggcagtggatcgtgggacaggagttcactctcaccatcagcagcctgcagcctgatgtatttgctaacctattattgaccaacagtaataattagttatccgtggaccgttcggaccgaaggggaccgaggggtggacagtaccaaacgaacgtggtaggctcgcnccgtacg

SEQ ID NO: 158461 - DNA, 524 bp, Homo sapiens
  misc_feature: GYAE6OF01EBP97.16.4.A04.1.454.CMB.1.raw
  modified_base (222)..(222): a, c, t, g, unknown or other
  misc_feature (222)..(222): n is a, c, g, or t
  modified_base (343)..(343): a, c, t, g, unknown or other
  misc_feature (343)..(343): n is a, c, g, or t
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttgccggccactcagngtgttagcaggtggttggcctggtatcagcagaaaccagggaaggcccctgaacctcctgatctatgatgccagcagtttagaaaagtggggtcccatcaagattcagcggcagtggatcngggacagagttcactctcaaccatcagcagcctgcagcctgatgtatttcgctaacttattattcgaccaaatagtaataattagttactccggttaggtaccgttacggaccgaaacggggtacctaggggtacggactacgtaaccgaaacgaaccgtggtacggactcgcaccgtacg

SEQ ID NO: 158462 - DNA, 770 bp, Homo sapiens
  misc_feature: GYAE6OF01B9BON.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttgccggcactcagtagtgttagcgtaggtggttggcctggtatcagcagaaccgagggacgccctagaactctgatctatgatgaccagtctaggtttaggaaaaggtcgggtacccagtaccgaaagtacgttacgacggtcggacgtaggtcggaacgtcggtagggaactaggtacgttacctaccgttccgtaccaacctataccgagaccgtaacgtcccgttacggaccgtaacggtcccgttaggtaacgtttacggttacgtttttaccggaacccgttaactttaacgttttaacgtttaccggtaaacccttaaacgttaaacggtttaaacttaaaaccggtttaacggttttaaccgttacccgggttaacggggttaacccggttttaacccgggggaaacccggtaaaaccggggggtaacccgggtaaacgggggtttaaccgggaaaccgttaaaccggttaaacccggtaaaaacccggttaaccgggttttacgggtaccgggttaacccgttaaccgggtaacccttaaaccccggtttaacgg

SEQ ID NO: 158463 - DNA, 511 bp, Homo sapiens
  misc_feature: GYAE6OF01AHTGI.16.4.A04.1.454.CMB.1.raw
  modified_base (506)..(506): a, c, t, g, unknown or other
  misc_feature (506)..(506): n is a, c, g, or t
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttgccgggccactcagagtgttagcaggtggttggcctggtatcagcagaaaccgagggaacggcccctgaacctcctgatctatgatgccagctagtttagaaaagtgggtcccatcaagattacagcggcaggtggatcgtgggacagtagttcactctcacatcagcagcctgcagcctgattgtattttcgactaacttattaattcgaacctaactaagtataagttagttactcgtaggtacgtcgaccgaagggacgagggtagacataccgaaacgactggtacgactcgcnctacg

SEQ ID NO: 158464 - DNA, 571 bp, Homo sapiens
  misc_feature: GYAE6OF01DRZG9.16.4.A04.1.454.CMB.1.raw
  modified_base (390)..(390): a, c, t, g, unknown or other
  misc_feature (390)..(390): n is a, c, g, or t
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttgccgggccactcagagtgttagcaggtggttggcctggtatcagcaagaaaccagggaaggcccctgaactcctgatctatgatgcagctaagtttaggaaaaggtcgggtacccatacaagattcgagcggcaggtggatcgtgggacagtagttcactctcaaccatcagcaccgctgcngcctgtatgtatttgactaaccttattacttacgacctaaacgtagttaattaagtttaacgttacttacccgggttagggtaaccggtttccgggaacccgtaaagggggacccgtaaggggtaggaacgtaacgtaaaccgaaacgaaacgttggtacggcttacggcctaaccgtacg

SEQ ID NO: 158465 - DNA, 557 bp, Homo sapiens
  misc_feature: GYAE6OF01C8QHH.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtcctccttccaccctgtctgcatctgtaggagacagagtcaccatcgcttgcccggccactcaggagtgttagcgaggtggttggcctggtatcagcaagaaaccgagggacgcccctagaacctccgtgatctatgatcgccagactagtttagaaaggtcgggtaccatacaagattcgagcgcgagtggatcgtgggacagtagttcactctacaccatcagcacgcctagccgagtccgtgtacttgtattttcgacttaacttattacgtacgacctaactaagttaattaatttatttacgtcgttaggtaccggttcgggaccgtaagggaccgaaggggtagaactagtaaccgtaaaacgtacgtggtacgtacttcgaccgtactacg

SEQ ID NO: 158466 - DNA, 576 bp, Homo sapiens
  misc_feature: GYAE6OF01ATWME.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttgccgggccactcagagtgttagcgaggtggttggcctggtatcagcagaaaccgagggaacggcccctagaacctctgatctatgatgccagctagtttagaaaaggtcggggtacccatacaagtattacgaggcggacgtaggtggtatcggtagggactaggtagttcacttcctacgaacctatcagtcagcctgacacgtcctagatgtatttcgactaacttattacttcaacctaactaagttaattaagttaagttacgtaccggtaggtaccggttaccggaccggtaaacggggtacgtaggggtaggaactacgtaaccgaaaacgtacgtggtacggtactacggcctaccgtacg

SEQ ID NO: 158467 - DNA, 529 bp, Homo sapiens
  misc_feature: GYAE6OF01AEMLD.16.4.A04.1.454.CMB.1.raw
  modified_base (190)..(190): a, c, t, g, unknown or other
  misc_feature (190)..(190): n is a, c, g, or t
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtagganacagagtcaccatcgcttgccggccactcagagtgttagcaggtggttggcctggtatcagcagaaccagggagcccctgaactcctgatctatgatgccagcagtttagaaaggtcgggtacccagtcaagtattcgagcggcaggtggatcgtgggacagagttcactctcaccatcagcagcctgcacgcctgatgtatttcgactaaccttattactcgacctaagtagttaattaagttacgttacgtccggttaggtaccggttcggaccgtaacgggaccgtagggtacggactacgtaccgaaacgtacgtggtacggactcgcctactcg

SEQ ID NO: 158468 - DNA, 685 bp, Homo sapiens
  misc_feature: GYAE6OF01D1HMG.16.4.A04.1.454.CMB.1.raw
  modified_base (627)..(627): a, c, t, g, unknown or other
  misc_feature (627)..(627): n is a, c, g, or t
tcagtgtactactccacgaccggtgctcgatttagagtagtgatcagggggagtcagactcagtcaggacacagcatggacatgagggtccccgctcagctccgtggggctcctgctgctctggctcccaggtgccaaatgtgacatccagatcgacccagtcctcccttccaccctgtctgctatctggtaggagacagacgtcaccatcgcgttcggccgggccactcagtagtgttagcgtagggttggttcggccgtggtactcgagacgaacgaaaccgaggggaaccgcccctagaacctccgtagacttctatgactcgaccagtacgttaaggttaaggaaacgggttccgggtacctaagttacgaaacgtacgttacgacgggtcggtagtaggtacgggtactcgggtagggactaaggttaccttaccgtaccttccgacctaacctacgtacgaacgccgtacgtccgtacgcgtaccgtccgtagtagttcgtttagtttccgaaccttaaccttattaccgtcgaacctaacgtaagttaagttaacgtttacgtacgttaccgggtacggttaccgggtacccggaccggaacggggtacggtacgggtanaacgtaacgtaaacgtaaaccgttacggcggttaccggacgtccgacctaacggttcg

SEQ ID NO: 158469 - DNA, 517 bp, Homo sapiens
  misc_feature: GYAE6OF01AH9GB.16.4.A04.1.454.CMB.1.raw
  modified_base (484)..(484): a, c, t, g, unknown or other
  misc_feature (484)..(484): n is a, c, g, or t
  modified_base (512)..(512): a, c, t, g, unknown or other
  misc_feature (512)..(512): n is a, c, g, or t
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttgccgggccactcagagtgttagcaggtggttggcctggtatcagcagaaaccagggaacggcccctgaactcctgatctatgatgccagcagtttagaaagtggggtcccatcaagattcagcggcaggtggatcgtgggacaggtagttcactctcaccatcagcacgcctcgcacgcctagattgtatttcgactaaccttattacttgacctaatagttataattagttatccgtaggtacgttcgggaccgtaagggaccgagggtagaacngtaaccgaaacgacgtcgtggactgccncgtac

SEQ ID NO: 158470 - DNA, 755 bp, Homo sapiens
  misc_feature: GYAE6OF01C31TW.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatcgacccagtcctccttccaccctgtctgcatctgtaggagacagagtcacatcgcttgccggccactcgagagtgtagcgtagggtggttggccgttggtatcgagcaagaaaccgagggaacggccctaggaacctccgtagacttctagtgagtcgcctagactaaggttaggaaaacggttcggggtaccctagtacgtaaagtacgttacgacggtcggtacgtaaggtacgggtaacgttaccggttacggggaaccgtaacgggtttaacgtttacccgtaacccgttacccgtttacccaaaccccgtaacgttacccggaacggacccgtaaccggtcccttacggaacccgtacgggtaccccgttaagggttaactttacggtttaacgttttaccggaacctttaaaccgtttagttaacgtttaaccgaacctaacgttaaacgtttaagttaaacgtttacgttttaaccgtccgggttaacggttacccgggttaccggaaacccggttaagggggtaaccggtacggggtaggtaactacggtaaaccgaaacggtagtccggtagccgttcgaaccgtcgttaccgg

SEQ ID NO: 158471 - DNA, 562 bp, Homo sapiens
  misc_feature: GYAE6OF01B1MAN.16.4.A04.1.454.CMB.1.raw
tcagtgtactactccacgaccggtgctcgatttagagtagtgatcaggggggagtcagactcagtcaggacacagcatggacatgagggtccccgctcagctcctggggctcctgctgctctggctcccaggtgccaaatgtgacatccagatgacccagtcctccctccaccctgtctgcatctgtaggagacagagtcaccatcgcttggcccgggccactcagagtgttagcgagggtggttggcctggtatcgagacaagaaaccgagggaacggcccctagaactccgtgacttctatgatgccagactaaggttaggaaaggtcgggtacccagtacgaagtattcgaggcggactaggtggaactcggtagggacaggtacgttcactctaccacactcagcagcctgcacgctagtatgttatttcgacttaactttattatacgaacctaataagttaataagttagttactcggtaggtaccgtcggaccgaagggtaccgagggtagaactacgacgaaaacggtacgtggtacgactcgaccgtactacg

SEQ ID NO: 158472 - DNA, 747 bp, Homo sapiens
  misc_feature: GYAE6OF01BUN3K.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatcgacccagtctcccttccaccctgtctgcatctgtaggagacagagtcaccatcgcttgctggccactcagtagtgttagcgtaggttggttcgcgttggtatcgagacgaacgaaaccggagggaaccggccccgtagaaccgtccgtagtacttacgtagtgatcgaccgagtacgtaaggtttacggaaacggtcgggtaccctagtacgaagtacttacgacggcgtacgtaggtacggacgttcgtagggaactagtacgttaccacttacctacctaactacgtaccgacgaccacgcctacgcgtacgtccgttagtacgttcgttaacttttaccgaacctttaaccgtttaagttacccgttaacggtaacccctaaacgttaacgtttaaacgttaaacgtttaccgggttttacgtaccccgggtttaaggggttaacccgggtttacccgggtaaacccgggtaaacggggtaccccggttaaaggggggtaccggtaaaccgtaaaacccggtttaaccggaaaaacccgggttacgttaccggggtaaccggttacccgtacgggtaaccccgttaacccg

SEQ ID NO: 158473 - DNA, 528 bp, Homo sapiens
  misc_feature: GYAE6OF01AYH0M.16.4.A04.1.454.CMB.1.raw
  modified_base (395)..(395): a, c, t, g, unknown or other
  misc_feature (395)..(395): n is a, c, g, or t
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttgccgggccactcagagtgttagcaggtggttggcctggtatcagcagaaaccagggaaggcccctgaactcctgatctatgatcgccagcagtttagaaaagtggggtacccagtcaagattcagcggacaggtggatcgtgggacagtagttcactctcaccatcagcagcctgcagcctgatgtntttgactaactattattcgaccaactaagtattaagttagttaagtccgttagggtaccgttcgggaccgtaaggggaccgtaggggtacggacacgtaccgaaacgacgtaggtcggactagccgacctacg

SEQ ID NO: 158474 - DNA, 761 bp, Homo sapiens
  misc_feature: GYAE6OF01ENMSH.16.4.A04.1.454.CMB.1.raw
tcagtgtactactccacgaccggtgctcgatttagagtagtgatcgagggggagtcagactcagtcaggacacagcatggacatgagggtccccgctcagctcctggggctcctgctgctctggctccaggtgccaaatgtgacatccagatgacccagtctccttccaccctgtctgcatctgtaggagacagacgtcaccatcgcttcgccggccactcagagtgttagcgtagggttggtcggccgttggtatcgagacaacgaaaccgagggaaccggcccctagaacctccgtagactcgtatgtaagtcgccagtacgtaaggtttaaggaaaacggttcgggtaccctagtacaaacgtacttacgacggtacggtacgaggttagggtacgtcggtaggggaactacggtaacggtttaccaacctttaccgtaacctaacccacgttaccgaacgtacgtaacccggtccgttacgaccgtaacgtcccgttaggtaacgtttcgtttaaacgttttcggtaaacccttaaacgttttaacgtttaacttacggtaaaccccttaaacgttaacgtttaaattaaacgtttacggtttaacggttacccgggttaacgggtacccgggttaacccgggaaacccgggtaaacggggtaacccggtaacgggggttaacgtaaccggtaaacgttaacccgggtaaaaacggtcgttacgggtacggtaccgttaccggactacccgttaacg

SEQ ID NO: 158475 - DNA, 720 bp, Homo sapiens
  misc_feature: GYAE6OF01EOB4D.16.4.A04.1.454.CMB.1.raw
  modified_base (188)..(188): a, c, t, g, unknown or other
  misc_feature (188)..(188): n is a, c, g, or t
tcagtgtactactccacgaccggtgctcgatttagagtagtgatcagggggagtcagactcagtcaggacacagcatggacatgagggtccccgctcagctcctggggctcctgctgctctggctccaggtgcaatgtgacatccagatgacccagtcctccttccaccctgtctgcatctgtagganacagacgtcaccatcgcttgccggccactcagagtgttagcgtaggtggttggcctggtactcgagcaagaaccgagggaacggcccctagaacctcctagacttcgtatgactcggccagtactaggtttacgaaaagggtcgggtaccagtacgaaagtattaccgaggtaccggagtaaggtcgggtaagttccggtagggggaacctaaggtacgtttaccgaccttaccgtaccaaccccgtagttaccgaacggtaccacggtcccgttaggaacccgaccggttacccgtaggttaacgttacgtttacgttttaccgaaaccctttaacccgtttagttttaacttacggtaaccaaacgttaagtttaacgttaaagtttaacgggtttaaccttaccgggttacggtaacccgggtttaccgggaaccggtaacggggtaaccccggtaggggttacggaacctaacgtaaacccggaaacctacggtacggttacggaccttcggaccctaaccgttaccg

SEQ ID NO: 158476 - DNA, 600 bp, Homo sapiens
  misc_feature: GYAE6OF01EIGVO.16.4.A04.1.454.CMB.1.raw
  modified_base (190)..(190): a, c, t, g, unknown or other
  misc_feature (190)..(190): n is a, c, g, or t
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtagganacagagtcaccatcgcttgccggccactcagagtgttagctaggtggttggcctggtatcagcaagaaaccgagggaacgcccctagaacctcctgatctatgatgccagctagtttaggaaacggttcggggtacccagtacaagtattacgacggcggcaggtggatcgagggacagtagttcacttacctacgaccattacgagtccgacgacctgaccacggcctaggtattacggttacttttacgacctttaacttattactacgaacctaaacgtaagttaacttaaagtcgtttaacgtccggtacggttaccggttaccggaccggtaaacggggaccgtacggggtacgaactaacgaacgtaaaccggtagtacgtacggacgttacgaccgtcctacg

SEQ ID NO: 158477 - DNA, 636 bp, Homo sapiens
  misc_feature: GYAE6OF01BXW2H.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttggccgggccactcagtagtgttagcgtaggtggttggccttggtatcgagacaagaaaccgagggaacggcccctagaacctcctgtatctagtgatcgccagctaaggtttagaaaaggtcgggtacccataccgaagtacttacgaggcggacgtaggtcggagttcggtagggtaactaggtacgtttcgacgttccttaccaacctaacgttcgaacggccgtaacgtcccgttagaccgtacgacccgttaggacgttgttacgttttacgaccttaaactttagttaacttaccgaaccttaaagtagttaacttaagttacgttacgtacggtacggtaccgttacggaccggtaagggtaccgtagggtagacgtaacgtaaccgaaacgtacgtcggacgtacacgtaccgacgttacg

SEQ ID NO: 158478 - DNA, 731 bp, Homo sapiens
  misc_feature: GYAE6OF01DKSNN.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttgccggccactcagagtgttagcgaggtggttggcctggtatcagcagaaaccgagggaaggcccctgaactcctgatctatgatcgcagctagtttaggaaaagtcggggtcccaagtacaagtattcgaaggcggacaggtggtactcgtaggggacaggtaacgttcaaccgttcctacgtaacctacttaccacggacctaacggcccgttgacccgacggtcccgttaggtactttacggttaacttttttacggacccttaaaccctttaacgttttaacgtttaaccggaacccgttaaaaccgtaaaggttttaaactttaaaagtttaacggtttttaaacggtttccccgggttaacggggtttaacccgggtttaccggggtaaaccccgggtaaacggggggtaaacccggtaacggggggttaacgggaaccgttaaacggttaaacccgtaaaaacggtaaaccggttacgggttaccgggtaccgttacggacccctaaccgttaaacg

SEQ ID NO: 158479 - DNA, 552 bp, Homo sapiens
  misc_feature: GYAE6OF01C9I0L.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttgccgggccactcagagtgtagcaggtgttggcctggtatcagcaagaaaccgagggaacggcccctgaactcctgatctatgatcgcagctagttagaaaggtcgggtacccagtacaagattcaggcggacgagtggactcgtgggacaggtattcacttcaccaccatacacgacagcctagcacgcctgacttgtactttgacctaacttatttactcaacctaactagttaattaacgtagttatccggtaggtaccgttaccggacgaagggtaccgtaggggtagaacgtaacgtaacgaaaacgtacgtacggtacgggacctacgcctaacgtacg

SEQ ID NO: 158480 - DNA, 572 bp, Homo sapiens
  misc_feature: GYAE6OF01CX7CQ.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctcccttccaccctgtctgcatctgtaggagacagacgtcaccatcgcttgccggccactcagagtgttagcgaggttggttcggccttggtatcgagacgaacgaaaccgagggaacggcccctagaacctccgtgatctatgatcgcagctagttagaaggtcgggaccagtacaagtatcgaggcgtcgagtggacttcgtgggacaggtacgttcacttcacactactacacgcacgcctgacacgcctagactgttatttcgactaacttattacgtcgactaacgtagttacttaattacgttacgtaccggttaggtaccggttaccggaccgtaacgggaccgtaggggtacgaacgtaactaacgaaaaccggtacgttacggtacggctacgcgtaactacg

SEQ ID NO: 158481 - DNA, 669 bp, Homo sapiens
  misc_feature: GYAE6OF01DCKFI.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcacatcgcttggccggccactcagtagtgttagcgtaggtggttggccgtggtatcagcaagaaccgaggacgccctagactctgactctatgagtcgccagtcgtaaggtttaggaaaacggtcgggtaccctaagtacgtaagtacgttacgaggcggacgtaggtaggtagtacgtagggaacgtaggtacgttaccgtactcctacgaccataccgagaccgtaacggtccgtacgaccgtacgaccgtagtacgttagttacttttacggaacccttaaactttacttaacgttaccgtaaacctaacgttaagttaaattaacgtttacgtttaacgttaccgggttacgggtaacccggttacgggacccggtaaacggggtaacccgggtacgggttaacggaccgtaaacgttaaccgaaaacgttacgtcggtacggtaccgtacgtaccctaacgttaacg

SEQ ID NO: 158482 - DNA, 548 bp, Homo sapiens
  misc_feature: GYAE6OF01B5E9J.16.4.A04.1.454.CMB.1.raw
  modified_base (536)..(536): a, c, t, g, unknown or other
  misc_feature (536)..(536): n is a, c, g, or t
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttgccgggccactcagagtgttagcaggtggttggcctggtatcagcagaaaccgagggacggcccctagactcctgactctatgatgccagctagtttagaaaggtgggtaccatcaagattcgagcggcaggtggatcgtagggacaggacgttcactctacaccatacagcacgcctgcacgcctagattgtattttcgacctaacttattattcgacctaacgtagttaattaagttagttacgtaccggttaggtaccggttaccggaccgaaaggggtaccgtaggggtagaacgtacgtaaccgaaagtacgtgtacggtacncgccaccgtacg

SEQ ID NO: 158483 - DNA, 692 bp, Homo sapiens
  misc_feature: GYAE6OF01CP01M.16.4.A04.1.454.CMB.1.raw
tcagtgtactactccacgaccggtgctcgatttagagtagtgatcaggggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttggcccggccactcagtagtgtagcaggtggttggcctggtatcagacagaaccaggggaacggccctggaactccgtgatctatgatcgacagactagttagaaaggtcggggtacccagtacgaagtacttcgaggcggacgaggtaggacgttacgtacggggacaaggttacgttacctaccgttcctaccaacccgtattaccgaacgaccgtaacggtcccttaggaccctacggtaccttagtaacgtttacgttactttttacggaaccctaacccttttaagtttaccgtttacggaaccctaaacgttaagtttaaacgttaacgtttaacggtttaaccgttccggttaacgggttaacccggtttaccgggaaccccggtaagggggaacccggttaggggtaccggtaactaacgttaaccggaaaacgttaccgtacgggttacggaccttacggacctaacccgttacg

SEQ ID NO: 158484 - DNA, 538 bp, Homo sapiens
  misc_feature: GYAE6OF01CA7XR.16.4.A04.1.454.CMB.1.raw
  modified_base (191)..(191): a, c, t, g, unknown or other
  misc_feature (191)..(191): n is a, c, g, or t
  modified_base (299)..(299): a, c, t, g, unknown or other
  misc_feature (299)..(299): n is a, c, g, or t
  modified_base (504)..(504): a, c, t, g, unknown or other
  misc_feature (504)..(504): n is a, c, g, or t
  modified_base (507)..(507): a, c, t, g, unknown or other
  misc_feature (507)..(507): n is a, c, g, or t
  modified_base (528)..(528): a, c, t, g, unknown or other
  misc_feature (528)..(528): n is a, c, g, or t
  modified_base (533)..(533): a, c, t, g, unknown or other
  misc_feature (533)..(533): n is a, c, g, or t
tcagtgtactactccacgaccggtgctcgatttagagtagtgatcagggggagtcagactcagtcaggacacagcatggacatgagggtccccgctcagctccgtgggctcctgctgctctggctcccaggtgccaaatgtgacagtccagatgacccagtcctccttccacctgtctgcatctgtagganacagagtcacagtccgcttcggcccggccactcagagtgtagcgaggtggtgctggtactcgagcaacgaaaccgagggacgtccctagtaacctccgtgactctagngatcgacctagtctagtttagaaacggtcgggtacccagtacgaagtatcgacggcgagaggtgactcggtaggactaggtacgttcaacttcgtaccacctagtaccgagccgtacgcctgaccgacgtccgtagtatcgtatttcgactacttatatcgactacagttatatgtcgtcgtagtacgtcgcgaggccgaggtanacncgtacaaacgtcgtagtcgancgacngtacg

SEQ ID NO: 158485 - DNA, 767 bp, Homo sapiens
  misc_feature: GYAE6OF01B55UI.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctggctccaggtgccaaatgtgacatccagatcgaccagtctccttccaccctgtctgcatctgtaggagacagagtcacatcgcttgccggcactcagtagtgttagcgtagggtggttggcctggtactgagacaacggaaaccgaggggaacggcccctaggaacctccgtgatctagtgacgtcgacctagtaccgtaaggtttaaggtaaaacggttcggggtaccctaagtaccgaaagtacgttacgacgggtccggacgtaggttcggtagttacggtacggggaacgtaggtaaccgtttacctaccggttccctaaccgaccctaacgttccgaacggtcccgtaacggtcccttaggaccgacgttacccgggtagtacgtttacggtttaattttaccgaacctttaaacttacgtttaacgttccgtaaaccctaacgttaaagtttaaacttaaacggttttaacggttaaccggttacccggttacgggggttaaccccggtttaacggggaaccggtaaacccgggggtaaccggtaacgggggtaaccggtaaacggtaaaccgttaaaccggaaaaccggtaacgggtttagggaccggttaaccgttccgaaccgtaccccgtttaacg

SEQ ID NO: 158486 - DNA, 562 bp, Homo sapiens
  misc_feature: GYAE6OF01B237D.16.4.A04.1.454.CMB.1.raw
  modified_base (95)..(95): a, c, t, g, unknown or other
  misc_feature (95)..(95): n is a, c, g, or t
  modified_base (279)..(279): a, c, t, g, unknown or other
  misc_feature (279)..(279): n is a, c, g, or t
  modified_base (376)..(376): a, c, t, g, unknown or other
  misc_feature (376)..(376): n is a, c, g, or t
tcagtgtactactccacgaccggtgctcgatttagagtagtgatcagggggagtcagactcagtcaggacacagcatggacatgagggtccccgntcagctcctggggctcctgctgctctggctccaggtgccaaatgtgacatccagatgacccagtctccttccaccctgtctgcatctgtaggagacagagtcaccatcgcttggaccggccactcagagtgttagcaggtggtaggcctggtatcgagcagaaccgagggacgtcccctgaacnctgatctatgatgccagacgtagttaggaaacggtcgggtccagtacaagtacttcgagcggataggtgaacgtcgtgggactagtacgttcactcncacgactcagtcacgcctgcgtagcctagagttctattttacggactaaccttatttactacgacccgtaaataagttaataaagttacgtttacgtccgtaggtaccgttacggaccggtaaacgggccgtaaggggtgaactacgaaccgaaacggtaccgtgtaggaccttcggactcgtacg

SEQ ID NO: 158487 - DNA, 580 bp, Homo sapiens
  misc_feature: GYAE6OF01BR51F.16.4.A04.1.454.CMB.1.raw
  modified_base (427)..(427): a, c, t, g, unknown or other
  misc_feature (427)..(427): n is a, c, g, or t
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttgccgggccactcagagtgttagcgtaggtggttggcctggtatcagcagaaaccgagggacgccctagaactctgatctagtgatgcagctagtttagaaacggtcgggtaccatcgaagtacttcgagcggcaggtggtatcgtagggacaggtagttccactcctacaccatacacgctacgtcctgactacgcctgatgtatttcgactaaccttnttactacgacctaaagtagttaattaagttacgttacgtcgggtaacggtaccggttaccgggaacgtaaaccggggtaccgtacggggtacgtaacgtaacgtaaaccgaaaccggtactacgggtacgtaccgtacgtacccacgttaccg

SEQ ID NO: 158488 - DNA, 594 bp, Homo sapiens
  misc_feature: GYAE6OF01BZJ4K.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttcgccgggccactcagagtgttagcaggtggttggcctggtatcagcaagaaaccgaggggaacggcccctagaacctcctgatctatgatgccagctagtttaggaaaaggtcggggtacccatacgaagattcgaggcggcgaggtggatcggtagggactaggtacgttcaccgttctaccaaccctatcacgccacgccgtgccacgcctagtacttgttattttcgaccttaaccttattacttacgacctaaacgtagttaacttaattacgttacgtacccggttagggtaccggttacggacccggaaaggggtacccggtaggggtacggaactacgtaaccgaaacggtacgtcggtacggactcgacctaccgtac

SEQ ID NO: 158489 - DNA, 496 bp, Homo sapiens
  misc_feature: GYAE6OF01BMF8D.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttgccgggccactcagagtgttagcaggtggttggcctggtatcagcagaaaccagggaaggcccctgaactcctgatctatgatgccagcagtttgaaaagtgggtacccatcaagattcagcggcagtggatcgtgggacagagttcacgtctacgacatcagcagcctgcacgcctgatgtatttgactaactattatcgacaagagtaataattagtatcgtggtaccgttcgaccgaagggacgtagggtgactagtacaaacgtactgtacggctcgcacgtac

SEQ ID NO: 158490 - DNA, 866 bp, Homo sapiens
  misc_feature: GYAE6OF01DYFO2.16.4.A04.1.454.CMB.1.raw
tcagtgtactactccacgaccggtgctcgatttagagtagtgatcagggggagtcagactcagtcaggacacagcatggacatgacgggtccccgctcagctccgtggggctcctgctgctctggctcccgaggtgaccaatgtgacatccagatcgaccctagtccttcccttccaccctgtctgctatcgtaggtaggagacgagacgtaccaccgtacgtccggtccgttccgggccccgggtaccctaccgtaccgaaggtaggttacggttacggacggtaggggttcgggttccggtccgttaggtaactaccgaacggtaccgaaaacgggaaacccggtacggggaacccgtaccccgtaacgtaaccgtcgtacgtacgttacgtagtacggtacgtcggaccgtaaggtacgttaaagggtttaacggtaaaccgggttccgggtacctaagtacgtaaacgtacgttacggacgggtaccggtacgtaggtacggtacgtacgggtaacgggacgtacggtaaccgtttacctaccgttacctaccgtaaccgtagtaccgtacgaccgtaaccgtcccgtacggtacgtaccggtacgttacgttacgtttacgtttaacgttaccgtaaacctttaacgtttaacgtttaaccgtcccgtaaaaccttagttaaaggtttaaccgtttaaagtttccgttaccgggtacccgttaacggggtacccgggttaacccgggaaaccgggtaaacggggttaccggtacgggtttaacccggaaacgttaaccggtaaacccgtaaacggttcccggttaggttaccgacccgttacggtaaccctcccggttacg

SEQ ID NO: 158491 - DNA, 639 bp, Homo sapiens
  misc_feature: GYAE6OF01EJ893.16.4.A04.1.454.CMB.1.raw
  modified_base (293)..(293): a, c, t, g, unknown or other
  misc_feature (293)..(293): n is a, c, g, or t
  modified_base (338)..(338): a, c, t, g, unknown or other
  misc_feature (338)..(338): n is a, c, g, or t
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttcgccgggccactcagagtgttagcaggtggttggcctggtatcgagcaagaaaccgagggaacggcccctgaactcctgatctangtactgccagtctaggtttaggaaaggtcggggtaccatcaaagnttcagcgacagtggatcgtagggactagacgttcacgttctaccaacctatacagcagtccgtcgactaccggtacctagacttggtacttttacgacttaaacccgttattacgtttacgaacccaaacgtagttaattaaagttacggtttaacgtcccgggttaacgggtaccgtttaacccgggacccgtaaaacgggggtacccgtaacgggggttacggaaccgtaacgttaaacccgaaaacggttaacggtacggttacgggtaccgtttaccgacccgtaacccgttaacgg

SEQ ID NO: 158492 - DNA, 563 bp, Homo sapiens
  misc_feature: GYAE6OF01DI8KW.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcacatcgctgccggccactcagagtgttagcaggtggtggcctggtatcagcagaaaccgagggaacggcccctagaacctcctgactctatgatgccagctaagtttaggaaaagtcggggtacccatacgaaagtattacgaggcggcgagtggatcgtagggacaggtagttcacgtctccaccataccagccacgtcctagaccagccctgactagtattttcgacctaacttacttattcgaacctaacgtaagttaattaattacgttacgtaccggttaggtaccggttacggaccgaacgggtaccggagggtacggaacacgtacgaaacgaaccgtgtacggatcgcgccgtaacg

SEQ ID NO: 158493 - DNA, 589 bp, Homo sapiens
  misc_feature: GYAE6OF01ER7Z0.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttgccgggccactcagagtgttagcgaggtggttggcctggtatcagcaagaaaccgagggaacggcccctagaacctcctagatctatgatcgccagtctaggtttagaaaaggtcggggtacccagtacaaagtattcgaggcggcaggtggatcgtagggacaggtagttcactctacaccatcgagcagcctgcacgtccgtagattagtattttgacctaacgtttattaacttacgtaccctaaactaagttaattaagttaagtttacgtaccgggttacggtacggttacccggaccgaaacggggtaccggtaaggggtacggaactacgtaacgaaaccggtaacgtaggtacggacgtcgacctccgtaacg

SEQ ID NO: 158494 - DNA, 660 bp, Homo sapiens
  misc_feature: GYAE6OF01AUI8S.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttgccgggccactcagagtgttagcgtagggtggttcggcctggtatcgagcaagaaaccgagggaacggcccctagaactccgtgatctatgatgccagtctaggtttaggaaacggttcggggtacccagtacgaagtacttacgaggtcggacgtaggtacggacgtcggtacgggactaaggtacgtttccacttacctaccgaacctacgtaccgacgccgtaacggtcctacgaccacggtaccttaggattacgttactttacgaccttaactttattacgttacgaacctaacgttaagttaagttaacgttacgttaacgttccggtacgggttaacccggtttacgggaacccggtaacggggacccggtaacggggtacgtaacgtaaccgtaaaccgaaacgggttacgtacgggtagtaccgtacgtaccgtacgttaacg

SEQ ID NO: 158495 - DNA, 821 bp, Homo sapiens
  misc_feature: GYAE6OF01DZML3.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttgcccgggccactcagagtgttagcgaggtggttggcctggtatcagcaagaaaccgagggaacggcccctaggaacctcctagatctacgtgactgccgagtcgtaaggtttaagggaaaacgggttcggggtacccctaagtaccgtaaagtacgttacgaacggtccgggacgtaagggttagggtacgtaccgggtacgggggtaaccgtaaggttaccggtttacctacccgtttcccgtaacccgtaaacccgtacgttaccgaacggtaccgtaaccggtccccgtacgggtaaccgtaccggtaccccgttaggttaacgtttacgggtttaacttttttacccggaaccttttaaacccgttttaagttttaaccggttaacccgtaaacccgttaaaacggtttaaacggttaaacgttttaaaacgttttaaccggggtttaaccgtttaccccgggggtttaacgggttaccccgggtttaccggggaaaccccgggtaaacgggggtacccgggtaaaggggtacccggtaaacgtaacgtaaacccggtaaaacggtacggttacgggtacggaccgttaccgaccgtaaccgttaccgg

SEQ ID NO: 158496 - DNA, 492 bp, Homo sapiens
  misc_feature: GYAE6OF01COK6I.16.4.A04.1.454.CMB.1.raw
  modified_base (367)..(367): a, c, t, g, unknown or other
  misc_feature (367)..(367): n is a, c, g, or t
  modified_base (376)..(376): a, c, t, g, unknown or other
  misc_feature (376)..(376): n is a, c, g, or t
  modified_base (485)..(485): a, c, t, g, unknown or other
  misc_feature (485)..(485): n is a, c, g, or t
  modified_base (487)..(487): a, c, t, g, unknown or other
  misc_feature (487)..(487): n is a, c, g, or t
tcagtgtactactccacgaccggtgctcgatttagagtagtgatcagggggagtcagactcagtcaggacacagcatggacatgagggtccccgctcagctcctgggggctcctgctgctctggctcccaggtgccaaatgtgacatccagatgacccagtctccttccaccctgtctgcatctgtaggagacagagtcaccatcgcttgccgggccactcagagtgtagcaggtggttggctggtatcagcagaaaccagggagccctgaactcctgatctatgatgccagcagtttgaaaagtggggtacccatcaaagattcaggcggcaagtggaatcgtagggacaggattcactctcacancagcacgcngacagctgtatagtattgactaacttatatacgaaccaatagtaataagttagttatacgtaggtacgtcgacgaaggacgaggtagacacaacaaagtacgtgacgancncacac

SEQ ID NO: 158497 - DNA, 725 bp, Homo sapiens
  misc_feature: GYAE6OF01D631D.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctggctcccaggtgaccaaatgtgacatccagatcgacccagttcctcccttccaccctgtctgcatctgtaggagacagacgtccaccagtccgtcgttcggcccggaccacgtcgagtacgttgtagcgtagggttggttcggtccgtggtatcgaagacgaacggaaaccgagggaaccgtccctaggtaacctcgtagtacttcgtacgtcgtactcgaccgtagtacgttaaggtttaacggaaacggttccgggtaccaacgtacaacgtacgttacgacggtcggtagacggttggacgttcggaacggtacgtagtaccgtcctactactacctactataccgacgtcgacgtcccgtagtccgacgtacgtagtagtttacgtaacgttttccgaacgtttaacttacgttataaccgtaacgtaaacttaggttaaaatttacgttaacccggtttacgtaccggggttacgggtaacccggttaacgggtaaaccccggggtaaacgggtaacccgggtttggggaacctaaccggttacggaaacgtaaccggttacgttcggaccggtacctccggtaacctacccggttaac

SEQ ID NO: 158498 - DNA, 567 bp, Homo sapiens
  misc_feature: GYAE6OF01D8KRH.16.4.A04.1.454.CMB.1.raw
  modified_base (336)..(336): a, c, t, g, unknown or other
  misc_feature (336)..(336): n is a, c, g, or t
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttcgccgggccactcagagtgttagcgaggtggttggcctggtatcagcaagaaaccgagggacggcccctgaactctgatctatgatgccagctagttagaaaggtcgggtccatcaagattcaggcgnagtggatcgaggacagacgttcactcacaaccatcagcacgctacgcacgcctagacttcgtattttacgacttaaccttatttacgtcgtacctaagtagttaataacgttagttaacgtccggttacggtaaccggttcggaaccggtaaacggggtaccggtaaggggtacgaacgttaactaaccgaaacgtaaacgttcggtacggacctacggcctacgttaccg

SEQ ID NO: 158499 - DNA, 541 bp, Homo sapiens
  misc_feature: GYAE6OF01DWU3W.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttgccgggccactcagagtgttagcgaggtggttggcctggtatcagcaagaaaccgagggacggcccctgaactctgatctatgatgccagctagtttaggaaaggtcgggtaccagtacaagtattcgacggcggacaggtaggatacgtgggactagtacgttcactctccaccatcagcacgtcctgcacgcctgatcgtatttcgactactattactgacctaagtagtaattaattacgttacgtcggttacggtaccgttcggaccggtaagggtaccgagggtagaacgtactacgaaacgtactcggtacggcttcgactccgtac

SEQ ID NO: 158500 - DNA, 647 bp, Homo sapiens
  misc_feature: GYAE6OF01DRF9T.16.4.A04.1.454.CMB.1.raw
  modified_base (449)..(449): a, c, t, g, unknown or other
  misc_feature (449)..(449): n is a, c, g, or t
tcagtgtactactccacgaccggtgctcgatttagagtagtgatcaggggggagtcagactcagtcaggacacagcatggacatgagggtccccgctcagctcctggggctcctgctgctctggctcccaggtgccaaatgtgacatccagatcgacccagtcctcccttcccacccttgtctgcatctgtaggagacagagtcaccatcgcttcggccggccactcagtagtgtagcgaggttggttggccgtggtactcagacaacgaaaccgagggaacgcccctagaactcctagactcgtagtgatcgcagtacgtaaggtttaagggaaacggtccggggtacctagtacgaagtagttacgaggcggacgtaggtacggactcggtagggactaggtacttcacgttcctaccactactacgacgtccaggtccgtgaaccncgttaccgtagtacttggttactttacgacttaaccttattacgtagacctaaagtagttaacttaacgttacgtttacgtaccggtacgggttaccggtccggacccggtaaggggacgttaacggggacgtaaacttaaacgtaaccggtaaacggtaacgttcgggtaccgaccggttacacccgtaccgttacg

SEQ ID NO: 158501 - DNA, 573 bp, Homo sapiens
  misc_feature: GYAE6OF01E5QYM.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttgccgggccactcagagtgttagcaggtggtggcctggtatcagcagaaaccgagggaacgcccctgaacctccgtgatctatgatgaccagtcgtagtttaggaaaaggtcgggtacccatacaagtacttcgaggcggacaggtggtaacgtcgtagggacagtacgttccactcctacaccatcgagcgacgcctagcaacgcctagtagttcgtagtttcaacctaacttattacgtcgacctaatagttaattaagttacgttacgtccggtaggtaccggttccggaccggaacgggtaccggtagggtacgaactaacgtaaccgaaacggtacgtggacgactcgacctaccgttacg

SEQ ID NO: 158502 - DNA, 667 bp, Homo sapiens
  misc_feature: GYAE6OF01CP6JY.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgaccagtctccttccacctgtctgcatctgtaggagacagagtcacatcgcttgccggccactcagagtgttagcgaggtggtggcctggtatcgagacaagaaaccgagggacgcccctagaacctccgtgactcgtatgatcgacagtacgtaaggtttaaggaaaacggttcgggtaccctaagtaccgaaagtacttacgaacggtcggtacgaaggtcggtattcgggtagggactaaggtagttccgacttccacgaaccgtataccgacgaccgtacgtccgtagaccgacggtcccgtagtacttacgttactttaccgaaccgttaactttagtttacgtaccgaacctaaacgtaagttaaacgttaagttacgtttaaccgttccgggtacggttaaccggttaccgggtaaccggaaacgggtacccgggtaggggtaacgaacgtaaccgtaaccggaaaaccgtacggttcggaacggtacctacggacctaccgttaccg

SEQ ID NO: 158503 - DNA, 530 bp, Homo sapiens
  misc_feature: GYAE6OF01DZINU.16.4.A04.1.454.CMB.1.raw
  modified_base (223)..(223): a, c, t, g, unknown or other
  misc_feature (223)..(223): n is a, c, g, or t
  modified_base (365)..(365): a, c, t, g, unknown or other
  misc_feature (365)..(365): n is a, c, g, or t
  modified_base (521)..(521): a, c, t, g, unknown or other
  misc_feature (521)..(521): n is a, c, g, or t
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttgccgggccactcagngtgttagcgaggtggttggcctgggtatccagcagaaaccgagggaacggcccctaggaactccgtgatctatgatgccagctagtttagaaaagttcggggtaccctataccgaagtattcgtagcggcaggtaggatcgngggacaggtagttcacgtctacaccatcagcagcctggacacgcctgatgtatttcgactactattatcgacactagtaattatagtatccgtagacgttcggaccgaagggcgagggtacgaatacgacgtaaacgacgttggtacggctacggntaccgtacg

SEQ ID NO: 158504 - DNA, 598 bp, Homo sapiens
  misc_feature: GYAE6OF01D00I8.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttgcccggccactcagagtgttagcgaggtggttggcctggtatcgagcaagaaaccgagggaacggcccctagaacctcctgatctatgatgccagctagttaggaaacgtcggggacccagtacaagtattcgaggcggactaggtggagtcgtgggacaggtacgttccacttcctaccaccataccgacgaccgacgtcccgtacgacctacggcccttagacttcgtacttttcgaacttaacttagtttactcgaacctaagtaagttaattaaagttagttacgtccggttacggtaccggttaccggaccggtaacgggaccggtaaggggtagaccgtaactaacgaaacgtacgttacggtacggactccggactacgtacg

SEQ ID NO: 158505 - DNA, 746 bp, Homo sapiens
  misc_feature: GYAE6OF01AUYI1.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttgccgggccactcagagtgttagcgtagggttggttggccgtggtatcgagacaagaaaccgaggggaacggcccctagaacctctgatctatgatcgaccagacgtagtttaggaaaacggtcgggtaccctaagtacaagtacttcgacggcggacgtaggtggacgttcggtagggaacgtaggtacgttacaccttactaccaaccgtactaccgacgaccgtaaccgcccgttcggacccgtaacgtcccgttaggtacgtttacgttaacgttttaccgaacctttaaaccctttaacgtttacgttaaccgtaaccctaaaacgttaacggttaaaactttaacgtttaacggtttaccggttacccgggttaccggggttaacccggttacccggggaaacccgggtaaacgggggtaaccccggtaagggggttaccggtaaacccgtaaaccggttaaccggtaaaaacccggttaccgttaaggggttaccggttaaccgtaccggtaccccgtaaccgttaacccgg

SEQ ID NO: 158506 - DNA, 648 bp, Homo sapiens
  misc_feature: GYAE6OF01D2BQO.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttgccgggccactcagagtgtagcaggtggttggcctggtatcagcaagaaaccgagggaacggcccctagaacctcctgatctatgatcgccagctaagtttaggaaaaggtcggggtacccagtacaagtacgttacgaggcggacgaggtaggagtcggtaggggactaggtacgttccacttctaccgaacctaacgttccacgtaccgaacgtccgtacggacacggtacctgtaacgttgttacgttttacgactttaacctttagtttaacgttacgaaccctaacgtaagttaacttaaagtttacgtttaacgtacccgggttacggtaccggttaccgggaacccggtaaacggggtaccggtaacgggggtagaaccgtaacgtaaccgaaaacgtaacgttacggtacggacgtacgaccgtacgtaccg

SEQ ID NO: 158507 - DNA, 839 bp, Homo sapiens
  misc_feature: GYAE6OF01DG4DH.16.4.A04.1.454.CMB.1.raw
tcagtgtactactccacgaccggtgctcgatttagagtagtgatcgagggggagtcagactcagtcaggacacagcatggacatgacgggtccccgctcagctccgtggggctcctgctgctctggctcccgaggtcgaccaaagtgtagacactccgagatcgacccagttcctccctccacctgtctagcatcgtaggtaggacgacgaggtacgtacaccgtagtcgtcgttcggcccgggaccacgtacgaggtagtacggttagccggtagggtcgggttggccgttaggtactacgacggacgaacggtaaaccggacgggaaccgtcccctaggaacctccgtagtacttacgtagtcgtacgacgtaaccgtagtacgtaaacgggtttaacgggtaaaacggtccggggtaacctaacgtaaccggtaaagttacgttacggacggccggtacggacggtaggtacgtacggtaggacgtagtaccgtacctacgtactaccgaacgtactacggagtacccgtcggttaccgacggtaccggaccgtaccgttagtaacgtttacgggtttaacctttacgttaaacccttaacggtttaacttaacgtacggaaaacccttaacggttaaacggttaactttaaacgggtttaacggtttaaccggttaccgggtttaaccgggtaccggggtttaaccgggaaaccggggtaaacggggttaaccgggtaaggggtttaacccgggaaaacgtttaccggaaaaaccgggtaacgttaaaccggttagggtaccgggaccgacccggttaaccgtaaccgttaccgg

SEQ ID NO: 158508 - DNA, 685 bp, Homo sapiens
  misc_feature: GYAE6OF01E5FTW.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatcgacccagtcctccttccaccctgtctgcatctgtagtagacagagtcaccatcgcttcggccggccactcgagagtgtacgcgaggtggtggccgtggtactcgagacaacggaaaccgagggaaccggcccctagacctccgtagactctagtgatcgccagtcgtaaggttaggaaacggttcgggtaccctagtactaacgtacttcgacggcggacgtaggtaggtacgtacggtaggggaactaggtaccgttaccaccttaccacccacctaacgtccgacgtccgacggtcccgtagccgtaaccgtccgttaggacgtttacggtttactttacgaaccctttaacgtttagttaacgttacgtaaaccctaagttaagtaaacgtttaaagttacgtttaacgtccgggttacggtacccgggttacgggacccggtaaaccggggacgggtacgggttaaccggaactaacccgtaacggaaaacggttcgtacgggtacgtacgacgtcccgaccgttacg

SEQ ID NO: 158509 - DNA, 539 bp, Homo sapiens
  misc_feature: GYAE6OF01BG6ZP.16.4.A04.1.454.CMB.1.raw
  modified_base (282)..(282): a, c, t, g, unknown or other
  misc_feature (282)..(282): n is a, c, g, or t
  modified_base (284)..(284): a, c, t, g, unknown or other
  misc_feature (284)..(284): n is a, c, g, or t
  modified_base (286)..(286): a, c, t, g, unknown or other
  misc_feature (286)..(286): n is a, c, g, or t
  modified_base (422)..(422): a, c, t, g, unknown or other
  misc_feature (422)..(422): n is a, c, g, or t
tcagtgtactactccacgaccggtgctcgatttagagtagtgatcagggggagtcagactcagtcaggacacagcatggacatgagggtcccccgctcagctcctggggctcctgctgctctggctcccaggtgccaaatgtgacatccagatgacccagtctccttccaccctgtctgcatctgtaggagacagagtcaccatcgcttcgccgggccactcagtagtgttagcgtaggtggttggcctggtatcagcaagaaccagggacgccctgactcngntntatgatgcagcgtagtttaggaaagtgggtacccagtacgaagattcgagcggcgaggtggactcgtgggacagtagtctactctacaccatacagcacgctgcacgcctgagtgttatttcgactaaccttattntacgacctaagtagttataagtttacgttactacgttacggtacgtacggtcggaacgggacgtacgggtagtacgacgtaacgaaacgtcgtagtcggtacctacggcctaacgtc

SEQ ID NO: 158510 - DNA, 744 bp, Homo sapiens
  misc_feature: GYAE6OF01EDYSO.16.4.A04.1.454.CMB.1.raw
  modified_base (513)..(513): a, c, t, g, unknown or other
  misc_feature (513)..(513): n is a, c, g, or t
tcagtgtactactccacgaccggtgctcgatttagagtagtgatcagggggagtcagactcagtcaggacacagcatggacatgagggtccccgctcagctcctggggctcctgctgctctggctcccaggtcgaccaaatgtagacatccagatcgaccctagtcctcccttcccacccgttgtctgctatcgtaggtaggagacgagtacgtccacgtagtccgtcgttcggcccggaccacgtcgagtagtagttacgacgtagggttcggtcggtaccgtaggtactacgagaccgaacgaaaccggacgggaccgtccctacggtacctacgtagtactacgttagtggacgtcgacggtagtacgttaaggtttaacgggaaacggttccggggtacctaacgtaacggtaaacgtacgttacgggaccggtcgggtacgtaacgggtaggttaccgtacgggtacggacgtagttaccgtctaccgtactaccgactagtaccganacgtacgcgtcgtacgacgttctagtacgtttagttacgttactaacttaacgttacgttaactacccgtaacttaaacgttacgttttaaagttacgtttaacgtttacggtttaccccgggtaaggttaccgggtaccggaaaccgggtaaaggggtacggtacgggtaacacggtaaacgtacggtaaaaccgtcgggtgttaacccgagtacgtacctacgttaccg

SEQ ID NO: 158511 - DNA, 630 bp, Homo sapiens
  misc_feature: GYAE6OF01C5UUP.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttgccggccactcagagtgtagcaggtggttggccgtggtatcgagcaagaaaccgagggaacggcccctagaactccgtgatctatgatcgcagtactaggtttagaaacggtcgggtacccagttaccgaagtacttacgaggccggtcgtaaggtcggaattcggtaggggacaaggtacgtttcaacgttcaccgacctataccagccaaggtccctagaccgacgtcctagattgttaacgttttcgaacttaacccgttatttaacgaccgtaacctaaacgtaaggttaacttaacgtttacgttaactccgggttacggtaacccggtttccgggaacccggtaacgggtaccggtaacgggtaggtacctaaacgtaaccgtaaagaccgtaggtacgtccgacgtcaaccgtac

SEQ ID NO: 158512 - DNA, 672 bp, Homo sapiens
  misc_feature: GYAE6OF01CE5O0.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtcctccttccaccctgtctgcatctgtaggagacagagtcaccatcgcttggccgggccactcagagtgttagcaggtggttggccgtggtatcgagacgaacgaaaccgaggggaacggcccctaggaacctcccgtagacttctagtagagtcgaccgagtacgtaaggtttacggaaaacggttcggggtaccctaagtacgaagtacgttacgacggcggacaaggtggtacgtacggtaggggaacaacggtacgtttaccaccttcctaccgtaaccattccgaagccgaacgtccctggaccgtacgtaccgttagtacgttaggttaacttttaccggaaccttaacgtttaattaacgttacgaaaccctaagtaacggttaaattaacgttaacgtttacggtaccggttacgggtaccgttaccgggaccggaacgggtacggtagggtacgaacgtagtaaccaaacggtacgtaggtacgtacgtcggacctaccgtacg

SEQ ID NO: 158513 - DNA, 558 bp, Homo sapiens
  misc_feature: GYAE6OF01DUVHG.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttgccgggccactcagagtgttagcaggtggttgcctggtatcagcagaaaccaggaagcccctgaactcctgatctatgatgccagctaagttgaaaagtgggtccatcaagattcagcggcagtggatcgtggacagagttcactctacaccatcagcagcctgacagcctagatggtattttcgactaaccttattagttacgacctaaacgtagtaattaacgttagtttacgtccggttagggaaccgtttcgggaccgtaaacggggtaccgtaaaggggttaggactaaagtaacccgtaaaacgtaacgttacgggttacggaccgttcggcctaaccgtaacg

SEQ ID NO: 158514 - DNA, 704 bp, Homo sapiens
  misc_feature: GYAE6OF01ETXW2.16.4.A04.1.454.CMB.1.raw
  modified_base (292)..(292): a, c, t, g, unknown or other
  misc_feature (292)..(292): n is a, c, g, or t
  modified_base (424)..(424): a, c, t, g, unknown or other
  misc_feature (424)..(424): n is a, c, g, or t
  modified_base (650)..(650): a, c, t, g, unknown or other
  misc_feature (650)..(650): n is a, c, g, or t
  modified_base (690)..(690): a, c, t, g, unknown or other
  misc_feature (690)..(690): n is a, c, g, or t
tcagtgtactactccacgaccggtgctcgatttagagtagtgatcagggggagtcagactcagtcaggacacagcatggacatgagggtcccccgctcagctcctggggctcctgctgctctggctcccaggtgccaaatgtgacatccagatcgacccagtcctccttccaccctgtctgcatctgtaggagacagagtcacatcgcttcgccgggccactcgagagttggtagcgtagggtggtggcctggatcgagacgagaaaccgaggaacgcccctaggaactccngtactctagtgatcgaccagtctaagttaggtaaaacggtcggggtaccctaagtacgaaagtactacgacggtacggacgtaggtacggagttacgtacggggacgtaaggttacgttacctaaacccgtntaacccgaacgtacgtacgaacggtacccaacgtccgacgtacctaacgtccccgttaggtaactttagggttaacttttacggaaccctttaaaacctttaaggtttaacttaaccggaaaccccgttaaaagttaagttaaacttttaaaagtaacgtttacccgttacggtaacgggtaccggttacccgggtaacccgaaacggggtaccgtaacggggtanaccgtaaacttaacgaaacgtaacgttggacgtaccgtanacccacgtttaacg

SEQ ID NO: 158515 - DNA, 727 bp, Homo sapiens
  misc_feature: GYAE6OF01ACSHO.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctggctcccgaggtcgaccaaatgtgacatccagatcgacccagtcctcccttccaccctgtctgcatctggtaggagacagacgtccaccagtccgtcgttcggcccgggaccaccgtacgaggtagttggtacgcggtagggttcgggttcggtccgtggtactcgagacgaacggaaaccggaacggggaaccggccccgtacgacccttccgtagtactcgtagtcgacgtcggaccagtagtaaggttaaggtaacggtcgggtacccagtacgtaagtactcgaggccggacgtaggtaggacgttcggtaggacgtacggtacgttacctactacctaccaaccgtactacgacgccgaccgtcgtacgacctcggtaccgttagttacgttacgttacgtttaccgaacctttaacctttagtttacgtaccgaaaccttaagttaacggtttaaattaacggtttacgtttaccggtaccgggttaccggttacccgggtaccgggaaacccgggaacgggtacccgggtaacgggtacgaaactacggaaaccgttaaaccggcggttacggtacggtacgtaccaccgtcgttaccg

SEQ ID NO: 158516 - DNA, 607 bp, Homo sapiens
  misc_feature: GYAE6OF01D6WXG.16.4.A04.1.454.CMB.1.raw
  modified_base (353)..(353): a, c, t, g, unknown or other
  misc_feature (353)..(353): n is a, c, g, or t
  modified_base (364)..(364): a, c, t, g, unknown or other
  misc_feature (364)..(364): n is a, c, g, or t
  modified_base (368)..(368): a, c, t, g, unknown or other
  misc_feature (368)..(368): n is a, c, g, or t
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttcgcccgggccactcgagagtgttagcgtagggtggttggcctggtatcagacaaggaaaccgagggacgcccctagacctcctgactctatgatgacagtacgtaaggttagaaacggtcgggacctagtacaagtatcgagcgngagtggatcgngganagtacgttcactcacacactacacgacacgtcctcgacctacgtctggtattacggttactttacgaccttaacttactttaacgtaccgtaacctaaacgtaagttaacttaaacgttacgttaacggtccggttacgggtaccgggttaccggaccgggtaaacgggaccggtaagggtacgaaactaacggtaaccgaaacggtaacgtcggtacggtactcgacctcgttaaccg

SEQ ID NO: 158517 - DNA, 544 bp, Homo sapiens
  misc_feature: GYAE6OF01DWFL0.16.4.A04.1.454.CMB.1.raw
  modified_base (496)..(496): a, c, t, g, unknown or other
  misc_feature (496)..(496): n is a, c, g, or t
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttgccggccactcagagtgtagcgaggtggttggctggtatcagcagaaaccagggaacggcccctgaactcctgactctatgatgcagctagttgaaagtgggtccatacaagattcagcgcagtggatcgagggacgagtagttcactctacaccatcagcacggctacgcgacgcctgtatgttattttcgactaaccttatttattacgaccaacgtaacgttaattaaagttacgttaagtccgttaggtaccgtttcgggaccgtaagggtaccgtaggggtanaacggactaacgaaacgaacgttcgtacgggactcggactaccgtacg

SEQ ID NO: 158518 - DNA, 714 bp, Homo sapiens
  misc_feature: GYAE6OF01EJ3UV.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctggcctccaggtgccaaatgtgacatccagatcgacccagtcctcccttccaccctgtctgctatcgtgtaggagacgagacgtcacctatccgcttcggcccgggaccacgtcgagtaggttgttacgcgtagggttggttcggtccgtggttactcgagaccgaaacggaaaccgaaggggaaccgtccccgtagaacctccgtagacttacgtagtcgtactcgaccgtagtacgttaaggtttaacggaaacggttccgggtaaccaagtacgaaaggtacgttaccgacgggcgacgtagggtacggtacgtcgggtagggaacctaggtacgttccaccgttcctaccgaacctacgacgtacgacgccgtaccgtacgccgtacgtccgtaggttacgttacgtttactttaccgaacctttaacgtttattacgtacccgtaacaaagtttaacgttaattaagttacggtttacccgtacgggttacggtaaccgggttaccgggaacggtaaaccgggtaccggtagggtaaccgacgtaaccgtacgtaaacgtacggtcggaacgtcgtacgacctcgtacg

SEQ ID NO: 158519 - DNA, 774 bp, Homo sapiens
  misc_feature: GYAE6OF01EBN9L.16.4.A04.1.454.CMB.1.raw
  modified_base (439)..(439): a, c, t, g, unknown or other
  misc_feature (439)..(439): n is a, c, g, or t
tcagtgtactactccacgaccggtgctcgatttagagtagtgatcagggggagtcagactcagtcaggacacagcatggacatgagggtccccgctcagctccgtggggctcctgctgctctggcctcccaggtgccaaatgtgacatccagatcgaccctagtcctcccttccaccctgtcctgctatctaggtaggacgacagacgtccacctagtccgtcgttcgggcccgggacctactacgaggtaggttaggttaggcggtaggggttggttcgggtccgttgggtatcgacggacaaacggaaaccggagggaaccggccccgtagtaccgtccgtagacttctaagtcgtacgcgtaccgacggtacgttaaggttaacgggtaaacgggtccgggtacctaagtacgtaaagtcgttacgaggtaccggngtacggttggtactcggtacgggaacgtagtacgttacctacccgttctaccgacctacgtacgtacgccgtacgtcccgtaacgcgtaccgcgtagttacgttaggtttcttaaccgacgttaacctttattaccgttaccgaaccgttaaacgttaagtttaagttaaaacgtttcggttaacccggttacgggttaacccgggttaaggggtaccccgggtaacgggtaaacggggaacccgggttaaggggtaccggaaacgttaacccaaagggttaaaccggttaaccgcgggtttaccggaccgtttaccggaaacctccgttaaacg

SEQ ID NO: 158520 - DNA, 651 bp, Homo sapiens
  misc_feature: GYAE6OF01B7BW9.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttgccgggccactcagagtgttagcaggtggttggcctggtatcagcagaaaccagggacgcccctgaactcctgatctatgatcgaccagacgtaggtttagaaaacggttcggggtacccataccgaaagtacttcgaaggtccggagtacggtgggaactcggtaggggaaccgtaggtacggtttcccaaccttctaccgaaccctagtccgaagcccgtaacgtccccgttaggacctacggacccgttgaacttaggttaacgtttttcggaaccttaaacccgtttaatttaacgttaccgtaaccgtaaacttaaggttaacttaagttacgtttacgtaccgtagggtacccgttacggacccggtaaagggaccgtagggtaggaaccgacgtaacgaaaaccgtacgtacggtacggacgtcgaccgtctaacg

SEQ ID NO: 158521 - DNA, 683 bp, Homo sapiens
  misc_feature: GYAE6OF01EBWIA.16.4.A04.1.454.CMB.1.raw
  modified_base (222)..(222): a, c, t, g, unknown or other
  misc_feature (222)..(222): n is a, c, g, or t
  modified_base (336)..(336): a, c, t, g, unknown or other
  misc_feature (336)..(336): n is a, c, g, or t
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatccgcttgccggcactcagngtgttagcgaggtggtggctggtatcagcaagaaaccgagggacggcccctgaactcctgatcgtatgatgccagctagttagaaagtcgggtccatacgaagatcgaggcggngtagtggatcgtacgggacaggtacgttcacgttcctaccaacctagtaccgacgaccgtaacgtccgtacggtaccgacggtcccgtaggtacttcggttacgttttacggtaacccttaaaccgtttatttacgttaaccggtaccctaaacgttagtttaaattaaacgtttacggtttaaccgttacccgggtttacgggtaaccggttacccggggtaaacccggtaaaccgggggtaaacccgggtacgggggttaacggaaaccgtaacggttaaacccgaaaaacggttaaaccggttcgggttacgggtaccgttaccggaccgtaaccggttaaccg

SEQ ID NO: 158522 - DNA, 754 bp, Homo sapiens
  misc_feature: GYAE6OF01EUHTA.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatcgacccagtcctcccttccaccctgtctgcatcgtgtaggagacagacgtccaccatccgtcgttcggccccgggccaacgtcgagtaggtgttagcgtagggttggttcggccgttggtactcgagacgaacgaaaccgaggggaaccgcccctaggaacctcgtagtatactagtgtactcgaccgagtacgtaaggtttaacggaaaaggtcggggtaccaacgtacgaaagtacgttacgaggcggacgtaggtacggtacgtcggtacgggaacgtacggtacgttactacctccgtaccaacctacgtacgacgtacaccggtcctacgacgaccgtacgtagtacgttacgtttacgtttaaccgtaccttaactttacgttaacgttaccgaaaccttaaacgttaagttaaacgtttaacgtttacggtttaacggtacccggttaacgggttaacccgggttaacccgggaacccgggtaaacggggtaccgggtaaacgggggttaccggtaaacgttaacggtaaacccggtaaacggtaaccggttacggggtacggtaaccgtacccggtaaccgtacccgttaacgg

SEQ ID NO: 158523 - DNA, 725 bp, Homo sapiens
  misc_feature: GYAE6OF01BUFPC.16.4.A04.1.454.CMB.1.raw
  modified_base (221)..(221): a, c, t, g, unknown or other
  misc_feature (221)..(221): n is a, c, g, or t
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgctgccggccactcagngtgtagcgaggtggttcggcctggtatcgagacgaagaaaccgaggggaacggcccctagaacctcctgtactacgtatagactcgccagctaaggttagaaaacggtcggggtaccacgtacaagtacttacgacggcggacgtacggtggaacgttcgtacggggaacgtaacggtacgtttaccctaccgttaccttaccgaaccctacgtaccgaacgtcgaacccgtccgttacggaccgtacgtaccccgttaggttaacgtacggtttacgttttacgaccctttaaaccgtttaacgttttaacgttaaccgtaaccctaaaccgtaatttaaaagtttaaacgtttacgtttaaccggttaccgggttacgggttacccggttaaccgggaacccggtaaaccggggtaacccggtaacggggtaaccgggaacggttaacctaaacgtaaacggtaaaccgttcgggtacggtaccgtcgtaaccgcttaacgg

SEQ ID NO: 158524 - DNA, 726 bp, Homo sapiens
  misc_feature: GYAE6OF01CT21X.16.4.A04.1.454.CMB.1.raw
  modified_base (445)..(445): a, c, t, g, unknown or other
  misc_feature (445)..(445): n is a, c, g, or t
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatcgacccagtctccttccaccctgtctgcatcgtgtaggagacagacgtcacactcgcttcggccgggaccactcgagtagtgttagcgaggttcggttggccgtaggtatcagacgaacgaaaccgagggaaccggcccctagaaccgttcctagactctagtgaactcgaccagtacttaaggtttaaggaaacggtccgggtacccaagtaccaaggtacttcggaggcggacgtaggtcggacgttacggcgggaacgtacggtacgtttaccacttcgtaccaccgtanaccgtacgaccgtaacgtcccgtacgaccgacggtccgttagtaacgtttacgttacttttaccggaacctttaaccgttttaagttaacgtttaccgaacccttaaaacgttaagtttaaacttaaggttttaacccggtttaacggttccgggttaccgggttaacccggggtttaccgggaacccgggttaaaggggacccgtaagggggtaacaaacgttaaccggtaaacgtaaaaccggttcgttacgggacgtccgtacgacccgtacgttacg

SEQ ID NO: 158525 - DNA, 773 bp, Homo sapiens
  misc_feature: GYAE6OF01D4MGC.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccacctgtctgcatctgtaggagacagagtcaccatccgcttcgccgggccactcagagtgttagcgtaggtggttggcctggtatcgagacaaggaaaccgacgggaacgcccctagacctctagtactctagtgatcgcctagcgtaagtttaggaaaaggtcgggtacccagtacgaagtacgttacgacggcggtacgtaggttacggtaacgttcggtacggggtaacgtaggttaacggtttccaacccgttcctacccaacccgtacgtaccgtacggtcccgtaacggtcccgtacggaccgtaccggttacccgttaggtacgtttaggtttaaccgtttttaccgtaaaccgttaaacccgttttaagttttaacgttacccggtaaaccttaaacgttaagtttaaacgtttaaagtttacgtttaaccgttaccgggttacgggttaacccggtttaccggggtaacccggaaacgggggtaaacccgggttaaggggggttacccggaaacccggtaaaccgtttaaaaccccgggaaaacgttacccgggttacggtaccgggttacctacccggtacccgtaacccgttacg

SEQ ID NO: 158526 - DNA, 612 bp, Homo sapiens
  misc_feature: GYAE6OF01E0IPQ.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcacatcgcttgccgggccactcagtagtgttagcgtaggtggtcggctggtatcagcagaaccgagggacgcctagacctctgatctatgatgccagctagttagaaaggtcgggtaccatgtaagtattcgaggcggacaggtcggtatcggtagggacgtaaggtacgttcgacttccgtacacctataccgacgcacgtcctgacacgtcctgacttgtacttttcgacgtaacctttattaacgtcgtaacctaagtattaacgtttaagttaacgtttactacccgggttagggttaacccggttccgggtaacccggaacgggtaccgggtaaacggggttacgggaacctaaacggttaacccgaaacggttaaacctcgggtacggtacctacggacctacgttacg

SEQ ID NO: 158527 - DNA, 784 bp, Homo sapiens
  misc_feature: GYAE6OF01ESX61.16.4.A04.1.454.CMB.1.raw
tcagtgtactactccacgaccggtgctcgatttagagtagtgatcagggggagtcagactcagtcaggacacagcatggacatggagggtccccgctcagctcctggggctcctgctgctctggctcccaggtgccaaatgtgacatccagatgacccagtctccttccaccctgtctgcatctggtaggagacagacgtcacctatccgtcttcggcccgggccactcgagtagttgttaacgcgtagggttggttacggccgttaggtactcgagacaacggaaaccgaggggaaccggcccctaggtaacctcccgtagtacttacgtagtgacgtcgccgtagtacgtaaggtttaggaaaacgggttcgggtacccctaagtacgtaaagtacgttacgaacggtacggacgtaagggtacggtaacgtacgggtacgggaaccgtaaggtacgtttacccgtaaccttcctaccctaaccctagtacccgacgtaccgtacgtacccgtagccgtaacgtccgttaggtacgtttacgttagttttacccgaactttaaaccctttgttaacgttccgaaaccgtaagttaacgtttaaagttaacgttttaacggttaccggttaccgggttaacgggttaaccgggtttacccgggaaaccgggtaacccggggtaaccggtaacggggggtaaccgtaaaccgttaaccggtaaccggtaaaaacccggttacgttcgggtacggtacccgttaacggaccctacgtttaaccgg

SEQ ID NO: 158528 - DNA, 759 bp, Homo sapiens
  misc_feature: GYAE6OF01D8LQX.16.4.A04.1.454.CMB.1.raw
  modified_base (268)..(268): a, c, t, g, unknown or other
  misc_feature (268)..(268): n is a, c, g, or t
  modified_base (380)..(380): a, c, t, g, unknown or other
  misc_feature (380)..(380): n is a, c, g, or t
  modified_base (743)..(743): a, c, t, g, unknown or other
  misc_feature (743)..(743): n is a, c, g, or t
tcagtgtactactccacgaccggtgctcgatttagagtagtgatcgagggggagtcagactcagtcaggacacagcatggacatggacgggtcccccgctcagcctccgtggggctcctgctgctctggcctccgaggtcacctaaatgtacgaacactccgaagataccgaccctagttccttcccgttaccctacccgttgttccgtcgctactcgtaggtaggaacaccgagacgtcaacctacgtcgtcgtcggacccggaccncgtagagtgttagttacgcgtagggttggtcgtctaggtactacgagaccgaaacggtaaccggaacgggacccgtccctaagtaaccctcgagtaccttagtacgtgtacnctacgacgtagtaaggttagtaaccggtcggaacctgtaacgtaacgtacgtacggacggttacggagtaacggtcggaagttacgggtaaacgtcgtaaacggttaccgttaacctacctaccgttaacccgtaactaacggttacggaaccctccgaaccggtcgaacgttcgaaccgtccgttagttacggtacgtttactttacgaaccctttaatagttaaccgtacgaacttaacgttaattaaacgttattaacgcggttaccgggagtttaacccgggaagttaacccgggaacggggtacgaacgggtacgttaacgaaaccgttacggaaaccgtaggttccggacgtaaccnctaaggttacctacgg

SEQ ID NO: 158529 - DNA, 763 bp, Homo sapiens
  misc_feature: GYAE6OF01AL96C.16.4.A04.1.454.CMB.1.raw
  modified_base (151)..(151): a, c, t, g, unknown or other
  misc_feature (151)..(151): n is a, c, g, or t
  modified_base (502)..(502): a, c, t, g, unknown or other
  misc_feature (502)..(502): n is a, c, g, or t
tcagtgtactactccacgaccggtgctcgatttagagtagtgatcagggggaggtcagactcagtcaggacacagcatggacatggacgggtccccgctcagctccctggggctcctgctgctctggcctcccaggtgaccaaatgtgacntccagatcgacccagtcctcccttccaccctgtctcgcagtctaggtacggacgacagtacgtaccaccgtagtccgtccgttcgggccccgggacctaccgtacgaggtacggttaggttacggacggtaggggttgggttcggacccgttagggttactccggaacgaccgaacggtaaacccggacgggacccggtcccctacgaacccgttcctaggtacttcagtcgactcgaccgagtacgtagttaaggaacggttcgggtacccagtactaagtacgtcgaggcggagtaggtgagtcggtaggactacggtacgttccaccgtctacctaccgataccgacnccgtacgccgtacgacctacggtaccgttagtatttacgtttactttaccgaacctttaacgttaacctttacgttaccggaaccttaaacgttaacgttaaaggtttacttaacgtttacccggtaccgggttccggtaaccgggttaccgggaaccgggtaccgggtaaacgggtacgggttaggaaaccctaccggttaaaccgtaaacccggttacgggtcggttaaccggtaccgtaccggtacctccggtttacc

SEQ ID NO: 158530 - DNA, 748 bp, Homo sapiens
  misc_feature: GYAE6OF01CEK6I.16.4.A04.1.454.CMB.1.raw
  modified_base (144)..(144): a, c, t, g, unknown or other
  misc_feature (144)..(144): n is a, c, g, or t
  modified_base (192)..(192): a, c, t, g, unknown or other
  misc_feature (192)..(192): n is a, c, g, or t
  modified_base (240)..(240): a, c, t, g, unknown or other
  misc_feature (240)..(240): n is a, c, g, or t
tcagtgtactactccacgaccggtgctcgatttagagtagtgatcagggggagtcagactcagtcaggacacagcatggacatgagggtccccgctcagctccgtggggctcctgctgctctggctccaggtgccaatgtgacntccagatcgaccctagtcctccctccacctgtctgcatctggtagganacagacgtccaccagtcgcgttacggcccggcacgtcgagtgtgttancggtagggttggtcgcgtggtactcgagacaagtaaccggagggtaaccgccctagtacctcgtagacgtcttagacgtagtcgactacgtacgttaaggtttaaccggaaaggtccgggttaaccagttaaccgtagtaacgttcgaacggcggtaacgtagggtacggtaacgttcgggaacggtaccggtaagttaccggtttaaccacgttaacccaccgttaacgtactacccgaacgaccgtaaccgtccgtaccggaacgtacgtacccgttaaggttaccgttagtttaaccgttctaaccgttaaactttgttaccggtttaaccgaaacccttaaggttaaataatttaacccggttaggtttaaccggttaccggtaacgggttaacggttaccccggaaacggggtaaacgggtccccggtaagggggttaaccaacggtaacgttaaaccgggtaaacgtacggttggacttaccggtaccgcctaacggttacc

SEQ ID NO: 158531 - DNA, 625 bp, Homo sapiens
  misc_feature: GYAE6OF01C8NPG.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtcctccttccacctgtctgcatctgtaggagacagacgtcaccatcgcttcggcccgggccactcaggagttgttagcgagggttggttcggccgtggtatcgagtacgaaggaaaccgagggaacgcccctagaacctcctgatctatgatcgacagtactaggtttacgaaacggtcgggtacccatacgaagtacttacgaggcggtacgaggtggacgtacgtggggaactaggtacgtttacacgttctacctaccattcaacggccacgtccgtagcacgtccgtagtacttgtactttacgaaccttaacgttattacgttacgaacctaagtaagttaattaagttaacgtttacgtcggtacggtacggttacggaccggtaacgggtaccgtaggggtacaacgtaacgtaaccgtaaaaccgtacgttcggtaacggcgttacgaccgtcgtacg

SEQ ID NO: 158532 - DNA, 688 bp, Homo sapiens
  misc_feature: GYAE6OF01ADA8Y.16.4.A04.1.454.CMB.1.raw
  modified_base (191)..(191): a, c, t, g, unknown or other
  misc_feature (191)..(191): n is a, c, g, or t
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatcgacccagtctccttccaccctgtctgcatctgtagganacagagtcacagtccgcttcggccggccactcgagtagtgttagccgtagggttcggttacggcctaggtactacgacgtacgaaggaaacccggtagggaaccggtcccccgtagtaaccgttccgtaggtactactacgtaggtacgtacgaccgtacggtacgttagggtttaacgggaaaacggttcggggtaccctagtaactaacggtaagtaccgttacggacggtacggtaacggtaggtacgtaggtaccggtacggtaacgttacgttaaccgtaccgtacctccgtacctacgtacgtacgtacgaccgtacgtccgtacgtaccgtcgtacgtagttacgtacttacgttaactactaaccgtttactaacgtaactaactacgttaatacgttaacgttcgtacgtacggtacgtccggtaacggtaccggacggtacggtacgtacgacaacgtaccgagtccgtacggtagactcgactacg

SEQ ID NO: 158533 - DNA, 836 bp, Homo sapiens
  misc_feature: GYAE6OF01EWII2.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatcgacccagtcctccttccaccctgtctgctatctggtaggagacagacgtccacctatcgcttcggcccggccactcagagttgttagcgtaggtggttcggcctggtatcagcaagaaaccgaggggaacgcccctagaacctcctaggactctagtgatcgacccgagtcgtaagggtttacggaaaacggttcggggtacccctaagtaccgtaaaggtactttacgagggtccggtacgaagggttacgggtacttaccgggtagggggaaacctaacgggtacgtttaccctaaccgttcccgtaccctaacccgtacgttaccggaagtaccgaacccggtacccgttagggacccgtaacggtcccctttaagggtaacgtttacggtttaacggtttttacccgaaccgttttaaaacccgtttagtttaaccgtttaaccggaacccttaaaacccggttaaggtttaaacgttttaaaacggtttaacggttttaaccccgggtttaaccgggttaccggggtttaacccggggtttaaccggggtaacccggttaaaacccggggggtaccggtaaacgggggttaacccggtaaacggtaaacccgttaaacccgggaaaaccggttacggttacgggtacggtaaccgttcggaaccgtaacccgttacgg

SEQ ID NO: 158534 - DNA, 633 bp, Homo sapiens
  misc_feature: GYAE6OF01CL5VU.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctggctcccaggtgaccaaatgtgacatccagatgacccagtcctcccttccaccctgtctgcatctgtaggagacagagtccaccatcgtcgttcgcccggccactcgagtagtgtagcgaggtggtcgctgtatcagacaacgaacgagggaacgcccctagaactccgtagatctagtgatcgcagtacgtaaggttaggaaacggtcgggtacccaagtacaagtacgttacgacggcggtacgaggtcgtaagtccggtaggaacgtagtacgttacctaaccgttcctaacccgacctagttaccgacgacacgtaccgcgaccgcgtcctagtacgttgttactttacgacttaacgtttattacgtactaacctaagtaacgttaattaacgttacggttaaccgtcgggttacggtaccggttaccggaccgaagggtaccgtaacgggtaactacgacgttaaccgtaaacgtccggtagtaccgtagtccaccgtaccgttac

SEQ ID NO: 158535 - DNA, 823 bp, Homo sapiens
  misc_feature: GYAE6OF01E55SR.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctggctcccgaggtgccaaatgtgacatccagatcgacccagtcctccttccaccctgtctgctatctggtaggagacagagtccaccatcgcttcggcccgggccactcgaggtagttgttagcgtagggttggttcggccgttaggtactcgacggaccgaaacggaaaaccggacggggaaccggtcccccgtaggtaacccttccgtaggtacttacgtaagtacggtacgtacggacccgtaacggtacggttaaacggtttaaagggaaacgggttccggggtaccctaagtaaccgtaaagtcgttaccgagggtccggtagtaacgggtcggtaacgttcgggtacggggaacgtaacggttacgttaccgtaaccttcccgtaaccgaaccctagtaccgacgaccgtaccgtccgttacggaccgtacggtaccctaggtacgtttacggtttaccgttttaccgaaaccctttaacctttagtttaaccgttcccgaaaccttaaacggttaacgtttaaacgtttaaacggtttaaccgttaaccgggttaccgggttaaccgggttacccgggttaaccgggaaacccgggtaaaccggggtaccggtacggggtaaccgaacgtaaccggtaaaccgaaacggttaccggtacgggtaccggtaccgtcgtaacccgtaccgtttaccgg

SEQ ID NO: 158536 - DNA, 569 bp, Homo sapiens
  misc_feature: GYAE6OF01BM20F.16.4.A04.1.454.CMB.1.raw
  modified_base (190)..(190): a, c, t, g, unknown or other
  misc_feature (190)..(190): n is a, c, g, or t
  modified_base (335)..(335): a, c, t, g, unknown or other
  misc_feature (335)..(335): n is a, c, g, or t
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtagganacagagtcaccatcgcttgccgggccacgtcagagtgttagctaggtggttggccttggtatcagcaagaaaccgagggaacggcccctagaacctcctggctctatgatgccagctagtttaggaaagtgggtaccagtcaagnttcgagcggcaggtggatcgtagggactagtagttcactcacaccatcacgcacgccgtacgcacgtcctagtagtgttacttttcgaccttaacttagttacgttcgaacctaagtacgttaattaagttacgtttacgtcggtaggtaccggttacggaccgtaacggggacgtacgggtacggtaactacgtaccgaaagtaccgttaggtacgactcggtacaccgtacg

SEQ ID NO: 158537 - DNA, 701 bp, Homo sapiens
  misc_feature: GYAE6OF01BAT95.16.4.A04.1.454.CMB.1.raw
  modified_base (194)..(194): a, c, t, g, unknown or other
  misc_feature (194)..(194): n is a, c, g, or t
tcagtgtactactccacgaccggtgctcgatttagagtagtgatcagggggagtcagactcagtcaggacacagcatggacatgagggtccccgctcagctcctggggctcctgctgctctggcctcccaggtgaccaaatgtgacatccagatcgacccagtcctccttccaccctgtctgcatctgtagganacagacgtcaccatcgcgttcggccggtccactcgagagttgttacgcgtagggttggttggccgtaggtactcgagacaacgaaaaccgagggaaccgcccctaggaacctcgtgactcgtagtgtatcgaccgagacgtaaggtttaacggaaacggttccgggtaccctaagtaccgtaaagtacttacgaacggcggtacgtaagggttacggtaacgtcggttaacgggaacgtaaggttaacgttacctaccgtacctaacccaactactcgaacgtccgaacgtccgtagactacgtccgtagtaacttagttaacgtttacgaaccttaacctttagttaacgtacgaacccttaaagtaacgttaagttaaacgttacgtttaccgtacgggtacgggtacggttaaccggaccggtaaacggggtacgtaacgggtacgaaacgtaacgtaaaccggtaaacgttagtcggtacgacctacggtactaaccggttac

SEQ ID NO: 158538 - DNA, 763 bp, Homo sapiens
  misc_feature: GYAE6OF01A6JFN.16.4.A04.1.454.CMB.1.raw
  modified_base (524)..(524): a, c, t, g, unknown or other
  misc_feature (524)..(524): n is a, c, g, or t
tcagtgtactactccacgaccggtgctcgatttagagtagtgatcagggggagtcagactcagtcaggacacagcatggacatgagggtccccgctcagctcctggggctcctgctgctctggcctcccaggtgccaaatgtgacatccagatcgacccagtcctcctccaccctgtctgcatctgtaggagacagacgtcacatccgcgttcggcccggccacgtcgagaggttgttacgcgagggttggttcggcccgttggtactcgagaccgaagaaaccgaggggaacggtcccccgtagtaacccgtcctacggtactacgttatacggaacgtcgacccgtagtaccgttaaggtttaaacgggtaaaacggttccgggggtaccctaagtaaccgtaaacggtaacttaccgacggtaccgggagtacgggtacggtacggtacggtacgggaacgtaaggttaccgttactacccgtactacccaacctaacgttcgaacgtaccacgtacccgngaccgtacgtcccgtaaggtacttaggtttacgtttacgaccgtttaacccgttaagtttacgttacgtaaccctaaacgtttaacgttaaagttaaacgtttaacggtttacgtaccggttaaccgggttaccgttaccgggaaaccgtaaccggggtaccgtaggggtaccgaacgtaccgtaaaccgtaaaccggtacgtacggtacgggtacgtaccgtacccgtacgttacccg

SEQ ID NO: 158539 - DNA, 757 bp, Homo sapiens
  misc_feature: GYAE6OF01BDOFB.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctcccttccaccctgtctgcatctgtaggagacagagtccaccatcgtcttcgccgggccactcagagtgtagcgaggtggttggcctggtatcagcaagaaccgagggaacgcccatcgaactcctgatctagtgatcgaccagtcgtaaggtttaggaaaacggttcggggtaccctagtacgaagtacttacgacggccgggacgtagggtggacgttacgggtacggggtaacgtaaggtacgtttaccgtaaccgttcctacccgtaaccctacgttaccgaccggtacccgtacggtccccttaggaccccgtaacggtccccgttaggtaacgtttacggtttaacgtttttaccggaaccctttaaacccgttttaagttttaaccgttaccgtaacccctaaaacgttaacgtttaaagtttaaacgtttaacggtttaacccgttaccgggttaccgggttaacccggtttacccggggaacccgggttaaaacgggggtacccggtaagggggttaccggaaaccgtaacgttaaacccggaaaaccggttacgttacgggtaggtaccgtcggtaaccctacccg

SEQ ID NO: 158540 - DNA, 825 bp, Homo sapiens
  misc_feature: GYAE6OF01CTFZJ.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctggctcccaggtgaccaaatgtgacatccagatcgacccagtcctcccttccaccctgtctgccatcgtagtaggagacagacgtcaccatccgcgttcgccgggaccactcgagtacgtagttacgcgtagggttggttcggtcgttcggtatacgagtacgaacgaaaccgaacggggaaccggtccccgtacgtaaccgttccgtacgtaacgttctaacgttcggacttcggaccaggtaccgttaaggtttaacgggtaaaaacgggttccggggtaccctaagtacgtaaagtacgtttacgacggtcggtacgtagggtacggaacgttcggtacgggaagtaaggtacgtttaccaacgtttccctacgtaaccctacgtaccctaaggtcccgaacggttcccgtgtaacccggtacgtacccgttaaggtacgtttaagttacgtttttaccgaaccctttaaacctttaagtttactttaaccggtaacctaaaacgttaaggtttaaacgttaaaacgtttaacgttttaacccgggttaccggttaccggggttaaacccggtttaccgggtaaaacccgggtaacggggtaacccgggtaggggttaaaccggtaaacttaaaccggttaaccgtaaaaccggttaacgttcgggttacggaccgttacggaacccgttacccgttaaccg

SEQ ID NO: 158541 - DNA, 568 bp, Homo sapiens
  misc_feature: GYAE6OF01C6D4Z.16.4.A04.1.454.CMB.1.raw
  modified_base (381)..(381): a, c, t, g, unknown or other
  misc_feature (381)..(381): n is a, c, g, or t
  modified_base (389)..(389): a, c, t, g, unknown or other
  misc_feature (389)..(389): n is a, c, g, or t
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccacctgtctgcatctgtaggagacagagtcaccatcgcttgccgggccactcagagtgttagcaggtggttggcctggtatcagcaagaaccagggaaggcccctgaactcctagatctatgatgcagactagtttagaaacgtcggggtacccagtacaagattcgagcgacagttggatcgtgggacagagttcactctacacatcagacanccgtgacncgacctgagttgtattttacgacctaaccttatttacgttacgacctaaactagttaattaaagttacgtttaacgtccggttagggtaccgttaccggaccggtaagggaccgtaacggggttagaaccgttagaaccgtaaaacgaaccggttgtaggtacctcggacctacttacg

SEQ ID NO: 158542 - DNA, 658 bp, Homo sapiens
  misc_feature: GYAE6OF01EP7DK.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcacatcgcttgcccggccactcagagtgttagcgaggtggtggcctggtatcagcaagaaaccgagggaacggcccctagaacctcctagatctatgatcgccagtctagtttacgaaaaggtcggggtaccatacgaagtacttacgagcggactaggtggacttcggtagggaacaggtacgtttaccacttctacccaaccgtactaccgagaccgacgtcctacgaccgtaccgtcgtagtacgttagtttactttaccgaacttaaccgtttagtttacgttaccgaaccttaagtaacgtttaaattaacggtttaacgtttaacgttacccgggttaccgggtaaccggttaccgggaaccgggtaaccgggtacggtaacggggtaacgggtaactaacgggtaaaccgtaaacgtaacggttcggtacgtaccgtacgacccgtacttaccg

SEQ ID NO: 158543 - DNA, 627 bp, Homo sapiens
  misc_feature: GYAE6OF01CRZZ4.16.4.A04.1.454.CMB.1.raw
  modified_base (253)..(253): a, c, t, g, unknown or other
  misc_feature (253)..(253): n is a, c, g, or t
tcagtgtactactccacgaccggtgctcgatttagagtagtgatcagggggagtcagactcagtcaggacacagcatggacatgagggtccccgctcagctcgtgggctcctgctgctctggctcccaggtcgaccaaatgtagacataccagatcgaccagttcctcccttccacctgtctgcagtcgtaggtaggagacgagacgtacaccgactcggtcgttcggccggccactcgagtagtgtacgcgnggttggtcgcgtggtactcgagaccaaggaaccggaggaccgccgtacgaacgtcgtagacttctagtcgacgtcgcgaacgtgtaacggttacggaacggttcggtaccagtacgagtcgtcgacgcggagtaggtacgcgttacggaggtacagtcgttactcgtacctacgactcgaacgcgaccgtgtcccgtagacgtccgtacgtgttagtttcgtatttaccgaactttacgttcttacgtaaccgaactagttaacgtagttaagtcgttactcgggtactacggtaccgggaacgacgggtacgtacgggacaatttaccgaaaccgaacggttacgtcggacgttagacccgaattccgttacg

SEQ ID NO: 158544 - DNA, 665 bp, Homo sapiens
  misc_feature: GYAE6OF01BEA59.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttgccgggccactcagagtgttagcgaggtggttggcctggtatcagcaaggaaaccgagggaacggcccctagaacctcctgactctatgatgccagctagtttaggaaaacggtcggggtacccagtacaagtattcgaggtcggacgaggttggagttcgtaggggactaggtacgttcacgttccaccaaccgactccgacgcaacgccgttgaccgacgccttaggactttgtaacgtttttcgaacccttaaaccctttatttaacgttcgaaccctaaacgtaacgtttaattaaacgtttaacggtttacgtacccgggttacgggttaaccggtttccgggaaacccggtaagggggtaacccggtacgggggttacggaaccgtaacgttaacccggaaaaccggttaccggttagggtacgggaccctacggtaccgtacccgtaacg

SEQ ID NO: 158545 - DNA, 784 bp, Homo sapiens
  misc_feature: GYAE6OF01CPYES.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtcctccttccacctgtctgcatctgtaggagacagagtcacatcgcttcggccggcactcagagtgtacgcgagggttggttggcctggtatcgagacaacgaaccggagggaacgcccctagaacctcctagatctaagtgaatcgaccgagtctaaggtttacggaaaacggtcgggtacccagtaccgaagtacttacgacgggcggacgaggttacggagttccggagggtaacgtaggtacgtttaccctaccgttacgtacccgaaccctacgttaccgacgaacccgacgtcccgttaggacccgacggttacccgtagggtaacgtttacgtttacgtttttaaccgaacccggtttaaacccttttaaggttttaacgttaccggtaaacccgtaaacgtttaaaggttaacttttaaacggttaaaccggtttaaccgggtttacccggttaacggggttaacccgggttaccgggtaaacccgggtaaaccgggggttaccgggtaaaccgggggttacggaaaaccgttaaaccggttacggtaaaaaaccccggttacggtttacgggtaaccggggttcctaacccggtaccccgtaaccgtttaacccgg

SEQ ID NO: 158546 - DNA, 645 bp, Homo sapiens
  misc_feature: GYAE6OF01B6ENJ.16.4.A04.1.454.CMB.1.raw
  modified_base (256)..(256): a, c, t, g, unknown or other
  misc_feature (256)..(256): n is a, c, g, or t
  modified_base (371)..(371): a, c, t, g, unknown or other
  misc_feature (371)..(371): n is a, c, g, or t
tcagtgtactactccacgaccggtgctcgatttagagtagtgatcagggggagtcagactcagtcaggacacagcatggacatgagggtccccgctcagctcctggggcctcctgctgctctggctcccaggtgccaaatgtgacactccagatcgaccctagtcctccttccaccctgtctgcatctgtagagacagagtcacatcgctcgccggccactcgagtagtgtagcgtaggtggtggcctggtatcgngacaacgaaaccgacgggaaccggtcccctagacctacctggtactacgtagtgatcgacctagtcgttaaggttaacggtaaacggtcgggtacccagtaacaacgtatacggnggccggtagtaggtggtactacggtaggacgtagtacgttccaccgtactaccaactactaacgcgaccgtacgtccgtacacggtaaccgtcgtacgttagtacggtttatttaccaaccgttaactttattagtacctaaccgtacgtaagtttaagtaacttttacggtacttacgggttcggtaccggttaccggtacggaaacgggtacccgggagggttacgaacgtacgtaaccgtaagtacggttgaccgtagtccgctaacgtcg

SEQ ID NO: 158547 - DNA, 768 bp, Homo sapiens
  misc_feature: GYAE6OF01A1C8S.16.4.A04.1.454.CMB.1.raw
  modified_base (95)..(95): a, c, t, g, unknown or other
  misc_feature (95)..(95): n is a, c, g, or t
  modified_base (240)..(240): a, c, t, g, unknown or other
  misc_feature (240)..(240): n is a, c, g, or t
tcagtgtactactccacgaccggtgctcgatttagagtagtgatcagggggagtcagactcagtcaggacacagcatggacatgagggtccccgntcagctcctggggctcctgctgctctggcctccgaggtgaccaaatatgacactccgagatcgaccctagttcctcccttcccaccctgtctgctatcgtaggtaggacacagactcaccagtccgtcgttcggccggccacgtnagtgttgtagcgtagggtggttcggccgtggtatcgagacgaacggaaaccggagggaaccgtccccgtagaacctccgtagtactacgtagtgactcgacgagtacttaagggttaacggtaacggtacgggtacctaagtacgtaaagtcgtacgaggacgcgtaggtacggtacgtcgggtacggaactagttacgttacctaccgttacctaaccgtactacgtaccgaacggccaccggttcctacggtaaccgaccgtaccgtagttacgtttacgtttaagtttaccgtaacgtttaaaccttaacggtttacgttaacccgaacgttaaacgttaagttaaacgtttaacgttaacgtttaacccgggtaccggttaacggggttccccgtttaaacggggaccccgggtaaaggggtaacccggttaacggggtaacccggtaaacgtaaacggttaaaccggtaaaaccggttacggttacggggacccgtacgtacccggttaaccgtaccgttacg

SEQ ID NO: 158548 - DNA, 775 bp, Homo sapiens
  misc_feature: GYAE6OF01CWPHR.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatcgacccagtcctcccttccaccctgtctgcatctgtaggagacagagtcaccatcgcgttcgcccggccactcgagtagtgttagcgaggttggttcggccttggtatcagacaaggaaccgagggaaccgcccctaggaacctccgtagtactctagtgacgtcgacgtagtacgttaaggtttaaggaaaacggttccggggtaccctaagtacgtaaagtacgttcgacggtccgggtactagggttacggagttccggtaggggaaccgtaaggtaccgttaccacccgttctaacccgaacctactaccggactaccgtacgtcccgtaggacctacggtacccttaggtaagtttcgttaacttttacccggtaaccttaacccgtttaacgttttaacgttaacccgtaaccgttaaaacgttaacggttaaatttaaacggtttacgggtttaaccgttacccggggtttaacgggttaaccccgggtttaccggggaaacccgggtaaacgggggtacccggtaaaggggtaccgaaaaccgttaacggtaaacccggtaaaaacggttccgttacggggtacgttccgtaaccgtaccgtaacccgtttaacg

SEQ ID NO: 158549 - DNA, 710 bp, Homo sapiens
  misc_feature: GYAE6OF01B8HSM.16.4.A04.1.454.CMB.1.raw
  modified_base (234)..(234): a, c, t, g, unknown or other
  misc_feature (234)..(234): n is a, c, g, or t
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatcgacccagtcctcccttccaccctgtctgctatcgtgtaggagacagactcaccatccgcgttggcccggaccacgtcgagngttgttagcgtagggtggttcggccgttggtatcgaagacgaacggtaaaccggaggggaccggtaccccctagtaacctccgtggtaacttctagtgacgtcgaccgtagtacgtaaggtttaacggaaacggttcgggtacccagtaacgagtacttacggacggcgtacggtaggtggtacgtcggtagggtaacgtagttacggtacctaaccttccgtaaccgacctacgtccgaacgtacgtccgtaccgtgaccgtacgccttagtagttaccgttttattaccgttaacccttaacgttttcgttaacgttcccgaaacttaagtaacgtttaagttaacgtttaacggttccgtacgggttacggttaccggtaccggaaccggtaacggggacgtaacggggtacgaaaccgtacgtaaaccgtaacggttacgttgggacccgttacgaccgtaacctcggttac

SEQ ID NO: 158550 - DNA, 826 bp, Homo sapiens
  misc_feature: GYAE6OF01DDCVX.16.4.A04.1.454.CMB.1.raw
tcagtgtactactccacgaccggtgctcgatttagagtagtgatcagggggagtcagactcagtcaggacacagcatggacatggacgggtccccgctcagcctccgtgggctcctgctgctctggcctcccgaggtcgaccaaatgtacgacactaccgagactacgacccagttcccttcccttcccacccttggtctcgactacgtcgtaggtaacggacacgagacgtacaccgtagtccgtcgttcggacccgggacctacgtacgaggtagttggttaacgtcggtagggttcggttcggtaccgtggtactcgacgacgaaccgaacggacgggtaaccgtcctaaggaccttaccgtagtacttactagtacgtacgacgtaccggtagttacgtaaggtttaagggaaacggttaccgggacctaagtacgaaacgttcgttaaccggaggtacggacgtaacggtaggtacgttacggaacggaacgtaggttaacctacgtaacccgtccctacgaaccgtagtaccgacgtacccgtacgtcccgtaagacccggtattaccggtaagttaacgttacgtttactttaccgtaactttaaaccgttacgtttacgtaaacctaaccgtaaaggtttaaaccttaaactttaaacgggtttaccgttaaccggtttccgggtaacgggtttacccggtaacggggtaaacccgggaaacgggtacccgggtaacgggttaacgtaaaccctaacggtaacccgttaaaacggttccgtacgggtcgtaacgggtaccgtaccctaggttaaccgg

SEQ ID NO: 158551 - DNA, 705 bp, Homo sapiens
  misc_feature: GYAE6OF01BKEKC.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatcgacccagtcctcccttccaccctgtctgcatcgtggtaggagacgagacgtcacctatccgtcttcggcccggccacgtcgagtgtgtagcgtagggttggttcggtccgtaggtactacgagacgaacgaaaccggagggaccggtcccctagtaacctcgtagtacttactagtgacgtacgacgtagtcgtaaggttaacggtaaacggtcggtacccagtaccgtaatcgttacgacggtcgacgtaggtgtacgtggagggactaggtacgttccactcctacacctactacgacgtcgacgtccagtaccgtacgtaccgtagttaccgttagttacgtttaccggaactttaaaccttacgtttaacgtaccgaacccttaaaggtaacgtttaacgtttaacggttacggttaccggttacccggttacgggtaacccggttacggaaacccgggtaacggtaacgggtacgggtaacgtaacgtaacccggtaaaccgaacggttaccggtacgtaccgtccgtaccgtacccgtacgttacg

SEQ ID NO: 158552 - DNA, 781 bp, Homo sapiens
  misc_feature: GYAE6OF01ELA7P.16.4.A04.1.454.CMB.1.raw
tcagtgtactactccacgaccggtgctcgatttagagtagtgatcagggggagtcagactcagtcaggacacagcatggacatgacgggtccccgctcagcctccgtggggctcctgctgctctggctcccaggtgaccaatgtgacatccagatacgacccagttcctcccttccacccctgtctgccatctgtaggagacagacgtcaccagtccgtcgttcggccggacctactcgagtagttgtacgcgaggggttggttcggccttaggtatcgacggaccaacggaaaccggaggggaaccgtccccctaggtaacccttcgtaggtaacttacgtagtcggtactccggaccgaggttacgttaaggtttaagggaaaacgggttccgggtaacccaagttaaccgtaagttacttaccgggaaggaccggtagtacgggtaagggtaccttacgggtagggaactacggttacgtacccacgttcacccacctagtcgacgaacgtcgtaccgtacgacgtaactcgttagtattcggtttactttaacggacctttaactttagttaccgtaagtaacccgtaaacgtttaggttaaacgtttaacggttcgttttaaccggacccggggtttaacggtacccggggttaaacccgaaacccggggtaaaggggtaacccgggtacgggttaacggaaccgttaaccggttaaaaccgaaacgggttacggttccggaaccgggttactaccgggtaccctaacgtttaccg

SEQ ID NO: 158553 - DNA, 598 bp, Homo sapiens
  misc_feature: GYAE6OF01EHUYQ.16.4.A04.1.454.CMB.1.raw
tcagtgtactactccacgaccggtgctcgatttagagtagtgatcaggggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttgccggccactcagagtgttagcgaggtggttggcctggtatcagacaaggaaaacccgaggggaacgccccctagaacctcctgactctagtgagtgaccagcgtaagtttaggaaaaggtcgggtacccagtacgaaagtacttcgagcggacgtaggtggtatcgtagggacaggtagttaccgacttacctacaacctagtactaggtagtcccgtagcagcctagtacttgtaactttgacctaacttattagtcgtaaccaactaagtaagttaatacgtttaagtccggttacggtaccgttacgggaccgaaacgggaccgtaggggtacggtaagtaactaccgaaaacgtacgtacggtacgacgatccacgagttaccg

SEQ ID NO: 158554 - DNA, 699 bp, Homo sapiens
  misc_feature: GYAE6OF01CUVHE.16.4.A04.1.454.CMB.1.raw
  modified_base (189)..(189): a, c, t, g, unknown or other
  misc_feature (189)..(189): n is a, c, g, or t
  modified_base (685)..(685): a, c, t, g, unknown or other
  misc_feature (685)..(685): n is a, c, g, or t
tcagtgtactactccacgaccggtgctcgatttagagtagtgatcagggggagtcagactcagtcaggacacagcatggacatgagggtcccgctcagctcctgggctcctgctgctctggctcccaggtgccaaatgtgacatccagatgacccagtcctccttccacctgtctgcatctggtagganacagagtaccactagtcgtcttcggcccggtacacgtcgaagtacgttaggtacgtcgtagggttggttcggccgttaggtacgtacgaggacgaaacggaaaccgacgggtaacggcccctagtaaccgtccgtagtactactacgtagatcgaccgagtacgtaggtttaaggaaaacggtcggggtacctaagtacgtaacgtagttcgaacgcggtacgtaggtacggacgtcgggtacgggaacgtaacggttacgttaccgtaacgttcctaaccgtaaccctaacttaccgacgttaaccgaccgtaaccgtcgtaacgtccgtccgttacgtaacgttagttacgttttacgaactttaccgttaactttacgtaactaccgtaaacttaagtattaagtttacgttacgttacggtacggtaccgttacggacccgggtaggacggtaacggttagaacgtacgaacgtaacggacttcggcgttanaccgtcacgttacg

SEQ ID NO: 158555 - DNA, 783 bp, Homo sapiens
  misc_feature: GYAE6OF01DDOBA.16.4.A04.1.454.CMB.1.raw
tcagtgtactactccacgaccggtgctcgatttagagtagtgatcagggggagtcagactcagtcaggacacagcatggacatgagggtccccgctcagctccgtggggcctcctgctgctctggcctcccgaggtgaccaaatgtgacatccagatcgacccagtcctcccttccacctgtctgcatctggtaggagacgagacgtccaccacgttccgacgttcggcccggaccacgtcgaaggtagttagtacgcgagggttggttcggccgttggatcgagacgaacggaaaccgagggaccgccctagtacctccgtagatactagtgacgtacgaccgagtacgttaaggtttaacgggaacggtaccgggtacctaacgtaacgtaagtacgttacgacggacggtacgtagggtcggtagtaccgggtagggtaacgaggttacgtacctaccttccgaaccgtaacgtacgtaacggacgaccggtaccgtccgtaacgtacgtccgtaccgtagtacgtttacgttattttaacccgaaccgttaacgttttacgttaacgttaccgaacttaaacgttaacgtttaaggttactttaacgggtttaaccggtttacccggtaggggttaaccccggttaacgggaaaccccgggtacgggtaaaccggggtacgggtaaaccggtaaccgtaaccggttaaaaaccgggttaaccaaccggggttttacggaccggttaccccgttaacggtccctaaccccgggtttaacg

SEQ ID NO: 158556 - DNA, 769 bp, Homo sapiens
  misc_feature: GYAE6OF01B90F9.16.4.A04.1.454.CMB.1.raw
  modified_base (136)..(136): a, c, t, g, unknown or other
  misc_feature (136)..(136): n is a, c, g, or t
  modified_base (145)..(145): a, c, t, g, unknown or other
  misc_feature (145)..(145): n is a, c, g, or t
  modified_base (197)..(197): a, c, t, g, unknown or other
  misc_feature (197)..(197): n is a, c, g, or t
tcagtgtactactccacgaccggtgctcgatttagagtagtgatcagggggagtcagactcagtcaggacacagcatggacatgacgggtccccgctcagctccgtggggcctcctgctgctctggctcccaggtnaccaaatgngacatccagatcgacccagtcctcctccaccctgtctgcatcgtggtagganacagacgtcacagtcgcgtcggccggacctactcgagtacgtgttagcggtagggttggtacggtcgttggtatacgacggaacgaacggaaaaccggacgggggtacccgcccccgttaggaaacccgttccgtagtacttacgtagttactaacgtccggacgtaacggttaacgttaagggtttaaacgggtaaaacggggttcccgggttacccaaagtttaccgaaaacggtttcgtacggacggacggtaccgtagggtacgttaaccggtcggtacgggaacacggttaccgtaccaactcctaccactacgtcaacggtccaaggtccctagaccgacgttcgtaaggtactttggtttaacctcgtaaacccttaacgtttaattaaccgtaccgaaaccgttaaagtaacggtttaaattaagggtttccgttaaccgttccgggtaccgggttaaccgggccggttaaaccgaaacggggtcggtaagggtaacaacgttaacgtaaaccggaaaccggttggtacccgggctaaaccggtcctaaaccgtcccgtttagg

SEQ ID NO: 158557 - DNA, 690 bp, Homo sapiens
  misc_feature: GYAE6OF01A6T8R.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctcctccaccctgtctgcatctgtaggagacagagtcacctatcgcttcgcccgggccacgtcagagtgttagcgaggtggttggcctggtactcgagacaacggaaaccgagggaacgtcccctagaacctcgtagattactagtcgacgtcgaccgaagtcgtaagtttacgggaaacggttcggggtaccctaagtacgaagtacgttcgaggccgtacgtaacggtaggtacgtcggtagggaactaggtacgttaccaaccgttccgtaccgtaacctacgtcgaacgtccgaacgccgtacgcgtaaccggccttagtacttacggttactttacgaaccctttaaccttaacgtttacgtacctaacccgtaaacgttaaggttaacttaacgtttacggttaacgtacccgggttacgggttaccggttaccgggaaccggtaaacgggtccggtaagggtacgaccgtaacggtaacccgaaaggttaccgtaggcgttacgaccgtaaccgtacgttccg

SEQ ID NO: 158558 - DNA, 715 bp, Homo sapiens
  misc_feature: GYAE6OF01AJHK5.16.4.A04.1.454.CMB.1.raw
  modified_base (193)..(193): a, c, t, g, unknown or other
  misc_feature (193)..(193): n is a, c, g, or t
  modified_base (295)..(295): a, c, t, g, unknown or other
  misc_feature (295)..(295): n is a, c, g, or t
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtccttccttccaccctgtctgcatctggtagganacagagtcacatcgcttcggccggcactcagtagtgttagcgtagggtggttggcctggtactcgagcaacggaaaccgaggggaccgccctagacctcgtnatctatgatcgaccagtctaggtttagaaacggtcgggtaccagtacgaaagtactacgacggcggtacgtacggtaggtacgttacgggtacgggaacgtacggtacgttacccgtacgttacctaccgacctacgtccgaacgtccgtacggtcccgtgtacctaacggtccgttagtacgtttacgttacgttttaccgaacctttaaccgtttaatttaccgtaaccgtaaccgtaaacgttaagttaaacgtttaagttaaccggtttacggttacccgggtacggttaaccgggttaccgggaacccggggtaaacgggtacccggtaacgggggtaccgaaaccggttaacgtaaaacccggaaacccggttcggtacgggtaccggtacgtaccggtaaccctaagtttccg

SEQ ID NO: 158559 - DNA, 826 bp, Homo sapiens
  misc_feature: GYAE6OF01B3T5Y.16.4.A04.1.454.CMB.1.raw
tcagtgtactactccacgaccggtgctcgatttagagtagtgatcaggggggagtcagactcagtcaggacacagcatggacatggacgggtccccgctcagctccgtggggcctcctgctgctcgtggcctcccgaggtgaccaaatggtagacatccagatacgaccctagttcccttcccttaccctacccgttgttcctgtacctagttcgttaggtaacggaacgacgaggtacgtaccaaccgtacgtcggtccgttcgggaccccgggacctacgtacgaaggttacggttaggtaggacggtagggtttcggttccggccttaggactacgacgtaacgaaacggaaaccggaacgggaccggtaccccgtagtaaccttcgagtacttacctaagtcgtacgtaccgaccgtaagtacgtttaaggttaaacgggtaaacggggtccggtaacctaagttaaccggtaagtacgtaccggacgggaccgtaggtaggtacggtacgtacgggtaacgggtaactagggttaaccttcccgactttaccaaccctaacgtacgtacgaacgtcccgtaagtacccgtgacccggtacgtacgttaggtacgtttactttaacggtttacctaaaccgttaacttaacgtttattaccgaaacgttaacgttaagttaaattaacggttacgttacggtttaccgggtaacgggttaaccggtaccggaaaccgggtaaccggggtacgtaacggggaacaacgttaaccgaaaccggtaaccggtgttacgggacgtaacctacgtaacgtcttaacg

SEQ ID NO: 158560 - DNA, 735 bp, Homo sapiens
  misc_feature: GYAE6OF01B83NI.16.4.A04.1.454.CMB.1.raw
  modified_base (261)..(261): a, c, t, g, unknown or other
  misc_feature (261)..(261): n is a, c, g, or t
  modified_base (298)..(298): a, c, t, g, unknown or other
  misc_feature (298)..(298): n is a, c, g, or t
  modified_base (308)..(308): a, c, t, g, unknown or other
  misc_feature (308)..(308): n is a, c, g, or t
tcagtgtactactccacgaccggtgctcgatttagagtagtgatcaggggggagtcagactcagtcaggacacagcatggacatgagggtccccgctcagctctggggctcctgctgctctggctcccaggtgccaaatgtgacatccagatcgacccagtcctcccttccaccctgtctgctatcgtgtaggagacagacgtcaccatcgcttcggcccggaccactcagtagtcgttagcagggtgtcggcctaggtancagacgaacgaaaccgagggacgcccctagaactccngactacgtanaggactacgtaccacgtagtaggtttaaacggaaaggttccgggtacctaactacgaacgtacgttacgacggtaccgggagtaacggtacggaacgttcgggtacggggtaaactacggttaaccgttacctacccgttctaacccgtacctaagacctaagaccgtaccgtcgtcgaccgtacggactttagggactttaagttaaccgtttacgaaccttaaacgttacgttaacttaccgaaactaaaccgttagttaaacgttaaaagtttaccggtttacggttaaccccggttcgggttaaccggttacccgggaaacgtaaaccgggggtaccgtaagggggtaccgtaaaccgtaaacggtacccgtaaaacggttacggttagggttacccacgggttaacaaccccgtcttaacgg

SEQ ID NO: 158561 - DNA, 680 bp, Homo sapiens
  misc_feature: GYAE6OF01EO8H3.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttggcccggaccactcagtgttgttagcgtaggtggttcggccgttggtatcgagcaaggaaaccgagggaacggcccctagaaccttccgtacgtactacgtatggactcgccaggtacgttaacggttttacggaaaacgggttccggggtaccctaagtacctaaacgtacgtttacgaacggcggacctaggtgggtactacgggtacgggacgtaagtacgttacctaccttccaccgtaacctacgtacgaacgcctacggcctcgaccgtacgtacccgtagtacgttagttaactttacgaccctttaacgttatttacgttaccgaacctaagtaagttaattaaccgtttacggttaccgtacggttaccgggtacgttaccggaaccggtaacgggtaccggtacggggtaagactaacgaaccgtaacgtaacgtacgaggtacctacgccgtaacgttacg

SEQ ID NO: 158562 - DNA, 666 bp, Homo sapiens
  misc_feature: GYAE6OF01BNHN3.16.4.A04.1.454.CMB.1.raw
  modified_base (350)..(350): a, c, t, g, unknown or other
  misc_feature (350)..(350): n is a, c, g, or t
  modified_base (453)..(453): a, c, t, g, unknown or other
  misc_feature (453)..(453): n is a, c, g, or t
  modified_base (461)..(461): a, c, t, g, unknown or other
  misc_feature (461)..(461): n is a, c, g, or t
  modified_base (474)..(474): a, c, t, g, unknown or other
  misc_feature (474)..(474): n is a, c, g, or t
  modified_base (646)..(646): a, c, t, g, unknown or other
  misc_feature (646)..(646): n is a, c, g, or t
  modified_base (658)..(658): a, c, t, g, unknown or other
  misc_feature (658)..(658): n is a, c, g, or t
tcagtgtactactccacgaccggtgctcgatttagagtagtgatcaggggggagtcagactcagtcaggacacagcatggacatgagggtccccgctcagctcctggggctcctgctgctctggctcccaggtgccaaatgtgacatccagatcgacccagtcctcccttccaccctgtcctgcctatctaggtaggagacgagagttccaccaagtccgtcttcggcccggggtacctacgtcaggtacgttggttacgcgtagggttggttcggccgttggtatcacgtaccgaagaaaccgtaggggacgacccctagtaacctctgacttctagtcgatcgctagngtaacggttaggaaacggtcggtaccagtacaagtattcgacggcgagtaggtcgtaacgtgacgggatagtacgttctaccgtcacctacgactagccgtanacgtccanctacgccttaggntagttacgtttcaacgttacttaacgttaactaccgtaacctaaaggttaattaacgttaaagttacgttaacccggttcggaaccgggtttaaccggtccgggaaacccgtaccgggtaacgggcgggtaataccgtaacggttaactaaaccgtacggttcggaccggtntacccggtaacncgttaccg

SEQ ID NO: 158563 - DNA, 819 bp, Homo sapiens
  misc_feature: GYAE6OF01EWO23.16.4.A04.1.454.CMB.1.raw
  modified_base (147)..(147): a, c, t, g, unknown or other
  misc_feature (147)..(147): n is a, c, g, or t
tcagtgtactactccacgaccggtgctcgatttagagtagtgatcaggggggagtcagactcagtcaggacacagcatggacatgagggtccccgctcagctccgtggggctcctgctgctctggctcccaggtgccaaatggggtnacatccagatgacccagtcctcccttccaccctgtctgcatctgtaggagacagagtccacatcgcttcggcccgggcctaactcgagtaggttgttaagcgtaggttggttggccgttggtatacgagacaagaaaccgaacgggaacggcccctagaaccgtcctaggattacgtatggatcgaccctagtactaaggttttaaggaaaaacggtcggggtacccctaagtaaccgaaagtaacttacggacggtcggactaggtacgggtactcgggtacgggaactaacggtaacgtttacccgaactttacctaaccgaacccctaaggttaccaacggtaccgaaccggtcccgttaacggtaccctaaccggtaccccgtaggttaacgtttacggtttaacgttttttaacggaaacccgttaaaaccctttagttttaaaccgttaaccggtaacccctaaaacgttaagttaaacgttaaaacgtttaacggttaacgttacccggggttaacgggtaccggttacccgggggtaaaccggtaaaaccggggtaacccggttaaggggtaacgggtaaccgtaaaccgttaaacccggaaaaaccgggttaaacgttacggggttaccggtaaccttaccggtaacccgtaacccgttaacg

SEQ ID NO: 158564 - DNA, 667 bp, Homo sapiens
  misc_feature: GYAE6OF01BS7ER.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccacctgtctgcatctgtaggagacagagtcacatcgcttcggccggccactcgagagttgttagcgtagggtggttcggccgttggtactcgagacgaaggaaaccgacggggaacggtcccccgtagaaccttccgtagtactcgtagtcgagtcgacccgagactaaggtttaacggaaagggttcgggtaccctacgtacaagtactacgaggcggacgaggtcggtacgtcgtacgggactaggtacgttcgacttcctacgaacctacgtcaacgcacggtcctaggaccacggtaccctgtacgttacgttacgtttacgaccttaacttagttaacgttccgtaacctaacgtaactttaagttaaacgtttagtaccgttccggtaggttaacccggtacggggaaccggtaacggggtaccggtacggggtacgtacggaaacttaaccggaaacgtaacggtcgtacggtacgcgtacctaccgttaccg

SEQ ID NO: 158565 - DNA, 785 bp, Homo sapiens
  misc_feature: GYAE6OF01DTOJT.16.4.A04.1.454.CMB.1.raw
  modified_base (153)..(153): a, c, t, g, unknown or other
  misc_feature (153)..(153): n is a, c, g, or t
tcagtgtactactccacgaccggtgctcgatttagagtagtgatcgagggggagtcagactcagtcaggacacagcatggacatggacgggtccccgctcagctccgtggggctcctgctgctctggcctcccgaggtcgacctaagtggtanacactccagacttccgaccctcttcccttcccgttaccctcccgttgtcctcgactagttcgttagggagggaacacgtacgtacgtaccaaccgtacgttccgcgttccggacccggaccacgtacgaggtgttacggtagacggtgggttcggtcggtcgtaggtactacgacgaccgaaacggaacggaccgggaccgtcccgtacgtaacctcgtacgttacgttataacgtcgtacgtacggaccgtacggttacgtaacgggtttaaggaccggttaccgggacctaacgtacgtaacgtcgtaacggcggacggagtacgggtagtacgtacggacgggacttacggttctacccgtcgtaccaaccgacacggtaccgagtcccgtaacggtccaccggtaacgacggttacgttagttacgttacgtttacgttaccaaacctttaacttggtttaacccacgtaacttaaacgttatttaacgtagtttcgttaaccggttccgtaaggggtaccccgggtaagaaccccgggtaggttaacgggaccggttactaaacggtcccttaaaccgggtaagtccccgggttagtacccgacgttacccggtctccgggtttacc

SEQ ID NO: 158566 - DNA, 840 bp, Homo sapiens
  misc_feature: GYAE6OF01DSXI3.16.4.A04.1.454.CMB.1.raw
  modified_base (142)..(142): a, c, t, g, unknown or other
  misc_feature (142)..(142): n is a, c, g, or t
tcagtgtactactccacgaccggtgctcgatttagagtagtgatcgagggggagtcagactcagtcaggacacagcatggacatgagggtccccgctcagctcctgggctcctgctgctctggctccaggtgaccaatggtnacatccagatacgacccagtctcctccacctgtctgctatcgtagtaaggtagacagtacgtaccaaccgacttccggtacgttacggccccgggtaccctacgtaccgtaagggtacggttacggttacggtaccggtaaggggtttcgggttccgggacccgtttaggggtaaactttaccgaaaacggttaacccggaaaaccggtaaaaacccggaacggggtaaacccggtaccccccgttaacggtaacccgtttccgtaacggtaaccgttacccgttaagtacgtaacggtacgtaccgtaacggtaaccgtttaaggtttaaacgggaaaccgttacggggtaccctaaagtaccgtaaaggtacccgttaggaacggacggtacgtacggttaggcgttaggacggtacgtaacggtacgttaccacgtttaccaacggttacccacgtaaccgtaagtcccgtagtacccgtacgtacgtacgttacccgagttactacggtttaacgtttaccgaaccttaagtttacttcgtaacggaccttaaacgagtttaacgttaacttacggtaccgttaaggccgggttaaaccgaccggtaaacgggtaggaccgtaaggggtacaaccggtaagtaaacccgtaacggtaacgttggggtaactaccggtaacaccgtcgttaaccg

SEQ ID NO: 158567 - DNA, 846 bp, Homo sapiens
  misc_feature: GYAE6OF01B1JL2.16.4.A04.1.454.CMB.1.raw
  modified_base (172)..(172): a, c, t, g, unknown or other
  misc_feature (172)..(172): n is a, c, g, or t
  modified_base (815)..(815): a, c, t, g, unknown or other
  misc_feature (815)..(815): n is a, c, g, or t
tcagtgtactactccacgaccggtgctcgatttagagtagtgatcaggggggagtcagactcagtcaggacacagcatggacatggacgggtccccgctcagctccgtggggcctcctgctgctctggcctcccgaggtcgaccaaagtgtgacactccagactacgacctntcctccttccaccttgtctgctatcgtaggtaggacgacgacgtacgtaccaccacgtccgtacggtccggacccggaccacgtacggaggtaggttacggtacggcgggttagggttcgggtccggtcggttaaggtactacgacgtaacgaaacgggaaccggaccgggaacccgtaccgtacgtaaccgtccgtagtacgttactaacgtgaccgtaccgacggtaacgttacggtttaagggtaaacgggtaccggttcccggtaaccttagtaaccggtagtacgtacgggtaccgggacgtagttaacgggtacgtacggtacgggaacggttacgtacgttaccgtaacctaccgtactaaccgtaccgtacgtacgaacccgtactacccggtacgtacggtaccgaccgttacggttagtacgtttacgttacgttaaccgtactttaacgtttaaccttacggtaaccgttaaacgtaaacgtttagtttaaacggtttaaccgtttacgggttaccggttacggggtaacccgggtaaccggggttacccggggaaacggttaaaccggggggtacgtaacggggtaactacgggtaaaaccgttaaccggaaccggttagggttaccccgnggtaacccgtccggttaaacctccgttacgg

SEQ ID NO: 158568 - DNA, 739 bp, Homo sapiens
  misc_feature: GYAE6OF01ED8Z0.16.4.A04.1.454.CMB.1.raw
tcagtgtactactccacgaccggtgctcgatttagagtagtgatcagggggagtcagactcagtcaggacacagcatggacatgagggtccccgctcagctccgtggggcctcctgctgctctggcctcccgaggtcgaccaaagtgtgacatccagactcgacctagtcctcccttccacccttgtctgactattcgtaggtaaggacgaccgaggtagtccaacctagttccgtccgttccggaccccggtcctacgtcgtagtaggttggttacgcggtacgggttggttcggtccgtaggtactacgtaacggacgtaaacggaaaccggaacggggtacccgtaccccgtacgtaaccttcgtacgtacttacgtagtcgtactccgacgaggtacgttacggttaacggtaacggtaccgggtacctagtaacgtaaggtactacggacgtacggtagtaggtacgtacgtacgtagggacgtacggtacgtaccgtacctaccgtacctaccgtactacgacgtacgtacgtcgacgtacgtacgcgttagtaacgtttcttacgttaccgtaacttaacgttacgttacgttaacaaccgtaagttaacgttaagttacgttacgttcgtaccgggttacgtaccgtaccgggacgaaccgggtaggtacggtaacgaacggtacaacggtaacggtacgtggttacccgagtaccgtaaccgcgttaccg

SEQ ID NO: 158569 - DNA, 683 bp, Homo sapiens
  misc_feature: GYAE6OF01CF1WU.16.4.A04.1.454.CMB.1.raw
  modified_base (196)..(196): a, c, t, g, unknown or other
  misc_feature (196)..(196): n is a, c, g, or t
  modified_base (443)..(443): a, c, t, g, unknown or other
  misc_feature (443)..(443): n is a, c, g, or t
  modified_base (468)..(468): a, c, t, g, unknown or other
  misc_feature (468)..(468): n is a, c, g, or t
  modified_base (643)..(643): a, c, t, g, unknown or other
  misc_feature (643)..(643): n is a, c, g, or t
  modified_base (674)..(674): a, c, t, g, unknown or other
  misc_feature (674)..(674): n is a, c, g, or t
tcagtgtactactccacgaccggtgctcgatttagagtagtgatcagggggaggtcagactcagtcaggacacagcagtaggacatgagggtccccgctcagctccgtgggctcctgctgctctggctccaggtgaccaatgtgacatccagactcgacccagtcctccttccacctgtctgcagtctagacgganacagacgtcacctagcgattcggacgggtccatacgagtcgttagtacgtcgtaggtcggttcggccgttaggtactagtacgacgtaaacggaaaccgacggggaaccggtacccctggtaaacctaccgttcgaacgtttacaacgtagtaccgtccggactaaccgggtacgtttaaggttaacggtaaaacggggttccggggtacctacgtacgggtaaactacgttcgaaggtccgtaagnggttcgtagtacgttacgggaaacncggttaacacggtaccttacggactacgaacgtccgaacggtcaaacggccctagaccgtacgccgttagacgtacgtttcgttaacctacttaccggttaattacgactacgacgttataagttaccgtagtaccgacgtacgggtacgtacggaccgaggtacggtacggtanaagaacacgttaacgactagggactggtacncgattacgg

SEQ ID NO: 158570 - DNA, 945 bp, Homo sapiens
  misc_feature: GYAE6OF01D02V6.16.4.A04.1.454.CMB.1.raw
tcagtgtactactccacgaccggtgctcgatttagagtagtgatcagggggagtcagactcagtcaggacacagcatggacatggacgggtccccgctcagctccgtggggcctcctgctcgctctggcctccgaggtcgaccaaatggtacgaactactaccgagtacgtaccgaaccctacgttcccttccccttaccctacccgttgttccgtcgactacgttcgtaggtaaggaacgacgacgtacgtacctaccgtacgtccgtaccggttccggacccgggtacctaccgtacgtaaggttacggtttcggttacggcggttaggggttcgggttaccggtacggttacgggtaactacgaacggtaaccgaaaacgggaaaccgggtaccggggtaacccggtaccccgtaacgttaacccgtaccgtacgtaactttacgtaacggtacgtaccggtaccgaccggtacggttaacggttaacgggtttaaacgggtaaacccggggttccgggtaaccctaaaggtaaccgtaacggttaccggttaacgggaccgggtacggtaacggtagggtacggtacggttacggggtaacggtaacgttaacggttaccgttacctacccgttaaccgtaaccctaccgtaacgtaccgtaacgtacccggtactaccggtcgtaccgtacggtttaccgtaggtttaacgttcgttttaaccgttaaccgtaacctttaaccgtttataccggtaactaaaccgttaacgtttaaagttaaacgttttaacgtttacggtttaacccgggtacggttaccgggtaaccgtacccgggaaccgggtaacggttaaccgggacggtaacccgtaaacgtaacccgtaaacgggttaaacggtcggtttaaaccggcttaaaccggtccttaacgcgtttcg

SEQ ID NO: 158571 - DNA, 741 bp, Homo sapiens
  misc_feature: GYAE6OF01CLE0D.16.4.A04.1.454.CMB.1.raw
tcagtgtactactccacgaccggtgctcgatttagagtagtgatcagggggagtcagactcagtcaggacacagcatggacatggacgggtccccgctcagcctcctggggctcctgctgctctgcctccgaggtcgacaaatggtgacatccagatcgaccctacgtcctcccttccgaccctgtcgtcgctacgtcgtggtacggagacgagtacgaccaccgacgtccggtccgtcgggccgggccctacgtacgaggtcggttaggttaggtccggtaggggtttcgggttacggtccgttaggtactcgacggaaccgaacgggaaacccgggacggggtaacccgtccccgtaagtaacccgttccgtagtacgttccgtagtagacgtcgaccaggtacgttaagggttacggtaaacgggccgggtacccaaggttacgaagtacgtacggacgggccgtagtacggtcggtacgtacgggacggacgtaggttaccgtacctccgttacctaccgactaacgtcgacgtccgacgtcgacgcgtactacggttagttacgttgttaacgttaccactttaacttacttacgtaccaacttaacggtaacttattacgttcgtacgggttccgtacggtaccggtcggaaacccgggtgggtaacggtccggacggaactaccggtacgtaaaccgttggtacgggtacctacggtcccgaagttccgttacg

SEQ ID NO: 158572 - DNA, 776 bp, Homo sapiens
  misc_feature: GYAE6OF01BS50B.16.4.A04.1.454.CMB.1.raw
tcagtgtactactccacgaccggtgctcgatttagagtagtgatcgagggggagtcagactcagtcaggacacagcatggacatgacgggtccccgctcagctccgtggggctcctgctgctctggctcccgaggtcgaccaaatgtcgacactccagactcgaccagtcctcctccaccctgtctgcatcgtagtaggagacgagacgtccaacagtccgcgttcggccggaccactcgagtagtgtacgcgtagggttcgtcggtaccgtggtactacgacgacgaaacggtaaaccgacgggtaaccggtccccgtaggtaacctccgtaaggtaacttaccgtagttacggacgtaccggtaccgtaacggtacgttaaaagggtttaacgggtaaaacgggttaccgggggtaaccctaagtaaccgtaaacggtacttaccggacgggaacgtcggtaaagggttacggtaaccggttggtaacggggtaacctaacgggttaacttcccgtaccaacccgtttacgaaaccccgttagttaaccgtacggaacccgtacgtacccggtacggaaacctacgtaccgtagttaaagtcgttttaacgttactaaccttaaccgtttattaaccgtacgaaccgttaataacggttaactaagttacgtacgtacggacgtacggtacggacggtaacgggtacgtacggtaagactaaaccggaacttaaacggcggttacgtacggtacgaaccttcgaacgtttaccg

SEQ ID NO: 158573 - DNA, 686 bp, Homo sapiens
  misc_feature: GYAE6OF01EF361.16.4.A04.1.454.CMB.1.raw
  modified_base (485)..(485): a, c, t, g, unknown or other
  misc_feature (485)..(485): n is a, c, g, or t
tcagtgtactactccacgaccggtgctcgatttagagtagtgatcagggggagtcagactcagtcaggacacagcatggacatgagggtccccgctcagctccgtggggctcctgctgctctggctcccaggtgaccaatgtgacatccagatacgacccagtcctcccttccacccctgtctgctatctgtaggagacagagtcaccatccgtcgttcggcccggtaccactcgagagttgtagcgtagggttggtcggccgttggtactcgagacgaacgaaccgtagggaccgccccgtagtaacctccgtacgacttactagtacgtactcgaccgtagtacgttaagtttaacggaaacgggttccggggtaccaagttacggtaaacggtagttaccgagggtaccggtacgtaggtagtacgtcggtagggtaacgtacggtacgttaccacttaccgtaccaaccgtactaccgacnccgtacgtcccgtagcgtacgtcgttagtattcgtttacgtttaccgtactaaaccgtttagttacgtccgaacgtaacgtacgtttaaattaccgttacgttaaccggttcggtaccggtacggtaccggaccgtaacggggtaccgtagggagtaactacggtaaacgaacgtagtcggtacgtagacgtcgtaacgtc

SEQ ID NO: 158574 - DNA, 996 bp, Homo sapiens
  misc_feature: GYAE6OF01B6SSA.16.4.A04.1.454.CMB.1.raw
tcagtgtactactccacgaccggtgctcgatttagagtagtgatcgagggggagtcagactcagtcaggacacagcatggacatgacgggtccccgctcagctccgtgggctcctgctgctcgtggcctcccgaggtcgaccaagtcggtagactactccgagagtaccgaccctacgttccttccccttaccctacccgttcgttctcgtctacgttcgttaggtaaggagtaaccgacggtacgtaccaacctacgttccggtccggttaccggcccgggtaccctaaccgtaccggtaacggttagggtttaccggttagggaccgggttaaggggttttccgggtttaccgggtaccggtttaagggtttaaccaccggtaaaccgggtaaccggaaaaccggggtaaaaacccggggtaaccgggggtaaacccccggttaccccgttaaaccgggtaccctttaccggttaccggttaactttaccggtaaacggttcggaaccgtaccggtaacccgttaacggttaaaccgggtttaaacggggtttaaaccgggtaaaccggggtttccccgggtaacccgtaagttaacccgggtaaagttaaccgttacgggtaaccggggtacccggtacgtttaacgggtacgggtaccggttaccgggtacgggtacctacggttacgttacccaccggttacctacccgtaaccgtagtaccgaacggtacccgtacgtacccgtacgtaccggttccgtaacgtttacgttacgtttacgttttacgtaccgttaaacctttagtttaacccgttacgttaacgtaaccgttaaacgtttagtttaaaccgtttaaggttacgtttaccggtacggttaccggttacccgggttaaccgggtaccggtaacgggtacggtaacggtaacgtacgtaaaccggtacgtaaaccgttgggttacgacgtcgtaacccgtacgtacgttaccg

SEQ ID NO: 158575 - DNA, 710 bp, Homo sapiens
  misc_feature: GYAE6OF01BGVT8.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctggcctcccaggtcgccaaatgtgacatccagactcgacccagttcctcccttccaccctgtctgcatcgtggtaggacacgagagtcaccatccgtcttcggccggcacgtcagtagtgtacgcgtaggtcggttacggctaggtactcgagtacgaacggaaaccggagggaaccggtccccgtaagaacccttccgtaagacttacgtatcggactcgaccgaagtcgttaaggtttaaggaacgggttcgggaaccctagacgtaaacgtcgtaccgaggtcggacgtacggtagtacgttacggtacgggtaactaaggtacgttaccgactttacccgactaaccgtaacgtcacggtacctacggccctggtaccgacgtacctagggtaccttagttacttaacgacctttaacgttattcgtaaccaaccgtaagttacgttaattaaggttccgtcggttaccggtacgggtaccgttaaccggaccggtaaaacgggtccggttaagggaccgtaaactaccggaaacgtaaacccgggtacgtttcgggacgttacccacgaacccgttacgttaccg

SEQ ID NO: 158576 - DNA, 901 bp, Homo sapiens
  misc_feature: GYAE6OF01ATDUS.16.4.A04.1.454.CMB.1.raw
  modified_base (192)..(192): a, c, t, g, unknown or other
  misc_feature (192)..(192): n is a, c, g, or t
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatcgacccagtcctccttccacctgtctgccatctgtagganacagacgtcacctatccgtcttcggcccgggccacgtcagtagtgttagcgtagggtggttggcctggtatcgagcaacgaaccgagggaaccggtcccctagaacctcgtagtacttacgtagtcgaacgtcgacgtacgtacgttaaggtttaacgggtaaaacggttccggggtaaccctaacggtaccgttaaaaggtaccgtttaccggaacgggtacccggtaggtacgggttacgggtaacgttcccgggtaacggggtaaccggtaacggtttaccggtttaacccgtaccggttttaacccgaaccctaacccggtacttaaccggtaccggacgtaaccggtcccgttagacccggtaaccgtccgtttacggttaacttacggtttaccgtttttaaccggaacccgttttaacccttttaacgtttaccgtttaacgggtaaacccccttaaaggttaaagggtttaaacctttaaacgggtttaaccgtttaacggttaccccgggtaaccggggttaaccggtttaaccccggggtaaacccggtaaacccgggggggtaacccgggttaacgggggttaacccgggtaaaccgttaaaaccggggttaaacccgttaaaaacccgggggttacgtttaaacccgggggtcggttaaacccggttacccggtacccgttaaaacccgttaaccgg

SEQ ID NO: 158577 - DNA, 654 bp, Homo sapiens
  misc_feature: GYAE6OF01EW2PO.16.4.A04.1.454.CMB.1.raw
  modified_base (182)..(182): a, c, t, g, unknown or other
  misc_feature (182)..(182): n is a, c, g, or t
  modified_base (212)..(212): a, c, t, g, unknown or other
  misc_feature (212)..(212): n is a, c, g, or t
  modified_base (225)..(225): a, c, t, g, unknown or other
  misc_feature (225)..(225): n is a, c, g, or t
tcagtgtactactccacgaccggtgctcgatttagagtagtgatcagggggagtcagactcagtcaggacacagcatggacatgagggtcccccgctcagctccgtggggctcctgctgctctggctcccaggtgccaaatgtgacatccagatcgacccagtcctccttccaccctgtctncatctgtaggagacgagagtccacgatcgntcgccggccactnagagtgtagcgtaggtggtggctggtatcagacaacgaacgagggaacgccctagtactctagattactagtgatacgaccgtagtacgtaaggtttaaggtaaaacggtccgggtacccaagtacgtaagtacgttacgaggccggactaaggtacggtacttcggtacggggacttaaggtacgttacctaaccttacctaccaacctactaccgacgtaccgacgtcctacggacgacgtccgtagtacgtagttactttacgaccttaaactagtttacgtaccgaacctaacgtaagttaaacttaagttaacgtttaccgtacgggtaacgtaccgggttaccggaccggaaacgggtacgggtacggtacggaactacgtaacgaaacggtacgttggtacgtacctcgaccgtaacgtacg

SEQ ID NO: 158578 - DNA, 815 bp, Homo sapiens
  misc_feature: GYAE6OF01BFI8Y.16.4.A04.1.454.CMB.1.raw
  modified_base (141)..(141): a, c, t, g, unknown or other
  misc_feature (141)..(141): n is a, c, g, or t
  modified_base (774)..(774): a, c, t, g, unknown or other
  misc_feature (774)..(774): n is a, c, g, or t
tcagtgtactactccacgaccggtgctcgatttagagtagtgatcgagggggagtcagactcagtcaggacacagcagtggacagtggacgggtcccccgctcagcctccgtggggcctcctgctgctcgtggccctccgnggtcgaccaaagtcgtcgacactccagagtccgaccctacgttcccttccccttcccaccttgtctgctagtcgtaggtaaggacgacgtacgtacgacctaccgtacgtccgtcggttaccggcccggaacctacgtacgtagttacggttagtaccggtacggttagggttcggtttcccggtaccgttaggttacccgacggaaaccgtaaaccgggaaaccggaaaacccggggaccggggtaaccccgtcccccgtaacgttacccgtaccgttagttaccgtacgttacgtaaccgttcgtaccggtaccgtaacggttacgggtttaaggttaaaccggttaaccgggtacccgtaacctaacggtagttaaaccggtactccggtaacgggtcccgtagggtttaccgacggtccgtacgggtacggtacttaacggtccgttaccgtaccgttaccgtaccgtaaaccgtccgttaaccgcggtaccgacccggtccgtacgacctaccggtcttaagttcgttaacgttctacctaactttataccgttaccagttaactaagttattaacgttagtcgtttagccggttacggtaccggacggagtaccgggagtccgtaanacggtacacgcggtaagccgttacgatccgtaacgttgtac

SEQ ID NO: 158579 - DNA, 835 bp, Homo sapiens
  misc_feature: GYAE6OF01AENMY.16.4.A04.1.454.CMB.1.raw
  modified_base (628)..(628): a, c, t, g, unknown or other
  misc_feature (628)..(628): n is a, c, g, or t
tcagtgtactactccacgaccggtgctcgattttagagtagtgatcgaggggggagtcagactcagtcaggacacagcatggacatggacgggtccccgctcagcctccgtggggcctcctgctgctcgtggcctccgaggtcgacctaagtgtcgactataccagactacgacccgtatcccttacccttccctacccgtgtcgtcgtctactcggtagggtagggaacgtacgaggtacgtccacctagtccggtaccgttccgggcccggaccaccgtacgaggtaggttaggtacgacggtacgggttcgggttacggtccgttaggtaaccgtacgtaaacggtaacggaaccgggtaacgggggtaaccgtaccccgtaagtacccgttacctacgtaacgttactaacgtacgacgtacggtaccgaaggtaccggtttaacgggttaacgggtaacgggttcccgggtacgtaacgtaacggtaagttacgtaccggtaaccggggacggtacgtaaggggtcgtagggtcgggtaacgaccgttacgtaccgtaacctccgtacctaacgtaccgttaccgaccgacgtaccgtccgaccgtacgtccgggtaaccgtnttaacgggttacgttacgtttacgttacgttaacccttagtttaacttacggtaactaacgttaaggttacgttaagttaacggttaacgtttacgggttaccggttacccgggtacgggtaccggaacgggttaccgggaagggtacggtcggtaaactaccggtaaagtaacggttgacgtccggtacaggaccttactgttacc

SEQ ID NO: 158580 - DNA, 479 bp, Homo sapiens
  misc_feature: GYAE6OF02I99F9.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttgccgggccactcagagtgttagcaggtggttggcctggtatcagcagaaaccagggaaggccctgaactcctgatctatgatgccagcagtttgaaagtggggtccatcaagattcagcggcagtggatcgtgggacagagttcactctcaccatcagcagcctgcagcctgatgattttgctaacctattatgacaacagtataatagttatcgtagtacgttcgacaggaccgagggtagacagtacaacgactgtacgctagcactac

SEQ ID NO: 158581 - DNA, 506 bp, Homo sapiens
  misc_feature: GYAE6OF02JCDI3.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttgccgggccactcagagtgttagcaggtggttggcctggtatcagcagaaaccagggaaggcccctgaactcctgatctatgatgccagcagtttgaaaagtggggtcccatcaagattcagcggcagtggatcgtgggacagagttcactctcaccatcagcagcctgcagcctgactgattttgactaacctattattcgacctaactagtataattagtttaatccgtagtacgttacggacgtaacgggaccgaggggtaggacgagtacaaacgactggtgctcgacacctacg

SEQ ID NO: 158582 - DNA, 486 bp, Homo sapiens
  misc_feature: GYAE6OF02ICAOW.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttgccgggccactcagagtgttagcaggtggttggcctggtatcagcagaaaccagggaaggcccctgaactcctgatctatgatgccagcagttgaaaagtggggtcccatcaagattcagcggcagtggatcgtgggacagagttcactctcaccatcagcagcctgcagctgatgattttgcaactattattgacctaacagtataatagttatcgtgtacgttcggacaagggaccgagggtggacagtacaaacgactgtaggctcgacactacg

SEQ ID NO: 158583 - DNA, 534 bp, Homo sapiens
  misc_feature: GYAE6OF02IRJMX.16.4.A04.1.454.CMB.1.raw
  modified_base (261)..(261): a, c, t, g, unknown or other
  misc_feature (261)..(261): n is a, c, g, or t
  modified_base (327)..(327): a, c, t, g, unknown or other
  misc_feature (327)..(327): n is a, c, g, or t
  modified_base (338)..(338): a, c, t, g, unknown or other
  misc_feature (338)..(338): n is a, c, g, or t
tcagtgtactactccacgaccggtgctcgatttagagtagtgatcagggggaggtcagactcagtcaggacacagcatggacagtgagggtccccgctcagctcctggggctcctgctgctctggctcccaggtgccaaatgtgacatccagatgacccagtctccttccaccctgtctgcatctgtaggagacagatcaccatcgcttgccgggccactcagagtgttagcaggtggttggcctggtatcagcagaaacngggaagccctgaactctgatcatgatgccagcagtttgaaagtggggccatcaagattcagcgganagtgatgaganagtagtcactcacacatcacgcacgctcgcacgcgtgtagtagtattacgtactaacttattacttacgtacctaactaagtaattaattaagttacgtacgtacggtacgtacggtacggtaacggacggtaacggtacggtacgtaacgtaacgtaacgtaacgtacggtacggtacgtacgtacgtacgtacg

SEQ ID NO: 158584 - DNA, 480 bp, Homo sapiens
  misc_feature: GYAE6OF02GLT0K.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttgccgggccactcagagtgttagcaggtggttggcctggtatcagcagaaaccagggaaggcccctgaactcctgatctatgatgccagcagtttgaaaagtggggtcccatcaagattcagcggcagtggatctgggacagagttcactctcaccatcagcagcctgcagcctgatgattttgcaacctattattgccaacagtataatagttatccgtgacgttcggcaagggaccagggtggacatacaacgaactggtggctgcactac

SEQ ID NO: 158585 - DNA, 486 bp, Homo sapiens
  misc_feature: GYAE6OF02IMGUV.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttgccgggccactcagagtgttagcaggtggttggcctggtatcagcagaaaccagggaaggcccctgaactcctgatctatgatgccagcagtttgaaaagtggggtcccatcaagattcagcggcagtggatctgggacagagttcactctcaccatcagcagcctgcagcctgatgattttgctaacctattattgaccaacagtataatagttatccgtgacgttcggccaagggaccgagggtggacaatacaaacgactagtggctgcactacg

SEQ ID NO: 158586 - DNA, 500 bp, Homo sapiens
  misc_feature: GYAE6OF02HN8YW.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttgccgggccactcagagtgttagcagtggttggcctggtatcagcagaaaccagggaaggcccctgaactcctgatctatgatgccagcagtttgaaaagtggggtcccatcaaagattcagcggcagtggatctgggacagagttcactctcaccatcagcagcctgcagcctgatgattttgctaacctattattgaccaacagtaataatagttactcgtaggacgttcggacctaagggaccgaagggtcggacgaataccgaaacgaacgtcggtggactgcacctac

SEQ ID NO: 158587 - DNA, 469 bp, Homo sapiens
  misc_feature: GYAE6OF02G5SP2.16.4.A04.1.454.CMB.1.raw
  modified_base (449)..(449): a, c, t, g, unknown or other
  misc_feature (449)..(449): n is a, c, g, or t
  modified_base (468)..(468): a, c, t, g, unknown or other
  misc_feature (468)..(468): n is a, c, g, or t
tcagtgtactactccacgaccggtgctcgatttagagtagtgatcaggggagtcagactcagtcaggacacagcatggacatgagggtcccgctcagctcctgggctcctgctgctctggctcccaggtgccaaatgtgacatccagatgacccagtctccttccaccctgtctgcatctgtaggagacagagtcaccatcgcttgccgggcactcagagtgttagcaggtggttggcctggtatcagcagaaaccagggaaggcccctgaactcctgatctatgatgccagcagtttgaaaagtggggtcccatcaagattcagcggcagtggatctggggacagagttcactctcaccatcagcagcctgcagcctgatgtatttgcaacctattattgccaacagtataatagttatcgtgacgttcgacaaggccgagggtgacntacaacgatgtgctgcacnc

SEQ ID NO: 158588 - DNA, 516 bp, Homo sapiens
  misc_feature: GYAE6OF02HMVOO.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttgccgggccactcagagtgttagcaggtggttggcctggtatcagcagaaaccagggaagcccctgaactcctgatctatgatgccagcagtttagaaagtggggtccatacaagattcagcggcagtggatcgtggacagagtcactctacaccatcagcagctgcagcctgatgtatttgactaactattatacgacctaacagttaataattaagttatccgtaggtacgttcggaccgaagggaccgtaaggggtacggaacaacgtaccgaaacggtaacgtggtacggctacgacaccgtacg

SEQ ID NO: 158589 - DNA, 510 bp, Homo sapiens
  misc_feature: GYAE6OF02HQE9L.16.4.A04.1.454.CMB.1.raw
  modified_base (352)..(352): a, c, t, g, unknown or other
  misc_feature (352)..(352): n is a, c, g, or t
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttgccgggccactcagagtgttagcaggtggttggcctggtatcagcagaaaccagggaacggccctgaactcctgatctatgatgccagcagtttgaaaagtggggtacccatcaagattcagcggcagtggatcgtgggacagngttcactctcaccatcagcagcctgcagcctgatgattttcgactaaccttattattcgacctaactagtaattaattagttaactcgtaggtacgttcggaccgtaagggaccgtagggtcgacgactacgaaacgacgtaggtggactgcactacg

SEQ ID NO: 158590 - DNA, 477 bp, Homo sapiens
  misc_feature: GYAE6OF02FTFQC.16.4.A04.1.454.CMB.1.raw
tcagtgtactactccacgaccggtgctcgatttagagtagtgatcaggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttgccgggccactcagagtgttagcaggtggttggcctggtatcagcagaaaccagggaaggcccctgaactcctgatctatgatgccagcagtttgaaaagtggggtcccatcaagattcagcggcagtggatctgggacagagttcactctcacatcagcagcctgcagcctgatgattttgctaacctattattgccaacagtataatagttatcgtgacgttcgccaagggaccagggtggacatacaacgaactgtggctgcactac

SEQ ID NO: 158591 - DNA, 525 bp, Homo sapiens
  misc_feature: GYAE6OF02JBL4L.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttgccgggccactcagagtgttagcaggtggttggcctggtatcagcagaaaccagggaaggcccctgaactcctgatctatgatgccagcagtttgaaagtggggtcccatcaagattcagcggcagtggatcgtgggacagagttcactctcacccatcagcagcctgccagcctgatgattttcgactaacctattattcgacctaaacgagttaataagtatttagtaccgttagacgttacggaccgaacgggtaccgtagggtacggacgaagtaccgaaaacgtacttaggtacggtactgaccaccgtacg

SEQ ID NO: 158592 - DNA, 524 bp, Homo sapiens
  misc_feature: GYAE6OF02JS4BA.16.4.A04.1.454.CMB.1.raw
  modified_base (261)..(261): a, c, t, g, unknown or other
  misc_feature (261)..(261): n is a, c, g, or t
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttgccgggccactcagagtgttagcaggtggttggcctggtatcagcagaaaccngggaaggcccctgaactcctgatctatgatgccagcagtttgaaaagtggggtcccagtcaagattcagcggcagtggatctgggacagagttcactctcaccatcagcagcctgcagcctgaatgattttgactaacctattattcgacctaactagtataattagtttatccgttaggtacgttccggacctaaggggtacccaggggttacggaactacgtacgaaacggtaacgttggtcggactacggaccacctacg

SEQ ID NO: 158593 - DNA, 517 bp, Homo sapiens
  misc_feature: GYAE6OF02GFM28.16.4.A04.1.454.CMB.1.raw
  modified_base (349)..(349): a, c, t, g, unknown or other
  misc_feature (349)..(349): n is a, c, g, or t
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttgccgggccactcagagtgttagcaggtggttggcctggtatcagcagaaaccagggaaggcccctgaactcctgatctatgatgccagcagtttgaaagtggggtccatcaagattcagcggcagtggatcgtgggacagngttcactctcaccatcagcagcctgcagcctgatgattttgactaacctattattcgacctaactagttaattaattagttatccggtaggtacgttaccggaccgtaaggggaccgtaaggggtacgaacgaagttacgaaacgtacgtggtggctcgacacctacg

SEQ ID NO: 158594 - DNA, 528 bp, Homo sapiens
  misc_feature: GYAE6OF02I4UPC.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttgccgggccactcagagtgttagcaggtggttggcctggtatcagcagaaaccagggaaggcccctgaactcctgatctatgatgccagcagtttagaaagtggggtacccatcaagattcagcggacagtggatcgtgggacagagttcactctcaccatcagcagcctgcagcctgatgattttgactaacctattacttgaccaactagtaataattagtttaataccgttaggtaccgttacgggacctaacggggaccgtagggggtacgtaacgaataccgaaacgtaacgtcggtaggacctagaccacctacg

SEQ ID NO: 158595 - DNA, 549 bp, Homo sapiens
  misc_feature: GYAE6OF02HYYV9.16.4.A04.1.454.CMB.1.raw
  modified_base (325)..(325): a, c, t, g, unknown or other
  misc_feature (325)..(325): n is a, c, g, or t
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttgccgggccactcagagtgttagcaggtggttggcctggtatcagcagaaaccagggaaggcccctgaactcctgatctatgatgccagcagtttgaaaagtggggtacccatcaagnttacagcggcagtggatcgtgggacaggagttcactctcaccatcagcagcctgcagcctgatgtattttcgactaaaccttattacttcgacctaactaagttaattaagttagtttaactccggttagggtaccgtttccggaccgtaacggggacccgaagggggttacggaacgtaactacgaaaacgtacgttggtacgggactacggaccacctaacg

SEQ ID NO: 158596 - DNA, 515 bp, Homo sapiens
  misc_feature: GYAE6OF02I9NZT.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttgccgggccactcagagtgttagcaggtggttggcctggtatcagcagaaaccagggaaggcccctgaactcctgatctatgatgccagcagtttgaaagtggggtcccatcaagattcagcggcagtggatcgtgggacagagttcactctcaccatcagcagcctgcagcctgatgtattttgactaacctattattcgaccaatagtaataattagttatccggttaggtacgttcggaccgtaagggacccgtaggggtcggaactagtaccgaaacgtacgtggtacggctaggccacgtacg

SEQ ID NO: 158597 - DNA, 519 bp, Homo sapiens
  misc_feature: GYAE6OF02IZ9DM.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttgccgggccactcagagtgttagcaggtggttggcctggtatcagcagaaaccagggaaggcccctgaactcctgatctatgatgccagcagtttagaaaggtcggggtccatcaagattcagcggcagtggatcgtgggacagtagtcactctcaccatcagcacgcctgcacgcctgtatgtattttgactaaccttattacttgaccaactagtattaattagttatcgtgtacgttcggacgtaacgggaccgtagggtcggaactacgtaacgaaacgaacgtggtacggacgtacgcctacctacg

SEQ ID NO: 158598 - DNA, 545 bp, Homo sapiens
  misc_feature: GYAE6OF02F7ZA1.16.4.A04.1.454.CMB.1.raw
tcagtgtactactccacgaccggtgctcgatttagagtagtgatcaggggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttgccgggccactcagagtgttagcaggtggttggcctggtatcagcagaaaccagggaacggcccctgaactcctgatctatgatgccagcagtttagaaaagtggggtaccatcaagattcgagcggcagtggatcgtgggacagagttcactctcaccatcagcagcctgcagcctgatgtattttcgactaaccttattattcgaccaactagtaataagttagtttaactccggttaggtaccggtttaccggaccgtaacggggaccgtaaggggtacggaacgtaacgttaccgaaacgtacgtacggtaggacgtacggaccaccgtacg

SEQ ID NO: 158599 - DNA, 516 bp, Homo sapiens
  misc_feature: GYAE6OF02I0569.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttgccgggccactcagagtgttagcaggtggttggcctggtatcagcagaaaccgagggaaggcccctgaactcctgatctatgatgccagctagtttaggaaaggtcggggtacccagtcaagtattcgagcggacaggtggatcgtggacaggtagttcactctcaccatcagcagcctgcagctgatgtatttgacctacttattatcgacctaatatataatagtttacgtcgttaggtaccgttacggaccgtaagggaccgtagggtagacgatacgaaacgacgtggtcggctcgacactacg

SEQ ID NO: 158600 - DNA, 545 bp, Homo sapiens
  misc_feature: GYAE6OF02HEEON.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttgccgggccactcagagtgttagcaggtggttggcctggtatcagcagaaaccagggaaggcccctgaactcctgatctatgatgccagcagtttgaaagtggggtcccatcaagattcagcggcagtggatctgggacagagttcactctcaccatcagcagcctgcagcctgatgtattttgactaaccttattattcgacctaaactagttaattaaattacgtttaagtccggttagggtaccgttcgggaccgtaacggggaccgtaaggggtacggaacgtaacgttaccgaaacggtaacgttcggtacggtaccgtaggacctacctacg

SEQ ID NO: 158601 - DNA, 558 bp, Homo sapiens
  misc_feature: GYAE6OF02HK0ER.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttgccgggccactcagagtgttagcaggtggttggcctggtatcagcagaaaccagggaaggcccctgaactcctgatctatgatgccagcagtttagaaagtcggggtccatcaagattcagcggcagtggatcgtgggacagagttcactctcaccatcagcacgcctgccagccctgactgtattttacgactaactattattacgaccaactagtaattaattaagtttacgtaccggtacgggtaccgttaccgggaccgtaaacgggtaccggtaggggtacggtaacctaacgttaccgaaaacggtaacgttacgggtacggtaccgtacgaccgtaccgtacg

SEQ ID NO: 158602 - DNA, 485 bp, Homo sapiens
  misc_feature: GYAE6OF02IBB4O.16.4.A04.1.454.CMB.1.raw
  modified_base (371)..(371): a, c, t, g, unknown or other
  misc_feature (371)..(371): n is a, c, g, or t
tcagtgtactactccacgaccggtgctcgatttagagtagtgatcaggggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttgccgggcactcagagtgttagcaggtggttggcctggtatcagcagaaaccagggaagcccctgaactcctgatctatgatgcagcagttgaaaagtggggtccatcaagattcagcggcagtggatcgtggacagagttcactctcacatcagcagctgcngctgatgtatttgctaactattattgaccaactaagttataattagttactcggtgtacgttcggacgaagggacgagggtgacactacgaacgactggtaggactgaccatac

SEQ ID NO: 158603 - DNA, 623 bp, Homo sapiens
  misc_feature: GYAE6OF02JHPHH.16.4.A04.1.454.CMB.1.raw
  modified_base (279)..(279): a, c, t, g, unknown or other
  misc_feature (279)..(279): n is a, c, g, or t
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttgccgggccactcagagtgttagcaggtggttggcctggtatcagcagaaccagggaacgccctagaactcngatctatgatcgccagctagtttagaaaggttcggggtcccatcaagatcagcggcagtggatcgtgggacaggtacgttcacttctacgacctatacgaagccgaagtcctgtccgaacgtcccgttggaacttgttaacgttttcgaacttaaccttagtttaacttacgaccctaaaccgttaagttaacttaaagttacgttttaaacgtacccggttaagggtaccgtttaccgggacccgtaaacggggtacccggtaagggggtacgtaaccgtaacgtaaccgtaaaaccggaacgtttacggttacggaccggttacggtacctaaccgttacgg

SEQ ID NO: 158604 - DNA, 510 bp, Homo sapiens
  misc_feature: GYAE6OF02HXGHO.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttcaccctgtctgcatctgtaggagacagagtcaccatcgcttgccgggccactcagagtgttagcaggtggttggcctggtatcagcagaaaccagggaaggcccctgaactcctgatctatgatgccagcagtttgaaaagtggggtcccatcaagattcagcggcagtggatctgggacagagttcactctcaccatcagcagcctgcagcctgatgattttgctaaacctattattcgaccaaactagtaataattagttaatccgtggtacgttcggaccgaagggacccgaaggggtcggaacaagtaccgaaacgaacttggtaggctagccacctacg

SEQ ID NO: 158605 - DNA, 480 bp, Homo sapiens
  misc_feature: GYAE6OF02F3M44.16.4.A04.1.454.CMB.1.raw
  modified_base (410)..(410): a, c, t, g, unknown or other
  misc_feature (410)..(410): n is a, c, g, or t
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttgccgggccactcagagtgttagcaggtggttggcctggtatcagcagaaaccagggaaggcccctgaactcctgatctatgatgccagcagtttgaaaagtggggtccatcaagattcagcggcagtggatcgtgggacagagttcactctcaccatcagcagcctgcagcctgatgattttgctaactattattgaccaanagtataatagttatcgtagacgttcggcaagggacagggtgacatacgaaacgactggtcgctgcactac

SEQ ID NO: 158606 - DNA, 515 bp, Homo sapiens
  misc_feature: GYAE6OF02IVTAN.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttgccgggccactcagagtgttagcaggtggttggcctggtatcagcagaaaccagggaaggcccctgaactcctgatctatgatgccagcagtttagaaaaggtggggtacccatcaagattcagcggcaggtggatcgtagggacaggtacgttcacctctccaccctatcagcagcctgcacgcctgatgtatttgacctaacttattatcgaccaatagtataatagttatccgtaggtacgttcggactaacgggacgtaggggtacgactataccgaaacgactggtcggactcgacactacg

SEQ ID NO: 158607 - DNA, 547 bp, Homo sapiens
  misc_feature: GYAE6OF02GH6C7.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttcgccgggccactcagagtgttagcaggtggttggcctggtatcagcaagaaaccgaggggaacgcccctagaacctcctgatctatgatcgccagcgtagtttaggaaaaggtcggggtacccatacaagattcagcggacagtggatcgtgggacaggagttcactctacacctatcagcacgcctgacacgcctagtattgttattttcgacttaacgttattattcgaccctaatagttaattaagttacgttactcggtaggtacgttaccggacgaacgggacgtaggggacgacgaatacgaaacgtacgtggtacggcgtacgaccactacg

SEQ ID NO: 158608 - DNA, 576 bp, Homo sapiens
  misc_feature: GYAE6OF02JR8V6.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttgccgggcactcagagtgttagcaggtggttggcctggtatcagcagaaaccgagggaacggcccctgaactcctgatctatgatcgccagctagtttagaaaggtcggggtacccagtcaagtattcagcggacagtggatcgtgggacaggtagttcactctacacatcagcagcctgcacgcctgatgtatttagactaaccgtatttaacttcgaaccctaaacgtacgttaattaagttacgtttaacgtccggttaggtaccggttacggaccgtaacggggtaccgtaacggggttagtaaccgtaacgttaccgtaaaacggtacgttacggtacggtacctacgggtacctacccttaag

SEQ ID NO: 158609 - DNA, 522 bp, Homo sapiens
  misc_feature: GYAE6OF02JHXP5.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttgccgggccactcagagtgttagcaggtggttggcctggtatcagcagaaaccagggaagcccctgaactcctgatctatgatgccagcagtttgaaaagtggggtcccatcaagattcagcggcagtggatcgtgggacaggagttcacttctacaccatcagcagcctgcacgcctgactgtacttttgactaacctattacttcgacctaacgtagttaataattagttatccggtaggtacgttcggaccgaagggaccgaggggtcgaactacgtacgtaaacgacgttggtcggacgtagaccactacg

SEQ ID NO: 158610 - DNA, 533 bp, Homo sapiens
  misc_feature: GYAE6OF02GA46E.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttgccgggccactcagagtgttagcaggtggttggcctggtatcagcagaaaccagggaacggcccctgaactcctgatctatgatgccagctagtttagaaaaggtggggtacccatacaagattcgagcggacaggtggatcgtgggacagagttcactctcacatcagcagcctgcagcctgatgtattttgactaaccttattacttgacctaactaagttaattaagttagttactccggttacgggtaccgttcggaccgaacgggaccgtaggggtacgaactactaacgaaacgtacgtggtacggctcgacctactac

SEQ ID NO: 158611 - DNA, 504 bp, Homo sapiens
  misc_feature: GYAE6OF02FPOW3.16.4.A04.1.454.CMB.1.raw
  modified_base (279)..(279): a, c, t, g, unknown or other
  misc_feature (279)..(279): n is a, c, g, or t
  modified_base (399)..(399): a, c, t, g, unknown or other
  misc_feature (399)..(399): n is a, c, g, or t
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttgccgggccactcagagtgttagcaggtgttggcctggtatcagcagaaaccagggaagcccctgaactccngatctatgatgcagcagtttgaaagtggggtccatcaagattcgagcggcagtggatcgtgggacagtagtcactctcaccatcagcagcctgcagcctgatgtattttgactaaccttnttatcgacaactagtataattagttatacgtggtacgttcggacgtaagggaccgagggtacggactaagtaccgaaacggacgttggtacggctcgaccactac

SEQ ID NO: 158612 - DNA, 566 bp, Homo sapiens
  misc_feature: GYAE6OF02J18VH.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttgccgggccactcagagtgttagcaggtggttggcctggtatcagcagaaaccagggaagcccctgaactcctgatctatgatgccagcagtttgaaaagtcggggtaccatcaagattcagcggcagtggatcgtgggacagagttcactctacacatcagcagctgcagcctgatgtattttcgactaaaccgttatttagttcgacctaaactaagttaacttaaagttacgttaacttcccggttagggtaccggtttaccgggacccgtaacggggtacccggtaaggggttacggaactaacgttaccgaaaacggtaacgttaggtacggtacgtacggacctaaccgtacg

SEQ ID NO: 158613 - DNA, 576 bp, Homo sapiens
  misc_feature: GYAE6OF02IIAXE.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttgccgggccactcagagtgttagcaggtggttggcctggtatcagcagaaaccagggaaggcccctgaactcctgatctatgatgccagcagttgaaagtggggtccatcaagattcagcggcagtggatcgtgggacagagttcactctacaccatcagcagcctgcagcctgactgtacttttgacctaaaccgttatttaattcggaccctaaactaagttaattaaattagtttaacgttccggttagggtaaccggtttccgggacccgtaaacggggtacccgtaaggggttacggaaccgtaacgttaccgaaaaaccggtaacgttagggtaccggtacgtacggacccgtaacctaaccg

SEQ ID NO: 158614 - DNA, 502 bp, Homo sapiens
  misc_feature: GYAE6OF02HQDJO.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttgccgggccactcagagtgttagcaggtggttggcctggtatcagcagaaaccagggaaggcccctgaactcctgatctatgatgccagcagtttgaaaagtggggtcccatcaagattcagcggcagtggatcgtgggacaggagttcactctcaccatcagcagcctgcagcctgatgattttgctaactattattgaccaacagtataattagttatccgtaggtacgttcggaccgaagggaccgagggtacggacagtaccgaaacgtaactcggtggctgacacctacg

SEQ ID NO: 158615 - DNA, 561 bp, Homo sapiens
  misc_feature: GYAE6OF02GW42S.16.4.A04.1.454.CMB.1.raw
  modified_base (352)..(352): a, c, t, g, unknown or other
  misc_feature (352)..(352): n is a, c, g, or t
tcagtgtactactccacgaccggtgctcgatttagagtagtgatcagggggagtcacgaactcagtcaggacacagcactcggacatgagggtccccgctcagctcctggggctcctgctgctctggctcccaggtgccaaatgtgacatccagatgacccagtctccttccaccctgtctgcatctgtaggagacagagtcaccatcgcttgcccgggccactcagagtgttagcaggtggttggcctggtatcgagcaagtaaaccgaggggaacggccccgtagacgtccgtgatctatgatgccagctaggtttagaaacggttcgggacccatcaagattcagcganagtggatcgtggacagtagttcactctacacatcagcacgcctgctagccgtagattacgtatttcgaccttaaccttactttactccgtacctaacgtagttaacttaagttacgttacgtaccggtaggtaccgttacggaccgaagggtacccgtagggtacgacgtagtaccgaacgtaacgtggtacgcgtcgacctacctacg

SEQ ID NO: 158616 - DNA, 481 bp, Homo sapiens
  misc_feature: GYAE6OF02I63GT.16.4.A04.1.454.CMB.1.raw
  modified_base (404)..(404): a, c, t, g, unknown or other
  misc_feature (404)..(404): n is a, c, g, or t
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtcttcatctgtaggagacagagtcaccatcgcttgccgggccactcagagtgttagcaggtggttggcctggtatcagcagaaaccagggaaggcccctgaactcctgatctatgatgcagcagttgaaaagtgggtcccatcaagattcagcggcagtggatctgggacagagttcactctcaccatcagcagcctgcagcctgatgattttgcaacctattatgcaanagtataatagttatcgtgacgttgaccaggaccagggtggacatacaaacgaacgtagtaggactgacaccgattcg

SEQ ID NO: 158617 - DNA, 756 bp, Homo sapiens
  misc_feature: GYAE6OF02G4YC4.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttgccgggccactcagagtgttagcaggtggttggccgtaggtactacgacgacgaacgaaccggaagggaccgtcccgtagaacccttcgtagacttactagtagtacgtacgaccgagtacgttaaggtttaaggtaaacgggttccgggtacctactaacgtaagttacttaccgacggccggtacgtagggtacggtacgttacgggtacgggtaacgtaacggtacgtttaccgtaaccgttaccgtaccctaacccgtacgttaacgaacgtaccgtaccggtaccgttacggaccgtaccgtccgtaggtacgtttacgtttaacgtttccgaaccctttaacccgtttaagtttacgttaccgtaacccgtaaagttacgtttaaacttaacgtttaacgtttaccggttacggttaaccgggttaccggttacccgggaaccgggtaacgggtaccgggtaaggggttaccgtaaccgtaacgtaacccggtaaacggtaccggttacgggtaccggtaccggtacgtaccctacgtaccg

SEQ ID NO: 158618 - DNA, 588 bp, Homo sapiens
  misc_feature: GYAE6OF02IIK2L.16.4.A04.1.454.CMB.1.raw
  modified_base (392)..(392): a, c, t, g, unknown or other
  misc_feature (392)..(392): n is a, c, g, or t
tcagtgtactactccacgaccggtgctcgatttagagtagtgatcagggggagtcagactcagtcaggacacagcatggacatgagggtcccgctcagctcctggggctcctgctgctctggctcccaggtgccaaatgtgacatccagatgacccagtctccttccaccctgtctgcatctgtaggagacagagtcaccatcgcttggccggccactcgagagtgttagcaggtggttggcctggtatcagcagaaaccgagggaacgcccctgaacctctagatcgtatgatcgccagcagttagaaagtggggtccatcaagattacagcggactagtagatcgtggacgagagttcactcgtacacatcgacgtcagcctgcagtccngactgtattttcgactaaccgttattacgtttacgacctaaacgacgttaaattaacgtaagtttacgtaccggttagggtaaccgtttccgggacccggaaaacgggttaccggtaaacggggttaggtaaccgggtaaactaccggaaaacggttaacggtacgtacgggttacctagacccgtaactaaccgg

SEQ ID NO: 158619 - DNA, 551 bp, Homo sapiens
  misc_feature: GYAE6OF02FWKL5.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttgccgggccactcagagtgttagcaggtggttggcctggtatcagcagaaaccaggggagcccctggaactcctgatctatgatgccagcagtttagaaaagtggggtcccatcaagattcgagcggacaggtggatcgtagggacagtagttcactctcacatcagcagcctgcagcctgatgtatttcgactaacctattacttcgacctaaatagttaattaagttagttaactccggttaggtaccgtttacgggaccgtaaaggggaccgtaaggggtacgaacgtacgtaaccgaaaacggtaacgttcggtacggtacctacggtaccaccgtaacg

SEQ ID NO: 158620 - DNA, 598 bp, Homo sapiens
  misc_feature: GYAE6OF02H4TXZ.16.4.A04.1.454.CMB.1.raw
  modified_base (342)..(342): a, c, t, g, unknown or other
  misc_feature (342)..(342): n is a, c, g, or t
tcagtgtactactccacgaccggtgctcgatttagagtagtgatcaggggggagtcagactcagtcaggacacagcatggacatgagggtccccgctcagctcctggggctcctgctgctctggctcccaggtgccaaatgtgacatccagatgacccagtcctcccttccaccctgtctgcatctgtaggagacagagttaccatcgcttcggccgggccactcagagtgttagcagggtggttggcctggtatcagacagaaacagggaacgccctgaactctgatctatgatgccagctagtttaggaaaagtcgggtacccatacaagattcgagcgnagtgatcgtggacagtagttcatctcacatacagcagtcctgacacgtcctagaacttgttaatttcgaactaaccttattaattcgtaacctaaactagttaaattaaagttaagtttaacgtccggtaggttaaaccgttcgggtaacccgaaggggtaacccgggtaggggtacggaaaccgtagttaaaccggtaaaaccgtaacgggtttcggtacggtaccgttaccgggacctaaccgttatttacccg

SEQ ID NO: 158621 - DNA, 530 bp, Homo sapiens
  misc_feature: GYAE6OF02GVVAS.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttgccgggccactcagagtgttagcaggtggttggcctggtatcagcagaaaccagggaaggcccctggaactcctgatctatgatgccagctagtttgaaaaggtggggtcccagtcaaagtattcgagcggcaggtggatcgtgggacaggagttcactctaccacctatacagcagcctgccagcctgatgtatttgctaactattatcgacctaactagttaataattacgttactccggttaggtaccgttacgggaccgtaaggggaccgagggtacggacaacgtacgaaacgtactggtaggctcgactacctacg

SEQ ID NO: 158622 - DNA, 537 bp, Homo sapiens
  misc_feature: GYAE6OF02JN0UI.16.4.A04.1.454.CMB.1.raw
  modified_base (398)..(398): a, c, t, g, unknown or other
  misc_feature (398)..(398): n is a, c, g, or t
  modified_base (521)..(521): a, c, t, g, unknown or other
  misc_feature (521)..(521): n is a, c, g, or t
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcacatcgcttgccgggccactcagagtgttagcaggtggttggcctggtatcgagcagaaaccgagggaacggcccctgaactcctgatctatgatgccagcagtttagaaaggtcggggtaccatacgaagattcgagcggcgagtggatcgtagggacagtagttcactctacacctatcacgcacgctgcagcctagntgtactttgacctaacttattacttcacctaatagtattaattagttaactccggtaggtaccgttccggacgtaacgggaccgtagggtacggacgtaataccgaaacgtacgtggtacggntacggtaccacctacg

SEQ ID NO: 158623 - DNA, 580 bp, Homo sapiens
  misc_feature: GYAE6OF02HQ67I.16.4.A04.1.454.CMB.1.raw
  modified_base (191)..(191): a, c, t, g, unknown or other
  misc_feature (191)..(191): n is a, c, g, or t
  modified_base (245)..(245): a, c, t, g, unknown or other
  misc_feature (245)..(245): n is a, c, g, or t
  modified_base (401)..(401): a, c, t, g, unknown or other
  misc_feature (401)..(401): n is a, c, g, or t
tcagtgtactactccacgaccggtgctcgatttagagtagtgatcagggggagtcagactcagtcaggacacagcatggacatgagggtccccgctcagctccgtggggctcctgctgctctggctccaggtgccaaatgtgacatccagatgacccagtcctccttccaccctgtctgcatctgtagganacagagtcacatcgcttgccggcactcagagtgttagcgaggtggtggctgtancagcaagaacgagggaacgccctagaactctgactctatgatgccagctaaggtttaggaaaggtcggggtaccagtacaagtagttacgaggcggacgtaaggtggattcggtagggacaggtacgtcacgttcacactatcgagcagcctgacngtcctagtatgtagtttacgacttaacttattattacgactaatagttaacttaagttaacgttacgtaccgtacggtaccggttaccggaccggaacgggtaccggtaacggggtacgaacgtaacgtaacccgtaaacggtacgttacggtcggtacgtaccgtacgtacccttacg

SEQ ID NO: 158624 - DNA, 496 bp, Homo sapiens
  misc_feature: GYAE6OF02HO7KU.16.4.A04.1.454.CMB.1.raw
  modified_base (418)..(418): a, c, t, g, unknown or other
  misc_feature (418)..(418): n is a, c, g, or t
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttgccgggccactcagagtgttagcaggtggttggcctggtatcagcagaaaccagggaaggcccctgaactcctgatctatgatgccagcagtttagaaaagtggggtccatcaagatcagcggcagtggatcgtgggacagtagttacactcctcaccatcagcagcctgcagcctgatgattttgactaaccttattattcgacctaanagtaattaatagttatcgtagtacgtcgacgaaggaccgagggtcgacagtacgaaacgtactggtgactgcactacg

SEQ ID NO: 158625 - DNA, 512 bp, Homo sapiens
  misc_feature: GYAE6OF02FZEB4.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttgccgggccactcagagtgttagcaggtggttggcctggtatcagcagaaaccagggaaggcccctagaactcctgatctatgatgccagcagtttagaaaagtggggtacccatcaagattcagcggcagtggatcgtgggacagagttcactctcaccatcagcagcctgcagcctgatgtatttcgactaactattactgaccaatagtaataattagttatcgtggtaccgttcggaccgaagggtaccgagggtacgaactacgtacgaaacgtactaggtacggactcggaccactacg

SEQ ID NO: 158626 - DNA, 526 bp, Homo sapiens
  misc_feature: GYAE6OF02HJCPP.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttgccgggccactcagagtgttagcaggtggttggcctggtatcagcagaaaccgagggaacggcccctgaactcctgatctatgatgccagcagtttagaaaaggtggggtcccatcaagattcgagcggcagtggatcgtgggacagtagttcactctcacatcacgcacgcctgcagcctgatgtattttcgactaaccttattatcgacctaactagttaataattacgttatccggtaggtacgttcggaccgtaagggaccgtaagggtcgaactaacgtacgaaacgtacgtaggtcggcgtacgacactacg

SEQ ID NO: 158627 - DNA, 649 bp, Homo sapiens
  misc_feature: GYAE6OF02FX8IZ.16.4.A04.1.454.CMB.1.raw
tcagtgtactactccacgaccggtgctcgatttagagtagtgatcaggggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttcggccgggccactcaggagtgttagcaggtggttggcctggtatcagcaagaaaccgaggggaacggcccctagaacctccgtgatctatgatcgccaggctagttttaggaaaaggttcgggggtaccaagtacgtaagtacttacgagcggactaggtggatcgtagggactaacggtagttccaacgttctaccaacctataccgacgcacgtccgtagccgtacgtccgtagacgttgttactttcggaccttaaactttacttacttacgaaccctaatacgttaaattaacgttaagtttaaccgttccggttaagggttaaccgttccgggaccgtaaacggggtacccggtaaggggtaaccgtaaccgtaaggtaaaccgtaaaaccggtaccgttacgggtaggtaccgtacggtacccaccgttaacgg

SEQ ID NO: 158628 - DNA, 620 bp, Homo sapiens
  misc_feature: GYAE6OF02GBBFA.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttggccgggccactcagagtgttagcgtaggtggttggcctggtatcagcaagaaaccgagggaacgcccctagactctgatctatgatcgaccagacgtaggtttaggaaaacgggttcggggtacccaagtacgaagtattcgaggcggacgaggtaggatcgtagggactaggtagttaccactcctacacctactacagcgacgtccgtagacgtacgcgtgtattagttacttttcgaccttaaacctttagtttacgtacgaacctaaacgtagttaaacttaatttaacgttacgtaccggtaagggttaccgttaccgggaacgtaacggggtaaccggtaggggtaacgtaacgtaaacgtaccgaaacgtacggttcggtaggtacgtccgtacgtaacctacg

SEQ ID NO: 158629 - DNA, 548 bp, Homo sapiens
  misc_feature: GYAE6OF02HQ2K3.16.4.A04.1.454.CMB.1.raw
  modified_base (190)..(190): a, c, t, g, unknown or other
  misc_feature (190)..(190): n is a, c, g, or t
  modified_base (222)..(222): a, c, t, g, unknown or other
  misc_feature (222)..(222): n is a, c, g, or t
  modified_base (347)..(347): a, c, t, g, unknown or other
  misc_feature (347)..(347): n is a, c, g, or t
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtagganacagagtcaccatcgcttgccggccactcagngtgttagcaggtggttggcctggtatcagcagaaaccagggaagcccctgaactcctgatctatgatgccagcagtttagaaagtggggtccatcaagattcagcggcagtggatctgggacagngttcactctcaccatacagcagcctgcacgcctagtatcgtatttttcgactaaccttattattcgtacctaacctaagttaattaattaacgttacgttccggttaggttaccgggttacggaccgtaacgggaacccgtaaggggtacggacgtaagtaaccgaaacggtaactcggtacggtctacggaccactaacg

SEQ ID NO: 158630 - DNA, 558 bp, Homo sapiens
  misc_feature: GYAE6OF02JE9NE.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttggccgggccactcagagtgttagcaggtggttggcctggtatcagcagaaacccgagggaacggcccctggaaacctcctagatctatgatgccagctaagtttaggaaaagttcgggggtaccagtacaagattcgagcggacagtggatcgtgggacaggtatcgactctacaccatcacgcacgctacgcgaacgcctgactgtactttgactacctatttatcgactaactagtattaattagttagtaccgttaggtacgttccggtacgaacgggtaccgaaggggttacgaaccgtacgttaacgtaaaccggaagttcggtaggtctacgactaccgtaacg

SEQ ID NO: 158631 - DNA, 677 bp, Homo sapiens
  misc_feature: GYAE6OF02HTALF.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttgccgggcactcagagtgttagcaggtggttggcctggtatcagcagaaaccagggaacggcccctagactcctgatctatgatcgccagtcgtaagtttaggaaaacggttcgggggtacccaagtactaaagtacttccgacgggtcggcgtaagggtggtaacgtcgtacggggacgaggtacgtttaccaccttccttacaaccctatacccgaagccgaacggtccctacggccaacggtccttaggtaatttggtacgttttacggaccttaaacccgttatttaacgtttaccggaacctaaacgtaacgttaagttaaacgttacgtttaacgtaccggttacgggttaaccggttccgggaacccggtaacggggtaacccggtaaggggttaccggaaccgtaacggtaaccgaaaccggtaacgttacgggtacgggtctaccgtaccgtaccctaacg

SEQ ID NO: 158632 - DNA, 569 bp, Homo sapiens
  misc_feature: GYAE6OF02GYL42.16.4.A04.1.454.CMB.1.raw
  modified_base (456)..(456): a, c, t, g, unknown or other
  misc_feature (456)..(456): n is a, c, g, or t
tcagtgtactactccacgaccggtgctcgatttagagtagtgatcaggggggagtcagactcagtcaggacacagcatggacatgagggtccccgctcagctcctggggctcctgctgctctggctcccaggtgccaaatgtgacatccagatcgacccagtctccttccaccctgtctgcatctgtaggagacagagtcaccatcgcttcgccggccactcagagtgtagcgtaggtggttggcctggtatcgagacgaagaaaccgagggaacgcccctagacctcgtgactctatgtatcgacagtacgtaggttaaggaaacggttcgggtacccagtacaagtactcgaggtcggacgtaggtagtagtcggtagggaactaggtacgttctacgtctaccacctatcagcacgtcctgtcacgtctagtatagtatttcgactaaccttnttactcgacagtattaataattagttacgtacgtaggtaccgttacggacgtaagggaccggtagggtacgaacgtaacgtaacgtaacgtacgtggtcgactcgacctactc

SEQ ID NO: 158633 - DNA, 524 bp, Homo sapiens
  misc_feature: GYAE6OF02F80NG.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttgccgggccactcagagtgttagcaggtggttggcctggtatcagcagaaaccagggaaggcccctgaactcctgatctatgatgcagcagtttgaaagtgggtccatcaagattcagcgcagtgatctggacagagtcactctacaccatcagcagcctgcagcctgatgtattttgactaaccttattattcgacctaacagttaataagttagttattaccggtggtaccgttccgggaccgaagggacccgtaagggtaggaactacgtaaccgaaacgaacgttcggtaggtacctacggacctaacctacg

SEQ ID NO: 158634 - DNA, 551 bp, Homo sapiens
  misc_feature: GYAE6OF02HYVSF.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttgccgggccactcagagtgttagcaggtggttggctggtatcagcagaaaccagggaacggcccctgaactcctgatctatgatgccagctaggtttagaaaaggtggggtacccatcgaaagtattcaggcggacaggtggatcgtagggacaggagttcactctacaccatcagcagcctgcacgctgatgtattttcgacctaacctattattacgacctaaacgtaagtaattaattaacgtttaacgtccggttaggtaccggttcggaccgtaacggggaccggagggttacggaactaagtaaccgaaacgtacgttggtaggacctgaccacgtac

SEQ ID NO: 158635 - DNA, 518 bp, Homo sapiens
  misc_feature: GYAE6OF02HU6X3.16.4.A04.1.454.CMB.1.raw
  modified_base (417)..(417): a, c, t, g, unknown or other
  misc_feature (417)..(417): n is a, c, g, or t
tcagtgtactactccacgaccggtgctcgatttagagtagtgatcaggggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcacatcgcttgccgggccactcagagtgttagcaggtggttggcctggtatcagcagaaaccagggaacgccctgaacctctgatctatgatgccagctagtttagaaagtcggggtaccatacaagattacgagcggcagtggatcgtggacagagttcactctacaccatcagcagctgcagcctgatgtatttgactaacttattattcgactaanagtaataattagttactcgtaggtacgttcggaccgaagggaccgagggtacggactaagtaacgaaacgtaacgttggtacggtactacgacaccgtacg

SEQ ID NO: 158636 - DNA, 483 bp, Homo sapiens
  misc_feature: GYAE6OF02FGY65.16.4.A04.1.454.CMB.1.raw
  modified_base (475)..(475): a, c, t, g, unknown or other
  misc_feature (475)..(475): n is a, c, g, or t
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttgcccgggccactcagagtgttagcaggtggttggcctggtatcagcagaaaccaggggaaggcccctgaactcctgatctatgatgccagcagtttagaaagtggggtccatcaagattcagcggcagtggatcgtgggacagagttcactctcaccatcagcagctgcagcctgatgtatttgctaactattattgctaacagtataattagtatcgtgacgttcgacgaagggacgagggtgaactagtacaaacgactggtggntgcactac

SEQ ID NO: 158637 - DNA, 583 bp, Homo sapiens
  misc_feature: GYAE6OF02F6WKR.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttgccgggccactcagagtgttagcaggtggttggcctggtatcagcagaaaccagggaacggcccctgaactcctgatctatgatgccagcagtttagaaagtgggtccatcaagattcagcgcagtggatcgtgggacagagttcactctcacatcagcagcctgcagcctgactgtatttcgactaacctattacttcgacctaacgtaagttaattaagttaacgttaacgtacccggttagggtaaccggtttaccgggtaccgtaaacgggggtacccgtaagggggttacggtaaaccgtaacgttaacccgtaaaaccggtaacgttacgggtaccgggtaccgttacggtacccgtaacccgttaacg

SEQ ID NO: 158638 - DNA, 585 bp, Homo sapiens
  misc_feature: GYAE6OF02FPPUA.16.4.A04.1.454.CMB.1.raw
  modified_base (281)..(281): a, c, t, g, unknown or other
  misc_feature (281)..(281): n is a, c, g, or t
  modified_base (384)..(384): a, c, t, g, unknown or other
  misc_feature (384)..(384): n is a, c, g, or t
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttgcccgggccactcagagtgttagcaggtggttggcctggtatcagcagaaaccagggaaggcccctgactccngatctatgatgccagcagtttagaaaaggtcggggtaccatacaagtattcagctgcagtggatcgtagggacagtagtcactctcaccatcagcagcctgcngcctgattgtattttcgacctaaccttattacttacgaccctaacttaagtaacttaaagttacgttaacgttaccggttgggtaaccgtttaccgggaacccggtaacgggggaacccggtaagggggtacggtaaccgtacgttaaccggaaaacggttacggttacgggttacgggaccgttacggaccgtaaccccg

SEQ ID NO: 158639 - DNA, 575 bp, Homo sapiens
  misc_feature: GYAE6OF02FSZ0G.16.4.A04.1.454.CMB.1.raw
  modified_base (252)..(252): a, c, t, g, unknown or other
  misc_feature (252)..(252): n is a, c, g, or t
tcagtgtactactccacgaccggtgctcgatttagagtagtgatcaggggggtaggtcagactcagtcaggacacagcatggacatgagggtccccgctcagctcctggggctcctgctgctctggctcccaggtgccaaatgtgacatccagatgacccagtctcccttccaccctgtctgcatctgtaggagacagagtcaccatcgcttgccgggccacgtcagagtgttagcaggtgtgctaggtatnagcagaacgagggaaggcccctagaacctcctgatctatgatcgcagctagtttagaaaggttcggggtaccagtacaagtattcgagcggacaggtggatcgtagggacagagttcactctacaccatcagcagcctgcacgcctagtatgtatttacgactaaccttattacgtacgactaactagttaactaacgttacgttaccgtccggttacgggtaccggttaccgggaccgtaacggggaccggtacggggtacgaaccgaacgttaaccgtaaaccggtaacgttcggtaccggtacacgtaccgtaccgtacg

SEQ ID NO: 158640 - DNA, 557 bp, Homo sapiens
  misc_feature: GYAE6OF02HHM0R.16.4.A04.1.454.CMB.1.raw
tcagtgtactactccacgaccggtgctcgatttagagtagtgatcaggggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttgccggccactcagagtgttagcaggtggttggcctggtatcagcagaaacgagggaacggcccctagaactcctgactctatgatcgccagctagttagaaaggtcgggtaccatcgaagtattcgaggcggctaggtggatcgtagggacaggtagttcactctaccacctatacgagctacgcctgacacgtcctagattgtatttcgactaacttattacttacgacctaagtaagttaattaagttacgttagtccggttaggtacgttccggacgtaacgggtaccgaagggtcgaacgtaacgtaccgaaacggtacgtaggtcggtctcgacctacctacg

SEQ ID NO: 158641 - DNA, 714 bp, Homo sapiens
  misc_feature: GYAE6OF02HPFAT.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctactctggctcccaggtgccaaatgtgacatccagatgacccagtctccttccaccctgtctgcatctgtaggagacagagtcaccatcgcttgccgggccactcagagtgttagcaggtggttggcctggtatcagcagaaaccgaggacgcccctgaacctctgatctaatgatgccgagctagtttagaaaaggttcgggtaccccatacgaagtacttcgaaggcggacgaggtggattccggtaggggactaggtacgttaccactaccgtaccaacctacgtacaggtacccacggtcccttacggacctaaccggtcccgttaggtacgtttacgtttacgtttttacggaacccttaaaccgttttaactttacgttaaccggaaacccttaaaccggttaagtttaaacgtttaaacgttttaacgtttaaccgttacccgggttaacgggtaacccggtttaccggggaacccggtaaacgggggtaacccgtaacgggggttaacggaaaccgttaacgtaaacccgtaaaccggtaacggttacggtacggtacccgttaggaccccttaccgtaacgttttcccgg

SEQ ID NO: 158642 - DNA, 509 bp, Homo sapiens
  misc_feature: GYAE6OF02FTKTL.16.4.A04.1.454.CMB.1.raw
  modified_base (369)..(369): a, c, t, g, unknown or other
  misc_feature (369)..(369): n is a, c, g, or t
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttgccgggccactcagagtgttagcaggtggttggcctggtatcagcagaaaccagggaaggcccctgaactcctgatctatgatgccagcagtttgaaaagtggggtacccatcaagattcagcggcagtggatctgggacagagttcactctcaccatcancagcctgcagcctgatgtattttgacctaacgttattattgacctaactagttaataattagttatccgttaggacgttcggacctaagggacctagggtcggactagtacaaacggactggtacggctcgacacgtacg

SEQ ID NO: 158643 - DNA, 537 bp, Homo sapiens
  misc_feature: GYAE6OF02FXRMQ.16.4.A04.1.454.CMB.1.raw
  modified_base (340)..(340): a, c, t, g, unknown or other
  misc_feature (340)..(340): n is a, c, g, or t
  modified_base (374)..(374): a, c, t, g, unknown or other
  misc_feature (374)..(374): n is a, c, g, or t
  modified_base (531)..(531): a, c, t, g, unknown or other
  misc_feature (531)..(531): n is a, c, g, or t
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttgccgggcactcagagtgttagcaggtggttggcctggtatcagcagaaaccagggaaggcccctagaacctcctagatctatgatgaccagcagtttgaaaaggtggggtacccatacaagattcgagcggnagtggatcgtgggacagagttcactctcacctancagcagcctgcagcctgattgtattttagtaaccttatttattcgacctaatagttaattaaattagttataccggtaggtaaccgttcgggaccagggtaaccgaggggtagaacgtacgtacggaacgtaacgtggttacggcgtacgcctactnttaccg

SEQ ID NO: 158644 - DNA, 643 bp, Homo sapiens
  misc_feature: GYAE6OF02GR7J3.16.4.A04.1.454.CMB.1.raw
tcagtgtactactccacgaccggtgctcgatttagagtagtgatcaggggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttgccggccactcagagtgttagcgaggtggttggccgtggtatcgagacaagaaaccgagggaacggcccctagaacctccgtgacttctagtgatcgacaggtctaggttagaaacggtcggggtacctatacgaagtatcgagcggtacaggtggactcggtagggacaggtacgttaccacgttctaccaacctactacgacgcctacggtcctacggaccgtacgtccgttagtacgttgttacgttttacgaacctaaccttttaagttacgttaccggaacctaaacgtaacgttaaactttaagttacgtttaacgtaccggttagggtaccgttaccgggaccgtaacggggaccggtaaggggtacgaaccgtaacgtaaccgaaaacggtacgttacggtacggtacgtcggtaccgaccttacg

SEQ ID NO: 158645 - DNA, 612 bp, Homo sapiens
  misc_feature: GYAE6OF02HDDB1.16.4.A04.1.454.CMB.1.raw
  modified_base (429)..(429): a, c, t, g, unknown or other
  misc_feature (429)..(429): n is a, c, g, or t
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttgccgggccactcagagtgttagcaggtggttggcctggtatcgagcaagaaaccgagggaacggcccctgaacctctgatctatgatgccagctaggttagaaaaggtggggtacccagtcaaagtattcgagcggcagtggatcgtgggacaggattcactctacaccatcagcacgcctgcgagtcctagacgttagtacttttgaacctaaacctttnttaacttcgaaccctaaatacgtttaaattaagttacgttaagttcccggttagggtaacccgtttcggggaaccctaagggggtacccgtaacggggggttacggaaccgtaaaggttaacccaaaaacgggttaacgtacgggttacggtacccggttaagggtaccctaacccttaacgg

SEQ ID NO: 158646 - DNA, 528 bp, Homo sapiens
  misc_feature: GYAE6OF02GV42F.16.4.A04.1.454.CMB.1.raw
  modified_base (511)..(511): a, c, t, g, unknown or other
  misc_feature (511)..(511): n is a, c, g, or t
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcacatcgcttcgccggccactcagagtgtagcgaggtggttggcctggtatcagcaagaaacagggaacgccctagaactcctgatctagtgatcgcagtctaggttagaaaggtcgggtaccagtacaaagtattacgacgcgatacggtggatcgtaggacagtacgttacacgtctacaccatacagcagcctgcacgctagatcgttattgactaacttattatacactaactagtaataatacgttactcgtagtaccgttacgacgaggacggtaggtacgaactaagtaacgaaacgtagtacggtnacgtacgacgacctacg

SEQ ID NO: 158647 - DNA, 670 bp, Homo sapiens
  misc_feature: GYAE6OF02IJW4Z.16.4.A04.1.454.CMB.1.raw
tcagtgtactactccacgaccggtgctcgatttagagtagtgatcaggggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttgccgggcactcagagtgttagcaggtggttggctggtatcagcaagaaacgagggaacgcccctagaacctcctgactctatgatcgccagctaaggtttagaaaaggtcggggtacccagtacaagtacttacgagcggactaggtggactcgtagggaactaggtacgttaccacgttcctacaccacttacgaacgcctaggccctagccgacggccttagtaatttcggtacgtttttacgaaccttaaacctttattttaacgttacggaaccctaaacgtaacgtttaaattaaacgtttacgtttaacggttacccggttaggggttaacccgttttaccgggacccgtaaacgggggtacccggtaacggggggttacggaaaccgtaacggttaacccgaaaacgggtacgttacgggtacgggtaccgtacggtaccctaaccggttaacg

SEQ ID NO: 158648 - DNA, 582 bp, Homo sapiens
  misc_feature: GYAE6OF02HES6P.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttggcccgggccactcagagtgttagctaggtggttggcctggtatcgagcaagaaacccgagggaacggcccctgaacctcctgatctatgatgccagctaggtttaggaaaaggtcggggtacccagtacaagtattcaggcggcgaggtggacgtcgtagggacagtagttcctactctacaccatcgacgcacgcctgcacgcctagtattagtattttcgacctaactttattacgttacgacctaagtaagttaataattagtttaacgtccggttagggtaccgttacggacccggtaacgggtaccggtagggtacgaaccgtaagtaaccgtaaacggtacgtggtcggactacggacctacgtacg

SEQ ID NO: 158649 - DNA, 546 bp, Homo sapiens
  misc_feature: GYAE6OF02G33J4.16.4.A04.1.454.CMB.1.raw
  modified_base (223)..(223): a, c, t, g, unknown or other
  misc_feature (223)..(223): n is a, c, g, or t
  modified_base (281)..(281): a, c, t, g, unknown or other
  misc_feature (281)..(281): n is a, c, g, or t
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttgccgggccactcagngtgttagcaggtggttggcctggtatcagcagaaacccagggaagcccctgaactccngatctatgatgccagcagtttagaaagtcggggtccatcaagattcagcgcgagtggatcgtagggacaggtagttccactctccactactcagcacgcctcgacacgcctagattacgtattttcgactacctttattacttcgaccaactacgtaattaattacgtttacttccggttaggtaccgttacggaccgtaacgggccgtaaggggtacggaactaacgtacctaaacggaactggtacggctacgctacctaacg

SEQ ID NO: 158650 - DNA, 604 bp, Homo sapiens
  misc_feature: GYAE6OF02GL5D7.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttgccgggccactcagagtgttagcgaggtggttggcctggtatcagacaggaaaccagggaacggcccctaggaacctctgatctatgatgccagacagtttagaaaagtcggggtacccatcaagtattcgagcggacaggtggactcgtagggacaggtagttcactctacaccatcagcagcctgcacgcctgtacgtgttactttacgacctaacctttattacttacggaccctaaacgtagttaaacttaagtttaacgtttaacgtccggtttaggtaccgggtttcggaccggtaacggggacccgtaaggggtacggtaacgtaaccgttaaccggaaaccggtaccggttacgggtacgggtaccgtcggtacccgtaccttaacgg

SEQ ID NO: 158651 - DNA, 681 bp, Homo sapiens
  misc_feature: GYAE6OF02G6RW5.16.4.A04.1.454.CMB.1.raw
  modified_base (190)..(190): a, c, t, g, unknown or other
  misc_feature (190)..(190): n is a, c, g, or t
  modified_base (309)..(309): a, c, t, g, unknown or other
  misc_feature (309)..(309): n is a, c, g, or t
  modified_base (377)..(377): a, c, t, g, unknown or other
  misc_feature (377)..(377): n is a, c, g, or t
  modified_base (420)..(420): a, c, t, g, unknown or other
  misc_feature (420)..(420): n is a, c, g, or t
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtagganacagagtcaccatcgcttgccgggccactcagagtgttagcgtaggtggttggccttgggtattcgagcgaacgaaaccgaggggaaccggcccctggaacccttccgtgattctatgntcgccagcctagttagaaaggtcggtacctagactaagtacttacgaggtccggacgtaggtacggtntcggtacgggacaggttacgttccgaacttcctacgaaacctntaccgaagccgagtcccgtcgacacggtccgtagtaacgttagttacttttacgacctttaaacttaacgttttacgttaccgtaaaccctaacgtaagtttaaacttaaacgtttaacgtttaccgttacgggtttaaccggtaccgggttacccggaaccggtaaacggggacccgggttaaggggaaccggtaactaaccggtaaccgtaaaaggaacccgtttggaccggttccctacggtacccgtacgttaaccg

SEQ ID NO: 158652 - DNA, 643 bp, Homo sapiens
  misc_feature: GYAE6OF02HR4I0.16.4.A04.1.454.CMB.1.raw
tcagtgtactactccacgaccggtgctcgatttagagtagtgatcagggggagtcagactcagtcaggacacagcatggacatgagggtccccgctcagctcctggggctccctgctgctctggctcccaggtgaccaaatgtgacatccagatgacccagtcctccttcccaccctgtctgcatctggtaggagacagagtccaccatccgcttcggcccggccactcgagtagttgttagcgagggtggttaggccgtggtatcgagcaagaaccgagggacgcccctgaacctcctgacttacgtatgagtcgccagtcgtagtttaaggaaaggtcggggtacccatactaagtattcgagcggcgaggtggactcggtagggaacagtacgttcacgttctacaccatccgagcacgcctcgacacgtcccgtagtagttagttagttttacgaacttaacctttactttacttaccgtaacccgtaaactaagtttaaattaagttaacgttttaacgtacccggttaaccgggttaccggttaccgggtaccggtaacgggtaccggtagggttaccggaacgtaacgtaaccgaaacgtacggtacggtacggtacgtaccggacctaccgtacg

SEQ ID NO: 158653 - DNA, 728 bp, Homo sapiens
  misc_feature: GYAE6OF02JOJ2U.16.4.A04.1.454.CMB.1.raw
tcagtgtactactccacgaccggtgctcgatttagagtagtgatcagggggagtcagactcagtcaggacacagcatggacatgagggtccccgctcagctccgtggggctcctgctgctctggctcccaggtcgccaaatgtgacatccagatcgacccagtcctcccttccaccctgtctgctatctgtaggagacagagtccaccatccgcttcgccggccactcgagagttgttacgcgtagggttggttcggccgttaggtactcgacgaccgaacggaaaccgaggggaacggtcccctagtaacctccgtagactacgtagtcgacgtcgaccgagtacgtaacggtttaaggaaacgggttccgggtacctagttacgaaacgtacgttacggaacggccggtacgtaagggttacggtaacggttacggtacggggaacgtaacggtacgttaccgtaaccgtccgtaaccaccgtaacgtcgaacgtccgacgtccgtacgaccgtaccggtaccgttgtaacgttacgtttaacgtttaccgacttaaaaccgttctttaacgtttccgaaccgttaacgttaaagttaaactttaacgttacggtttaacgtccggttaacggtaccggttaccggaccgtaacgggaccgttaaggggtactaacggtaacgtaaccgaacggtaacgttcggaacgtcgtacgacctacgtacg

SEQ ID NO: 158654 - DNA, 712 bp, Homo sapiens
  misc_feature: GYAE6OF02II7MI.16.4.A04.1.454.CMB.1.raw
tcagtgtactactccacgaccggtgctcgatttagagtagtgatcagggggagtcagactcagtcaggacacagcatggacatggacgggtccccgctcagctccgtggggctcctgctgctctggcctcccgaggtcgaccaaatcgtgactatccagatcgaccctagtcctcccttccaccctgtctgcattcgtggtaggacacgagacgtcacactcgcgttcggcccggcacgtcaggtaggttgtagcgtagggttcggttcggcgttaggtactcgacgacgaaacggaaaccggtacggggaaccggtcccctaggtaccttccgtagtactcgtatcggtactcgccagtacgttaggttaacggtaaacggtccgggtacctaagtacgtaacgtacttacggacggcgacgtaggtacggtacgtcggtaaggacgtaacggtacgttctacgtccacgtaaccgtagtacgtacgacgtcgtaccgtacgcgtacgtcttacgtagtttacgtacttttaaccgacttaacctagtttacgacctaaccgtaaagtaatttaacgtaaacgttacgttaccggttacggtcggttaaccggttcggaaccggtaacgggttaccggtaacgggttacaaccgtaaacgtaacggtaacgttacggtacggtccgggttaactccggtacctacgttacg

SEQ ID NO: 158655 - DNA, 534 bp, Homo sapiens
  misc_feature: GYAE6OF02JBNUR.16.4.A04.1.454.CMB.1.raw
  modified_base (190)..(190): a, c, t, g, unknown or other
  misc_feature (190)..(190): n is a, c, g, or t
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtagganacagagtcaccatcgcttgccgggccactcagagtgttagcaggtggttggcctggtatcgagcagaaaccgaggggaacggcccctgaacctcctagatctatgatgccagcagtttagaaaggtcggggtacccatacaagtattcgagcggacaggtggatcgtgggacagagttcactctacacatcagcagcctgctagcctgattgtatttcgactaaccgtattcttagacctaagtataattaagttacgttatccggtaggtacgttacggaccgaagggaccgtaggggtacgaagtactaacgaaacgtactggtcgacttcgacctactacg

SEQ ID NO: 158656 - DNA, 529 bp, Homo sapiens
  misc_feature: GYAE6OF02HWUWQ.16.4.A04.1.454.CMB.1.raw
  modified_base (291)..(291): a, c, t, g, unknown or other
  misc_feature (291)..(291): n is a, c, g, or t
  modified_base (395)..(395): a, c, t, g, unknown or other
  misc_feature (395)..(395): n is a, c, g, or t
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttgccgggccactcagagtgtagcaggtggttggcctggtatcagcagaaaccgagggaacgcccctgaacctcctgatctatgntgccagctagttgaaagtgggtaccatcaagattcacgcggcagtggatacgtaggacagtacgtcactctacaccatcagcagcctgcagcctgatgtatttnactaccttattatacgacctaactagttaataattgtttaacgtccggttaggtaccgttagggacccgtaagggaccgtaggggtacgaactaagtaccgaaacgacgtaggtcgacgtcgaccgtacctacg

SEQ ID NO: 158657 - DNA, 594 bp, Homo sapiens
  misc_feature: GYAE6OF02H4LBX.16.4.A04.1.454.CMB.1.raw
  modified_base (398)..(398): a, c, t, g, unknown or other
  misc_feature (398)..(398): n is a, c, g, or t
tcagtgtactactccacgaccggtgctcgatttagagtagtgatcaggggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcacatccgcttgccgggccactcagagtgttagcgaggtggttggcctggtatcgagcaggaaaccagggaacggcccctgaactcctgatctatgatgccagctagttagaaagtcggggtcccatcaagacttacaggcggcagtagatcgtaggacagtagtcacttctacaccatcagcagcctgcacgtcctagntgtatttgacctaaccttatttaacgtcgtaccaaacgtagttaagtaactttaacggttactaacccggttcgggtaaccgtttacccgggacccggtaacggggtaacccggtaggggttacggtaaccgaacggtttaaccgaaaaccggtacgttagggtaccggtaccggtacgtacccgtaccttaaccg

SEQ ID NO: 158658 - DNA, 725 bp, Homo sapiens
  misc_feature: GYAE6OF02IHXYV.16.4.A04.1.454.CMB.1.raw
  modified_base (223)..(223): a, c, t, g, unknown or other
  misc_feature (223)..(223): n is a, c, g, or t
tcagtgtactactccacgaccggtgctcgatttagagtagtgatcgagggggagtcagactcagtcaggacacagcatggacatgagggtccccgctcagctcctggggctcctgctgctctggctcccaggtgccaaatgtgacatccagatcgacccagtctccttccaccctgtctgcatctgtaggagacagagtcaccatcgcttgccggcactcagngtgttagcgaggtggttggcctggtatcgagacaagaaaccgagggacgcccctagtaactcctgtatctatgtatgccagtctagtttaggaaaacggtcggggtaccctagtacgtaacgtacttcgaacggcggacgtaaggttacgggtattcggtacggggaacgtaggtaacggtttacctaaccgttcctacccgtaaccgtacgtaccgaacggacctaacggtcccgttacggaccctaggtacccgtagtaacgtttacgttaacgttttacggacccttaaaccgtttaaacgttttacgtttaaccgtaacccttaaaacgtaagtttaaacgtttaaacgtttaacggtttaacgttacccggtttacgggtaacccgggtttaccgggaacccgtaaacggggtacccggaagggggttacggaaaccgttaacgtaacccgaaaacggttaccgttaggtccgggactacggtacccaccgttaacg

SEQ ID NO: 158659 - DNA, 529 bp, Homo sapiens
  misc_feature: GYAE6OF02FWLQQ.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttgccgggccactcagagtgttagcaggtggttggcctggtatcagcagaaaccagggaaggcccctgaactcctgatctatgatgccagcagtttgaaagtggggtccatcaagattcagcggcagtggatcgtgggacaggagttcactctacacatcagcagcctgcagcctgatgtatttgactaaccttattacttgaccaactagttaattaacttagtttacgtccgttaggtacgttccggaccgtaacggggaccgtaaggggtacggtacgagttaccaaacggtacgtaggtacggactcggacctactacg

SEQ ID NO: 158660 - DNA, 613 bp, Homo sapiens
  misc_feature: GYAE6OF02IMAEY.16.4.A04.1.454.CMB.1.raw
  modified_base (401)..(401): a, c, t, g, unknown or other
  misc_feature (401)..(401): n is a, c, g, or t
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatcgacccagtcctccttccaccctgtctgcatctgtaggagacagagtcaccatcgcttgccggccactcagtagtgttagcgtaggtggttggctggtatcagcagaaccgaggacgccctagactctagactctatgatcgccgagtctaggtttaggaaacggttcgggtaccagtacgaagtacgtacgagcggtagagtggatcgtacgggacagtacgttcactcctacacctactacacgacncgaccgtcgacacgtaccgtagtagttacgttacgtttacgaaccgtaacctttagtttacgttaccgtacctaaacgtaacgttaaattaacgttaacgtttacgttaccggtacggttaaccgttaccggaccgtaacgggtaccgtagggtaccgacgtaacgtaacgtaaccgtacgttacggtacggtacgttacgacctacctacg

SEQ ID NO: 158661 - DNA, 544 bp, Homo sapiens
  misc_feature: GYAE6OF02IT4XE.16.4.A04.1.454.CMB.1.raw
tcagtgtactactccacgaccggtgctcgatttagagtagtgatcaggggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttgccgggccactcagagtgttagcaggtggttggcctggtatcagcaagaaaccgaggggaacggcccctagaactcctgatctatgatgccagctaggtttaggaaaaggtggggtacccagtcaagtattcaggcggctaggtggtagtcgtgggacagtacgttcactctcaccatacagcagcctgcagcctagtattgtatttgacctaacttattactcgacctaactacgttaataattagttaacgtccggttagtaccgttacggacgaacgggacgtagggtagactaacgacgaaaccgtacgtgtacggtctacgaccactacg

SEQ ID NO: 158662 - DNA, 615 bp, Homo sapiens
  misc_feature: GYAE6OF02HD6YL.16.4.A04.1.454.CMB.1.raw
  modified_base (339)..(339): a, c, t, g, unknown or other
  misc_feature (339)..(339): n is a, c, g, or t
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtcctgcatctgtaggagacagagtcaccatcgcttggcccggccactcagagtgtagcaggtggttggcctggtatcgagcgaagaaaccgaggggaacggccccgtagaacctccgtgatctatgatgccagctagtttagaaaggtcgggtaccatcgaagtntacgagcggacgtagtgacgtcgtagggtacaggtactcgacttcgacaccatcacgcacgtctcgacacgccgtagagttgttactttccgacttaacctttagttacgttaccgtacctaaagtacgtttaataacgtttacgtttaacgttccggtacgggttaccgttaccggggaccgtaaacggggtcccggtaagggggttacgtaaacgtaacgttaacccgaaacggtaccggtttgggtaccggacggtacctaccgtacttaccg

SEQ ID NO: 158663 - DNA, 657 bp, Homo sapiens
  misc_feature: GYAE6OF02GLRXS.16.4.A04.1.454.CMB.1.raw
  modified_base (191)..(191): a, c, t, g, unknown or other
  misc_feature (191)..(191): n is a, c, g, or t
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaagganacagagtcacatcgcttgccggcactcagagtgtagcaggtggttggcctggtatcagcaagaaccgagggaacgccctagaactcctagatctatgatcgaccagctaaggtttaggaaaaggttcggggtaccatacaaagtattacgagcggacgaggtggactcgagggactaggtagttaccacgtctaccgaaccactacgacgtacgacgtcccgtgaccgtaacgtcccgttaggtaagttacgttttacgtttacgtaacccttaaaccgttttaagtttaacgtttaccgaaccttaaacgtaaacggtttaaattaaagttttaacggtttaaccgtaccggtttaacgggtaaccggttaacccgggtaccggtaacggggtaacccggtaaggggtaccgtaaacgtaacgtaaccgtaaacggtacgtacggtcgacttcgaccgtactacg

SEQ ID NO: 158664 - DNA, 741 bp, Homo sapiens
  misc_feature: GYAE6OF02FJJX6.16.4.A04.1.454.CMB.1.raw
  modified_base (184)..(184): a, c, t, g, unknown or other
  misc_feature (184)..(184): n is a, c, g, or t
  modified_base (311)..(311): a, c, t, g, unknown or other
  misc_feature (311)..(311): n is a, c, g, or t
tcagtgtactactccacgaccggtgctcgattagagtagtgatcagggggagtcagactcagtcaggacacagcatggacatgagggtccccgctcagctcctgggctcctgctgctctgctcccaggtgccaaatgtagacatccagactgaccccagtctcccttccaccctgtctgcatcngtaggagacagactcaccagtcgcttcgacccggtccacgtcacgtagttgttagcgagggttggttcgcccgtggtactcacggccaaggaaacccgagggaaccggtccccctataacctcctanactactacttgaactcgtccagtcctaaggtttacgaaacggttcggggtacctagtaacgagtacttacgacgtcggtacgaaggttcggtactccggtacgggactacggtaccgtttaccacccttcctaacctacccgaatccgaacgcgtacccgccttacgaaccgtcctaccggtaggttaccttacggtttactttacccgaaccttaaaccctttagtttaacggttacccaaacccgttaaacgttaaacgtttaaacttaaacggttttaaccggtaaccgttacccgggtaagggttacccccgggtaccggtaaccggtaaacccgggtacccggtaaggggtaccctaaacccgtaacgtaacccggaaaccgtaacggtcgtaaccggtccgtaacgtacccctaccgtttaccg

SEQ ID NO: 158665 - DNA, 617 bp, Homo sapiens
  misc_feature: GYAE6OF02FW7LO.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttgcccgggccactcagagtgttagcaggtggttggcctggtatcagcaagaaaccgagggaacggcccctagaactcgtgatctatgatcgcagcgtagtttaggaaaaggtcgggggtacccagtacgaagtagttacgacggcggacgaggtcggactcgtaggggactaggtacgttaccactcctaccaacctactcgaagccacgcccgtgccgtacgccctagtacttagtacttttacgacctaacctttattaacgttcgacctaaactagttaattaagttacgtttacgtaccggttagggtaccgttacggaccgtaacggggtacccggtaaggggtacgtaaccgtaacgttacgaaaccgttacgtaggtacggacgttacggacctaccgttacg

SEQ ID NO: 158666 - DNA, 611 bp, Homo sapiens
  misc_feature: GYAE6OF02HJ6XC.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctcccttccaccctgtctgcatctgtaggagacagagtcaccatcgcttgccgggccactcagagtgttagcaggtggttggctggtatcagcagaaaccagggaacgccctagaacctctgatctatgatcgccagtctaggtttaggaaaggtcggggtacctatacgaaagtattcgaggcgacgaggtcggatcgtaggggactaaggtagttccactcgtaccacctactaccagcacgtcctacgccgacgtcctaggtattacggtatttttcgaccttaaccgttaacttacgttacgaaccctaaagtaagttaaattaacgttagtttaaccgtaccgtacgggttaccgttaccgggacccgtaagggacccggtaaggggtccggaaactacgttaacgaaacgtacgttagggtacggtacgtacgaccacgttaccg

SEQ ID NO: 158667 - DNA, 643 bp, Homo sapiens
  misc_feature: GYAE6OF02HHP46.16.4.A04.1.454.CMB.1.raw
  modified_base (223)..(223): a, c, t, g, unknown or other
  misc_feature (223)..(223): n is a, c, g, or t
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttgccgggccactcagngtgttagcaggtggttgcctggtatcagcaagaacgagggacggccctgaactctgactctatggactgcctagacgtagttagaaaggtcggggtacctagtacaagtattacgaggacgtcaggtggacgtcgtagggactaggtacttccacttacacctaacgactaccgacgtccgagtcccgtcgaccgacgtcccgttagtaacgtttcgttaacgttttcaaccgttaaacctttagtttaacgtacgaacctaaacgtaacgttaagttaaacgttaacggttacgttcggttacgggtaaccgtttcccggggaaccgttaaccggggtaccggtaagggtcggaaaccctagtaaacccggtaaacggtaacgtttcgggtaccggtccgtacggtacccaccgttacg

SEQ ID NO: 158668 - DNA, 684 bp, Homo sapiens
  misc_feature: GYAE6OF02IW7WG.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtccaccatcgctgccggccactcagagtgtagctaggtggtggccgtgtatcgagcaacgaaaccgagggaacggcccctagtaacctcctgtattcgtagtagagtcgacctagctaagttaggaaacgtcggggtacccagtaccgtaagtactacgacggtcggacgtacggttggtaacgttcggtacggggtaactacggtacgttcctaacgttccgtacctaaccgtagtacgtacggaccgtacgttccgtacgaccgtacgtaccgtgtaacgttcgttacgttttacctacccgttaaaccgtttagttaccgttaccgtaaccgttaaaccttaaggttaaacttaacgttacgttttaccgtaaccgggttacggtaaccggtttcccgggaccggtaaccgggtacggtacggggtacgtaaccgtaacgttaaccgtaaacggtacgtcggtagtaccgtcgtaccgtactacg

SEQ ID NO: 158669 - DNA, 583 bp, Homo sapiens
  misc_feature: GYAE6OF02INVLP.16.4.A04.1.454.CMB.1.raw
  modified_base (286)..(286): a, c, t, g, unknown or other
  misc_feature (286)..(286): n is a, c, g, or t
tcagtgtactactccacgaccggtgctcgatttagagtagtgatcaggggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcacatcgcttgccggcactcagagtgtagcgtaggtggttggcgtggtatcagcaagaaaccgagggaacgcccctagaacctctagntactagtgatgcagcgtagtttagaaaggtcggggtaccagtacgaagtatcgaggcggacgaggtggactcggtagggacagtacgttcactctacactactacagcacgtcctacggctacggtctaggttaagtgttacgtttacgaccttaaccgtatttacttacgacctaaacgtagttaacgtaagtttagttacgtaccggtacgggtaccgttacggaccgtaacggggtaccgagggtacggaactaagtaaccgaagtacggtgtcgtacgacgtacctacgtacg

SEQ ID NO: 158670 - DNA, 559 bp, Homo sapiens
  misc_feature: GYAE6OF02FUU8Q.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttgccgggccactcagagtcgttagcaggtggttggcctggtatcagcagaaaccgagggaacggcccctgaactctgatctatgatgcagcagtttagaaagtggggtaccagtacaagattcgagcggcagtggatcgtgggacgagagttttttacactcgtcaccatacagcgagcctcgcacggcctagactgtatttgactaaccttattacttcgaccaacgagttaactaattaagttaacttaccgttacggtacggttccggacgtaacgggtacggtaagggtacggtacgtaagtacgaaacggtacgttacggtacggtaccgtcggtacctaccgtacg

SEQ ID NO: 158671 - DNA, 551 bp, Homo sapiens
  misc_feature: GYAE6OF02FWDGZ.16.4.A04.1.454.CMB.1.raw
  modified_base (190)..(190): a, c, t, g, unknown or other
  misc_feature (190)..(190): n is a, c, g, or t
  modified_base (279)..(279): a, c, t, g, unknown or other
  misc_feature (279)..(279): n is a, c, g, or t
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtagganacagagtcaccatcgcttgccggcactcagagtgttagcaggtggttgctggtatcagcagaaaccgagggaacgcccctgaacttccngatctatgatgcagcagtttagaaagtgggtaccatacaagattcagccgcagtggatcgtgggacaggtacttcactctccacctatctagctacgcctagcacgcctagtacttgttactttacgactaaccttattattacgacctaactagttaattaatacgtttactcggttacgtaccgttacggacccgtaaaggaccggtaagggtacgtaacctaacgtaaccaaacggttactcggtaggtaccgtacggtaccaactacg

SEQ ID NO: 158672 - DNA, 839 bp, Homo sapiens
  misc_feature: GYAE6OF02G5CFC.16.4.A04.1.454.CMB.1.raw
  modified_base (180)..(180): a, c, t, g, unknown or other
  misc_feature (180)..(180): n is a, c, g, or t
tcagtgtactactccacgaccggtgctcgatttagagtagtgatcagggggagtcagactcagtcaggacacagcatggacatgagggtccccgctcagctccgtgggctcctgctgctctggctcccaggtgaccaatgtgacatccagatcgacccagtcctccttccaccctgtccngctatctgtagagacagagtccacctatccgtcgttcggcccggcctacgtcgagtagtggttacgcgtagggttggttacggccgttgggtactacggaacgtaccgtaaacggaaacccggtaacgggggaaaccggtcccccttaacggtaaacccttcccgttaggtaaccgttacgttaagtacggtactcggaccgtaacgttaccgtaaagggttttaacggaaaaccgggttccggggtaaccctaaggttaacccgaaaggttaacgttccggaacgggtaccgtacgaacgggtacgtacgttcgggtacggtaacgtacggttacgtccgtactacccgtaaccacgtacgttacgaacggtcaaccgtcgacgtacctacggtaccgtaggtaacgtttcgtttaacgttcgtaaccgttaacgtttacgttacgtaacccgtaaccgttaacgttaaacgttaagttttaaaccgttaacggtttacccggttaacccgggttaagggttaccccgggttaacccgggttacgggtaaacccggggtaacgttaccggggttaaaccgtaaccggttaacgttaaacccgtaaaccggttccgttacggtaaccggttcggtaaccggtaccctacgtttaaccgg

SEQ ID NO: 158673 - DNA, 641 bp, Homo sapiens
  misc_feature: GYAE6OF02II5RP.16.4.A04.1.454.CMB.1.raw
  modified_base (488)..(488): a, c, t, g, unknown or other
  misc_feature (488)..(488): n is a, c, g, or t
tcagtgtactactccacgaccggtgctcgatttagagtagtgatcaggggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcacatcgcttcgcccgggcactcagtgtgttagcgaggttggttcggccgtggtatcagacaacggaaacgacgggaacgacccctgtaacctcctgtactctagtgatcgcagtcgtaaggtttaggaaaacggttcggggtaccctaagtcgtaaagtacttacgtacgggccggactaggtggtacgtacggtaggacgtaggtacgttaccgaccttccgactacctagtacacgacgacgtcgtacgcgacgtcctaggtatcgttattttcgacttaaaccgtnttaacgttcgtaacctacgttaaagttaacttaaacgttcgtttaccgtaccgggtttaacgtaccggttaccgggtaccgaacggggtacgtaacggggtacgaacgtactaacgaaccggttagtcggtagtccgtagacccgtacttacg

SEQ ID NO: 158674 - DNA, 521 bp, Homo sapiens
  misc_feature: GYAE6OF02JIJTG.16.4.A04.1.454.CMB.1.raw
  modified_base (351)..(351): a, c, t, g, unknown or other
  misc_feature (351)..(351): n is a, c, g, or t
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtagagacagagtcaccatcgcttgccgggccactcagagtgttagcaggtggttggcctggtatcagcagaaacccaggggaaggcccctgaacctcctagatctatgatgccagcagtttagaaaagtggggtaccatacaagattcagcggacagtgatctgganagagttcactcacaccatacagcagcctgcagcctgatgtattttcgactaactattattcgacctaacacgtaataattagttactaccggtgtacggttacgacgaagggaccgtagggtacgaacgtaatacgaaaccgtaacgtcggtagtcgtcgactacctacg

SEQ ID NO: 158675 - DNA, 591 bp, Homo sapiens
  misc_feature: GYAE6OF02F7HEN.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttgccgggccactcagagtgttagcgagggtggttggcctggtatcagcaagaaaccgaggggaacggccccctagaacctcctggactctatgatcgccagctaaggtttagaaaaggttcggggtacccaataccgaagtacttacgagcggacgaggtaggtatcggtagggacaggtacgttcacctctacgacctatcacgcacgcctggacacgcctagtatcgttatttcgactaacttatacgttcgaacctagtagtaataacgttagttacgtaccggttaggtacgttccggacggtaagggtacccgtaaggggtacgaaccgtaactaaacggaaaccgtacgttcggtacggacttaccggactacctacg

SEQ ID NO: 158676 - DNA, 620 bp, Homo sapiens
  misc_feature: GYAE6OF02JBH3J.16.4.A04.1.454.CMB.1.raw
  modified_base (196)..(196): a, c, t, g, unknown or other
  misc_feature (196)..(196): n is a, c, g, or t
tcagtgtactactccacgaccggtgctcgatttagagtagtgatcagggggagtcagactcagtcaggacacagcatggacatgagggtccccgctcagctcctggggctcctgctgctctggctcccgaggtgccaaatgtgacatccagatgacccagtctccttccaccctgtctgcatctgtaggagacagngtcaccatcgcttgccggccactcgagtagtgttagcgtaggtggttggcctggtactcagcaacgaaaccgagggaacggcccctaggaactcctagatctagtgatgccagctaagttgaaacggttcggggaccctataccgaaagtattacgaggccggatacggtaggactcggtagggactaaggtcgttacactccgtaccaccgatccgagaccaggtcctagcctacgtacctgtcttaggttacttcgtaaccgttaacgttaactttacgaccgtaaccctaagtaattaacgtaactttaaggtttccgtaccgtacggggttaccgttaccggaccggaacgggtacggtacggggtaccgacgtaactaccgtaaaccgtagtcggtacgtcgacccgtagacccttacg

SEQ ID NO: 158677 - DNA, 674 bp, Homo sapiens
  misc_feature: GYAE6OF02JEZJB.16.4.A04.1.454.CMB.1.raw
  modified_base (223)..(223): a, c, t, g, unknown or other
  misc_feature (223)..(223): n is a, c, g, or t
  modified_base (663)..(663): a, c, t, g, unknown or other
  misc_feature (663)..(663): n is a, c, g, or t
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccacctggtctgcagtctgacgagacagagtcaccatcgcttgccggaccactcagngtgttagcgtaggtggttggctaggtatcagcaagaaaccgagggaacgcccctaggaacctctagatctatgatcgaccagtctaggtttacggtaaaaggttcggggtaccctagtacgtaaagtgttaccgaaggtccgggactaggtaacggtagttcgggttacgggaaccgttaagggtaactttccggtaaccttaccgtaccgtaacctacgttaccggtaaacgcctaaccgtccggttcggaccttacgggccctaggtaactttgggttaactttacggaaccttaaccgttaatttaactccggtaactaaaccgttaggttaaacttaagttaaccgtttacggtaccgttaggttaccggttacgtaccgggaaccggtacgtaaacgggtcgtaacgtaacgtaacgaacgtaacgtgtcgtacncgacctatacg

SEQ ID NO: 158678 - DNA, 759 bp, Homo sapiens
  misc_feature: GYAE6OF02GS6N6.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctggcctccaggtgaccaaatgtgacatccagatcgaccatctcccttccaccctgtctgcactctggtaggagacgagacgtccacctagtcgtctcggcccggccactcgagaggttagttagcgtaggttcggttcggtccgttggtactcgacgacaacggaaaccgacggggaaccggccccgttacgtaaccgtcccgtagtacttacgtagtagtacgtcgaccgagtacgttacgggtttaacggtaaacgggttccggggtaccctaagtacgtaacgtacgttacgaacggtccggtacgtacgggtcggtacgttacgggtacgggtaacgtacgggttaaccgttaccgtaccgttccctaacccgaacctactccgaccggtaccgacgtcccgtgaccgcgtaccgtaggtagttacgtttaccgtttacgaacctttaaacttttagttactaccgtaaacccgtaaagttaacgtaatttaaacgtttaccggtttacggtacccggttacggtacccggtaccgggtaaccggtaaccggggtaccggtaacgggtaggtaaaccctaaggtaacccgtaaacggtacggttcggaccggtactaccggacccttacgttccg

SEQ ID NO: 158679 - DNA, 705 bp, Homo sapiens
  misc_feature: GYAE6OF02JDQE1.16.4.A04.1.454.CMB.1.raw
  modified_base (516)..(516): a, c, t, g, unknown or other
  misc_feature (516)..(516): n is a, c, g, or t
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccacctgtctgcatctggtaggagacagagtcaccatcgcttcggcccgggccacgtcagagttggttagcgaggtggttggccgtggtactcgagcgagaaaccgagggaacggccctgtaacctccgtagattcgtagtggactcggaccaggtacgtaggttttaacggaaagggttccggggtaccctagtacgaaggtaacttacgaacggccggtactaggtacggactcggtaaggggacctaaggtacgtaccacttcctaccacctactacgacgtacgaccggtcccgtgacccggtactccgtaggtactggtttaacgttaccggacttaaaccgttntttaacgtcggtaacctaacttaaggtttaacttaacggtttaacgtttccgtaccgggttacggtaccgggttacccgggtacggtaaccgggggaccgttacggggggtaacggtaacccgttaacgtaaaccggtaaaggtaccggtttcggtcgggtacccgtacggtaccctaccgttaaccgg

SEQ ID NO: 158680 - DNA, 753 bp, Homo sapiens
  misc_feature: GYAE6OF02GQGFJ.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctggcctccaggtgccaaatgtgacatccagatcgacccagtcctcccttccaccctgtctgcatcgtgtaggagacgagacgtccaccatcgccttcggcccggccactacgagtagtagttagcgtaggttggtcggccgtggtatcagacaacgaaccgagggacgccctagacctcgtgatctatgactcgaccgagacgttaaggttaacggtaaacggtcggggtaccctagtaccgtaagtacgttacgacggtacggacgtaggtacggtaacgttcgggtaacgggaactacgggttacggtttacctaacgttacccgtaccgaacccgttacgtacgacggtaccgaccggtccgtacggaccgtaacggtccgttaggttacgtacgttttaacgttttaccgtaaaccctttaaacgtttacttaacggttacccgtaaccgttaaacgttaacgtttaaacggtttaacgtttaacgttaaccggtttccgggtaacggttaccgggttaaccgggacccggtaacggggtaaccgggtaagggtaacccggtaactaaaccggttaaccggaacggttacggttacggtaccgggtacctaacgtacccgttaaccgtc

SEQ ID NO: 158681 - DNA, 679 bp, Homo sapiens
  misc_feature: GYAE6OF02GH0DH.16.4.A04.1.454.CMB.1.raw
  modified_base (294)..(294): a, c, t, g, unknown or other
  misc_feature (294)..(294): n is a, c, g, or t
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatcgacccagtcctccttccaccctgtctgcatctgtaggagacagagtcaccatcgcttcggcccgggccactcagagttgtagcgaggtggttggcctggtatcgagcagaaaccgagggacgccctgactcgtgatctagngatcgccagtctagttaggaaacggtcggggtacccatcgaaagtacgttacgacggaccggactagggtcggtacgttcgaggggtaacgaaggtacgtttaccaaccgttctacctaacctaacgtaccgagacccgtaacgtcccgtacgaccgtaccgaccgttaggtacgtttacgtttaactttaccgtaaccttaaaccgtttaatttacgttaaccgtaacccttaaacgtaacgttaaattaacggtttaacgtttaaccggttcccggttaggtaacccggggtttaccggaccggtaacgggaaccggttaggggtaccgaacgtaacggtaaccgaaacgttacggtcggtacgcgttacgactaccgttacg

SEQ ID NO: 158682 - DNA, 583 bp, Homo sapiens
  misc_feature: GYAE6OF02FL24U.16.4.A04.1.454.CMB.1.raw
tcagtgtactactccacgaccggtgctcgatttagagtagtgatcaggggggagtcagactcagtcaggacacagcatggacatgagggtccccgctcagctcctggggctcctgctgctctggctcccaggtgccaaatgtgacatccagatgacccagtctccttccacctgtctgcatctgtaggagacagagtcaccatcgcttcgccgggccactcagagtgttagcaggtggttggcctggtatcagacagaaaccgagggaacgcccctagactcctgactctatgatcgccagctaagtttagaaaacggtcggggtacccagtacaagattcgagcggcgagtgatcgtagggacagtagttcactctacaccatcagcagtcctgccacgcctagatgtacgtttcgacgtaaccttattacgttcacctaactagttaactaagtttaacgttacgtaccggttaggttaccggttacggaccgtaaaggggacccgtaaggggtacggaaaccgtacttaacccggaaaacgtacggttacggtacggtactaccggacctaaccgtaacg

SEQ ID NO: 158683 - DNA, 571 bp, Homo sapiens
  misc_feature: GYAE6OF02F6FIH.16.4.A04.1.454.CMB.1.raw
  modified_base (338)..(338): a, c, t, g, unknown or other
  misc_feature (338)..(338): n is a, c, g, or t
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttgccgggccactcagagtgttagcgaggtggttggcctggtatcagcagaaaccagggaacgcccctgactctgatctatgatgacagcagttttagaaaggttggggtacccatcaagattcgaagcggnagtggatcgtgggacagtacgtcactctcaccatacagcagcctgcacgcctgatgtatttcgactaaccttagttacttacgacctaactagttaattaattaacgtttaacgtaccggttagggtaccggtttccggaccggtaacgggtacccggtaaggggtacggtaaccgtaacgtaaccgaaaacggtacgttaggtacggtacgtacggtaccctaccgttaacg

SEQ ID NO: 158684 - DNA, 568 bp, Homo sapiens
  misc_feature: GYAE6OF02GFJ9S.16.4.A04.1.454.CMB.1.raw
  modified_base (222)..(222): a, c, t, g, unknown or other
  misc_feature (222)..(222): n is a, c, g, or t
  modified_base (290)..(290): a, c, t, g, unknown or other
  misc_feature (290)..(290): n is a, c, g, or t
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttgccggccactcagngtgttagcaggtggttgcctggtatcgagcagaaaccgagggaacggcccctagaacctctgatctangatgccagctagtttaggaaaggtcgggtacccatacgaagtattcgaggccggacgtaggtggagtcgtagggacgtacggtagttcactcgtaccaccatcacgcacgcctgccacgcctgtactgtatttcgactaacttattacgtacgaccctaagtagtaattaacgttagttagtccgttaggtaccgttggacccgaagggtaccgtagggtaccgaacgtacttaacgaaaccgtacgttgggtaccgtctaacggtaccaccgttacg

SEQ ID NO: 158685 - DNA, 632 bp, Homo sapiens
  misc_feature: GYAE6OF02GXH92.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccacctgtctgcatctgtaggagacagagtcacatcgcttgccggccactcagagtgttagcaggtgttggcctggtatcagcagaaaccgagggaacggcccctgaacctcctgatctatgatgaccagactagtttagaaaggtcggggtacccatcaagtattcgacgcggacgagtggactcgtagggacaggtagttaccactcctaccgacctactcgacgaccacgtccgtgactacgccttagttacgttgttaattttccggaccttaaacctttagtttaacttaccggaccctaaacgtagttaaacttaagtttaacgtttaccgtaccggttacgggttaccggttacgggacccgtaacgggggtacccgtaaggggtaccggtaacgtacgttaaccgtaaaccggtacggttccgggtacggtaccgttacggacccgtacgttaacccg

SEQ ID NO: 158686 - DNA, 672 bp, Homo sapiens
  misc_feature: GYAE6OF02HRYFC.16.4.A04.1.454.CMB.1.raw
  modified_base (170)..(170): a, c, t, g, unknown or other
  misc_feature (170)..(170): n is a, c, g, or t
  modified_base (374)..(374): a, c, t, g, unknown or other
  misc_feature (374)..(374): n is a, c, g, or t
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatcgacccagtctccttccnccctgtctgcatctgtaggagacagagtcaccagtcgcttggcccggcacgtcgagtagtgttagcgtaggtggttggcctggtatcgagcaacgaaaccgagggaacgcccctagaacctccgtagtactctagtgtactcgaccgagtaccgtaagtttaggaaacggttcgggtaccagtacgtaagtacttacgagcggngtaggtgtacgtcgtacggtactaggtacgttctaccgtctacctaacctatacgagtaccgtagccttacggactacggtacgtaggtaactttacggtacttttaccgaacttaaccgtttatttacgtaaccgtaacctaaacgttaagttaacgttaacgttaccgtttaacggtaccggtacggttaaccgggttacgggaccggtaaacggggtaccgtaacgggtaccgtaactaacgttaaaccggtaaagtaccggttaggtaccggacgtacgtaccgtaccgttacg

SEQ ID NO: 158687 - DNA, 710 bp, Homo sapiens
  misc_feature: GYAE6OF02J157Y.16.4.A04.1.454.CMB.1.raw
  modified_base (158)..(158): a, c, t, g, unknown or other
  misc_feature (158)..(158): n is a, c, g, or t
  modified_base (211)..(211): a, c, t, g, unknown or other
  misc_feature (211)..(211): n is a, c, g, or t
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccngtctccttccaccctgtcctgactagtccttgaaggacgacaggtatcaaccntcgcttggcccggccaactcagagtgttacgcaggtggttggccttggtatcgagacgaacgtaaacccggagggaacgccccttagaaaccttccgtggtaacctcgtagtaggaactcggtaccaaggtacttaaggtttaacgggaaaacgggttccggggttaacccagttaaaccgaaaggttattaccggaaaggcccggggtaaactagggtaacgggtaccttaccggtaggggtactaaggtacggtaccctaccttacgtaccaaccgtacgtaacgaaccgtacgaacgtccgtacgtaccgcgtacgtacgtagtacgttagttttaccgacgttaacttactttacgaacgtaacctaagtaaaggttaactaagttaactacgtacggtcgtaaccggtacgtacccggtaaggtaccggtaacgggtcgtaaccgtacgtaaccgaacgtaacggttggaccgttacgacggtacacccgttac

SEQ ID NO: 158688 - DNA, 801 bp, Homo sapiens
  misc_feature: GYAE6OF02H092H.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctaggctcccgaggtcgaccaaatgtgacataccagtactgacccagtccttaccttcccaccctgctcgcatctgtacggagacagagtccaactacgtccggtacgtcggccgggacctactacgagtacggttagttacgacgtaggggttggttaccggaccttagggtactcgaaaggaccgaaaacgggtaaaacccggtaggggaaccggtcccccgttaacgtaaacccgtacccgttagacttaacgttacgtagacgtaccggaccgacgttaacgttaacggtttaagggtaaaaccgggttccggggtaccctaaagtacgtaaaagtcgttacacggtacgggctaaggtacgacgttcggaaggacgtagtacggttacctacctcgacaaccttacgtacaacggcaaccggtcctacgtaccacgtaccgtagttacgttacgttacgttaccaacccttaacgttaactttacggttaaccgaacccttaaagttaacgtaaaactttaagggttaaaccgtttcgaccgggttaacggtaaccgttaacccgggaggtaaaaccccggggtaccgggttaggtaaccgggtaaacccttaacaaaggttaaccccgaacgggtttcggaacggttacccgtaccgaaccccgttaagttacccg

SEQ ID NO: 158689 - DNA, 576 bp, Homo sapiens
  misc_feature: GYAE6OF02HDTF0.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttgccggcactcagagtgtagcaggtggtggcctggtatcagcaagaaaccgagggaacggcccctagaacctcctgactctatgatcgcagctaggtttagaaaggtcggggtacccaatacgaagtattacaggcggagagtggatcgtagggacaggtagttccactcctacaccatcaagcacgcctgaccacgcctagagttgtaacttttcgaactaacttatttacttacgaacctaagtaagttaattaagttacgtttaactcggtacggtaccgttaccggaccgtaagggacccgtaaggggtacgtaactaacgtaacaaacggtacgttcggtacggtcctaacgccgtaacctacg

SEQ ID NO: 158690 - DNA, 711 bp, Homo sapiens
  misc_feature: GYAE6OF02HDCQ5.16.4.A04.1.454.CMB.1.raw
  modified_base (497)..(497): a, c, t, g, unknown or other
  misc_feature (497)..(497): n is a, c, g, or t
tcagtgtactactccacgaccggtgctcgatttagagtagtgatcagggggagtcagactcagtcaggacacagcatggacatgagggtccccgctcagctcctggggctcctgctgctctggctccaggtgaccaaatgtgacatccagatgacccagtcctccttcccaccctgtctgctatctgtaggagacagacgtcaccagtccgtcttcggccggaccactcgagtagtgttacgcgtaggtggttcggccttgggtactacgacggacgaaacggtaaaccgaacggggaaccggtaccccctaggaacccttccgtagtactcgttaacgtgacgtcgacctagtacgtaaggttaaggaaacggtcggggtacctaatacgaagtacgtacgacggtacgagtaggtaggtacgtacggtacgggaactaggtacgttacctactccgacctaccacgtacgcgtacacgtcgtacgccgacgtcgngtaacttgttactttacgaacctaacgtttaatttacgttaaccgtaacctaagtaacgtttaacttaacgtttacgtttacgtaacccggttaccgggtaccggttaccgggaaccgggtaacgggtaccggtaagggtaaccgtaaccggtaaccgtaaaccgtaaacggttaccgttacggtaccggtacgtaccgtaccgtaccttacgg

SEQ ID NO: 158691 - DNA, 666 bp, Homo sapiens
  misc_feature: GYAE6OF02FHD1X.16.4.A04.1.454.CMB.1.raw
  modified_base (190)..(190): a, c, t, g, unknown or other
  misc_feature (190)..(190): n is a, c, g, or t
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtagganacagacgtcacctatccgcttggcccgggccactcagagtgttagcgaggttggtggctggtatcagacaagaaaccgaggggaacggtcccctagaaccttcctgactctatgactcgccagtcgtaaggtttaaggaaaacggttcggggtaccctagtacaagtacttcgacgacggcgtaggtcggtaatcggtagggaacctaggtacgtttaccgacttccgtacctacctacttcaacggtcctacgtccgtacgccgacgtccgttagtacgttggtttacttttacgacctttaaacctttactttaagttaccgtacctaaaccgtagttaaacttaacgtttaacgtttacgtaccggttaggttaaccggttacccggaccggtaacgggaaccggtaacggggtacgtaaccgtaagtaaccgaaaccggtagttacggacgttacgtcgtacctacgttaac

SEQ ID NO: 158692 - DNA, 623 bp, Homo sapiens
  misc_feature: GYAE6OF02HY4X5.16.4.A04.1.454.CMB.1.raw
tcagtgtactactccacgaccggtgctcgattttagagtagtgatcaggggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttgccggccactcgagagtgttagcgaggttggttcggccgttaggtatcgagacgaacgaaaccgaaggggaacggcccccgtagaacctcccgtagacgtctatagatcgaccagtctaaggtttaggaaaacggtcggggtaccctagtacgaaagtacttacgaggcggacgtaggtaggacgtcgtagggacaggtacgttacacgtctacaccatcgacgcacgtccgtgacacgctgagttagttatttcgaacctaacttagttacttacgaacctaagtagttaataacttaaggttactaccggttacgggtacgttccggacggtaacgggtaccggaagggttacgaacgtaacgtaaccgaaacgtacgttacggtacggtaccgacgtacccgacttaccg

SEQ ID NO: 158693 - DNA, 740 bp, Homo sapiens
  misc_feature: GYAE6OF02IC7A0.16.4.A04.1.454.CMB.1.raw
  modified_base (439)..(439): a, c, t, g, unknown or other
  misc_feature (439)..(439): n is a, c, g, or t
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcgttcgccggtccactcagagtgttagcagggttggttcggctggtatcagcgaagaaaccgagggacggccccagaactccgtagatctatgactcgccgagcgtaggttaagaaaacgggttcggggtaccctagtacgtaagtacgttacgagggtcggacgtaggttaggacgttacggtagggacgtaacggtacggttacctaccgttacctaccgtaacccgtaacncccgaagtacccaacgggtccgtaccggaaccgtacgtacccgttgttaacgtttagttaacgttttaccggaacctttaaaccgtttaactttaagttacccgtaacccgtaaacggtacggttttaaacttaacgttttaaccggtttaacggtttacccgggttaacgggttaacccgtttaccgggaacccggggttaaccggggtacccggttaaaggggggtaccgtaaaccgtaacggttaacccgaaacgggttacttaggggtacccgttacgtaccgacccgacgttaccg

SEQ ID NO: 158694 - DNA, 544 bp, Homo sapiens
  misc_feature: GYAE6OF02FFGHE.16.4.A04.1.454.CMB.1.raw
  modified_base (332)..(332): a, c, t, g, unknown or other
  misc_feature (332)..(332): n is a, c, g, or t
  modified_base (418)..(418): a, c, t, g, unknown or other
  misc_feature (418)..(418): n is a, c, g, or t
  modified_base (428)..(428): a, c, t, g, unknown or other
  misc_feature (428)..(428): n is a, c, g, or t
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttgcccgggccactcagagtgttagcaggtggtggcctggtatcagcagaaaccagggaacggcccctagacctctgatctatgatcgccagctagtttagaaaggttcggggtaccagtcaagtnttcgagcggctaggtggagtcgtagggacaggtacgttacacgtctaccacatcagcacgcctagctagcctagactgttactttnactaaccttnttactcgactaactagttataacgttagttactcggtaggtaccgttacggaccgaagggccgtaaggggtacgaactacgtacgaaacgtacgttggtacggctcgacacttacg

SEQ ID NO: 158695 - DNA, 625 bp, Homo sapiens
  misc_feature: GYAE6OF02I1NY3.16.4.A04.1.454.CMB.1.raw
  modified_base (263)..(263): a, c, t, g, unknown or other
  misc_feature (263)..(263): n is a, c, g, or t
  modified_base (337)..(337): a, c, t, g, unknown or other
  misc_feature (337)..(337): n is a, c, g, or t
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttgccgggccactcagagtgttagcgaggtggttggcctggtatcagcagaaaccgngggaacggcccctgaacctccgtgactctatgatgccagctagttaggaaaggtcggggtacccagtacaagtnttacgagcggacgaggtggatcgtagggactaggtacgttacacgtctaccaactactccgaacggtccacggtcccgtacggacctacggtccctaggtacttaggttaacttttcgaaccttaaacctttagtttacgtacgtaacctaacgtaagttaattaacgttaacgttacgttaccggtacgggtacgttaccgggaccgtaacgggtacccgtaggggttacggaactaacggtaacgaaacgtacgttcgggtacggaccgtacgtacctacgttacg

SEQ ID NO: 158696 - DNA, 690 bp, Homo sapiens
  misc_feature: GYAE6OF02IH89F.16.4.A04.1.454.CMB.1.raw
  modified_base (194)..(194): a, c, t, g, unknown or other
  misc_feature (194)..(194): n is a, c, g, or t
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgactatccagatcgaacccagtcctcccttccacctgtctgcatctgtagganacagtagtcaacatccgcttcggccggccactcagtcgtgtagcgtaggttggttcggcgttggtactcgaacgactaacggaaaaccggacgggaaccggtccccgtacgtaaacctcccgtaggtaacttccgtagtacgtactcgacgtacggtctaaggtttaaggaaacggttcggggtaccagtacgatacgtcgaggcggcgagtcgacgtcgacggatagtacgtcacctgtaccacgtactcaacgacctagtacctgacctacggtccttaaggtcgttagttaacgttttaccgaaaccgttaactagtttaacgtcccaaacgttaaacctagtttaaacttacgtttaacgttccggtaacggtttaccggtaccgggttaccggaaccgggtaagggtaccggtaacgggtaacggacgtaaaacgttaaccgtaacggtacggtacggttccggtacccgtacgtacccgtaacttacggg

SEQ ID NO: 158697 - DNA, 711 bp, Homo sapiens
  misc_feature: GYAE6OF02F3RME.16.4.A04.1.454.CMB.1.raw
  modified_base (191)..(191): a, c, t, g, unknown or other
  misc_feature (191)..(191): n is a, c, g, or t
tcagtgtactactccacgaccggtgctcgatttagagtagtgatcagggggagtcagactcagtcaggacacagcatggacatgagggtccccgctcagctccgtggggctcctgctgctctggctcccaggtgccaaatgtgacatccagatgacccagtctccttccaccctgtctgcatctgtagganacagagtcaccatcgcttgccgggaccactcagagtgttagcgaggtggttggcctaggtatcgaagacaagaaaccgagggaacggcccctaggaacctcctagatctagtgaatcgaccagtaccgtaagtttaggtaaaacgggttcggggtaccctaagtacgtaaacgtattacgaacggacggacgtaaggttaggtaacgttacgtacgggaactaacggtaacgtttaccaaccttaccgttaccgaaacctaacgttacgaaacggtacccgtaaacggtccccgttaaggacccgtaaccgtccggtttaaggtaacgttacggtttaacgttttaccggaaaccttaaaccgttttaattaaccgttacgaacctaaacgtaaagttaagttaaacgtttaagttacgtacggttaggtaccggttacggaccgtaacgggacggtaagggttacgaactaacgttaacgaaaccgtaggttacggtacgctaacgccctaacgttacg

SEQ ID NO: 158698 - DNA, 683 bp, Homo sapiens
  misc_feature: GYAE6OF02H7JOG.16.4.A04.1.454.CMB.1.raw
  modified_base (191)..(191): a, c, t, g, unknown or other
  misc_feature (191)..(191): n is a, c, g, or t
  modified_base (518)..(518): a, c, t, g, unknown or other
  misc_feature (518)..(518): n is a, c, g, or t
  modified_base (637)..(637): a, c, t, g, unknown or other
  misc_feature (637)..(637): n is a, c, g, or t
tcagtgtactactccacgaccggtgctcgatttagagtagtgatcaggggggagtcagactcagtcaggacacagcatggacatgagggtcccgctcagctcctggggctcctgctgctctggctcccaggtgccaaatgtgacatccagatgacccagtcctccttccaccctgtctgcatctgtagganacagagtcaccatcgcttcggccgggccaactcaggtagttgttaggcgtaggggttggttcggccgttaggtatcgagcgaagaaaaccgacgggaacggcccctagaaccgtcctaggattactagtagactacggaccaggtacgtaaggtttaaggaaaaaccgggttcggggttaccccgtaagtaacctaaaggtacttacggaacgggccggtacgtaaggtacgggtaacgttacggtaggggaaacctggttaacggttcctaaccgttccctaaccaaccgtactacgtacaccgtacggacttcgaaccagttccnggtaacttggttactttcgacttaaacttaatttcgacgtaaccagtaaacgttaattaaacttagttaacgttacggaccggttaggtacccgaacgaaggggtacgtagggtacganaaccgttaaccgaaagtacgtcggtcggtacacgtacccgatacgg

SEQ ID NO: 158699 - DNA, 664 bp, Homo sapiens
  misc_feature: GYAE6OF02HTOC1.16.4.A04.1.454.CMB.1.raw
  modified_base (209)..(209): a, c, t, g, unknown or other
  misc_feature (209)..(209): n is a, c, g, or t
  modified_base (515)..(515): a, c, t, g, unknown or other
  misc_feature (515)..(515): n is a, c, g, or t
tcagtgtactactccacgaccggtgctcgatttagagtagtgatcagggggagtcgagactcagtcaggacacagcagtggacatgagggtccccgctcagctccgtgggctcgtgctgctctggctccgaggtgccaaagttgtgacatccgaagtatcgacccagtctcccgttccacccgtgtctgcatctaggtaggagacgagngtccacagtccgtcgttcggccggaccactcgaggtagttcgtaagcgtaggtggttcggcctggtactcagactaaggaaacccgaggggaaccggtacccctacggaaccttcccgacggtactcgttagcggtaatcgccgagtcgtaggttagaaacgggttcgggtaccagtacggaatcgttacgagcggtacaggtacggtaactcggtaggaccgtaagtcgttaccgaaccttcgtaacctccgtaagaccgttacgccgtaaacgtccgtacgacctacggtccctgacgttagtntttaccgaacttactaagtttacgcgaactaacgtgttaatacgtttaactcggttaaccggtgtcccgtttaaggaccggtaggtacggtaagggttacacgttaacgaccgtaaggtacgcggttagaccgttgaccggtattacgg

SEQ ID NO: 158700 - DNA, 696 bp, Homo sapiens
  misc_feature: GYAE6OF02I1ERD.16.4.A04.1.454.CMB.1.raw
  modified_base (587)..(587): a, c, t, g, unknown or other
  misc_feature (587)..(587): n is a, c, g, or t
tcagtgtactactccacgaccggtgctcgatttagagtagtgatcagggggagtcagactcagtcaggacacagcatggacatgagggtccccgctcagctccgtggggcctcctgctgctctggctcccaggtgaccaaatgtgacatccagatcgacccagttcctccttccaccctgtctgcatcgtggtaaggacgacagagtccaaccgatcggcttcggcccgggtaccaaccgtcaaggacgttgttaagcgtagggttggttcggccgtaggtacgtacgaagacgaaagaaaacccgagggaacggtcccctagacctcctagtatacgtagtacgatacgactagacgtagtttaagtaaaggtcgggtaccagtaagaagtacgttacgacggcggacgaggtacgacgtcgtaaggactagttacgtacctaagttccctacgaacctactacgacgacgactcccgagaccgactccgtacgtagttaccgttaagtttacgtaacctaaacgttaacttaacgttacgtaacccaaaacgtagttaaactaacgtttaagttagttacccggnggttaaccgtccggaacccggttaacgggaaccggttaagggtaaccgtaaacgtaccgtaaacggtaaactacggttcgacccgggacgtacgtacctaggttacccg

SEQ ID NO: 158701 - DNA, 724 bp, Homo sapiens
  misc_feature: GYAE6OF02HQHCQ.16.4.A04.1.454.CMB.1.raw
tcagtgtactactccacgaccggtgctcgatttagagtagtgatcagggggagtcagactcagtcaggacacagcatggacatgaggtccccgctcagctcctggggctcctgctgctctggctcccaggtgccaaatgtgacatccagatgacccagtctccttccaccctgtctgcatctgtaggagacagagtcaccatcgcttgccggccactcagtgtgttagcgtaggtggttggcctggtactcagcacgaaaccgagggacggcccctagacctcctagactcgtatggactcgaccagtcgtaaggtttacggaaaacgggtcggggtaccctaagttacgaaagtacgttaccgaacgggtcggacgtacggttacggaacgttaccgggtaggggtaacctaaggtaccggtttacctaccgttaccgtaccgtaaccctacttaccgaacggtccgtacgggtccctacgggtacctaccgggtaccttagggaactttgttaaccgttttccgaaccttaaacccgtttaacgttttacgttaaccgaacccttaaaacggtagtttaaacgttaaacgtttaacgtttaccggtacccgggttacgggttaaccggttaccgggaccggtaacggggtaacccggaggggttacggaactacggttaaaccgaaccgttacgtcgggttacgcgtacgtcccgtacttcg

SEQ ID NO: 158702 - DNA, 714 bp, Homo sapiens
  misc_feature: GYAE6OF02F6DCX.16.4.A04.1.454.CMB.1.raw
  modified_base (269)..(269): a, c, t, g, unknown or other
  misc_feature (269)..(269): n is a, c, g, or t
tcagtgtactactccacgaccggtgctcgatttagagtagtgatcagggggagtcagactcagtcaggacacagcatggacatgagggtccccgctcagctccgtggggctcctgctgctctggcctcccaggtgaccaaatgtgacatccagatcgaccctagtcctccttccaccctgtctgcatctgtaggagacagacgtcacctagtcgcgttcggccggccactcagtacgttggttagcgtaggtggttcggccgtggtacncgagtacgaacggtaaaccgaggggtaaccgccccgtagtaaccgttccgtagtacttacgtagtacggacgtcgaccgagtctaaggtttaggaaacggttcgggtaacctagtaactaagtacgttacggacggacggacgtaggtacggtactacgggtagggtaccgtaaggttacgttaccgtacgttacccgtaccgtaaccgtactaccgaacgccgtacggtccgtacggacctacggtaccttaggtacgttacgttactttaccgaaccttaactttattacgtaccgtaaccgtaagtaacgttaacttaagtttaaccgtttacggtacggttacgggtaccgttaaccgggaccgtaacgggtaccgggtaggtaccgtaactaccgttaacgaacggtacggttggtacggtcgtacgtaccgtacttacg

SEQ ID NO: 158703 - DNA, 584 bp, Homo sapiens
  misc_feature: GYAE6OF02FJQQC.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttgcccgggccatcagagtgttagcaggtggttggcctggtatcagcagaaaccaggggaacggccccctgaactccgtgatctatgatgccagctaagtttagaaaaggtcgggggtacccatacaagtattcagcggacaggtggatcgtaggggactaggtacgtttcaacttccgtacaccactcagcgacgcctcgcctacgccttagactagtattttcgactaaccttattacgttcgacctaactaagttattaaagttagttaacttccggttagggtaccgttaccggtaccgaacggggtaccggtaacggggtacggaacgtactaacgaaacgtacgtacggttaggctacggaccaccgtaccg

SEQ ID NO: 158704 - DNA, 793 bp, Homo sapiens
  misc_feature: GYAE6OF02G8OY8.16.4.A04.1.454.CMB.1.raw
  modified_base (197)..(197): a, c, t, g, unknown or other
  misc_feature (197)..(197): n is a, c, g, or t
tcagtgtactactccacgaccggtgctcgatttagagtagtgatcagggggagtcagactcagtcaggacacagcatggacatgagggtccccgctcagctccgtggggctcctgctgctctggctcccaggtgaccaaatgtgacatccagatcgacccagtcctcccttccaccctgtctgctagtctgtagganacgagcgtcaaccatcgcgtcgccggccactcgagtagttgtagcgtaggttcggttcggccttggtactacgaagaccgaacgaaaccggaggggtaaccgaccccgtagtaaacccgttcccgtagtaacgttacgttaagtagtacgtaccgacccggaagttaccgttaaaggtttaaacgggtaaaacgggtccggggtacccctaagtacgaaagttacgtacgtacgggtccggtagttagggtcggtaacgttacgggtacggggaacttaagggtactttaccaaccgttccaccgtaacctacgtaccgtacgtaccgacgtccgtagaccgtaccgtaccgttaagactttacggtttaacgtttaccgtaacttaaaccgttttatttaaccgaacgtaaccgtaaacgttaaacgttaacgttaaagtttaacgtttaacggttaccggtaacgggtttaccggttacccgggtaccggaaacgggggtaccggttaaggggtaactaaccggtaaacgtaccggtaaaaccggttacgggttacggtaccgggtaccgtaaccggttacccgtacgttaccg

SEQ ID NO: 158705 - DNA, 838 bp, Homo sapiens
  misc_feature: GYAE6OF02JKFBH.16.4.A04.1.454.CMB.1.raw
  modified_base (133)..(133): a, c, t, g, unknown or other
  misc_feature (133)..(133): n is a, c, g, or t
  modified_base (202)..(202): a, c, t, g, unknown or other
  misc_feature (202)..(202): n is a, c, g, or t
tcagtgtactactccacgaccggtgctcgatttagagtagtgatcagggggagtcagactcagtcaggacacagcatggacatgagggtccccgctcagctcctggggctcctgctgctctggcctccaggtnaccaaagtgtgacatccagatcgacccagtcctcccttccacccgttgtctgactagtcgtagtagganaacaggacgtacaccagttccgcgtttacggcccggacctacgtccgaaaggtaggttgtttaacggcggttaggggttcgggttacggtccgttagggttaacttcgaggtaccgaaacggaaaaccggacgggggtaaaccggtccccgttacggaaaccttccgttaggtacttacgtagttacggactacgaccgacgtacgttaacggttttaacggaaacggttcggggttacccaagtaccgtaacggtaacgttcggacggacggtacgggtagtacggagttacccgtaggggtaaacgtaacgtacgttttaccaaccgttaccttaaccggaacgtaacttacggaaacggttccgaagtacccgttaggtaacccgcgttaacccgtagttaaaccgttgttaaccgtttaacggtaacccgttaaaacctttacggtttaacgtaaccgtaaacccgttaacggttaaatttaaggttaaaccgtttacgtttaacgtacccggtaacgggttaacgttaccggggacgtaaaccgggcggttaaacggggttacaaccggttaacggtaacgttaaaccggtacgtttacgggacgtaccgtttagaaccccgttgtaaccg

SEQ ID NO: 158706 - DNA, 790 bp, Homo sapiens
  misc_feature: GYAE6OF02GTGZB.16.4.A04.1.454.CMB.1.raw
  modified_base (266)..(266): a, c, t, g, unknown or other
  misc_feature (266)..(266): n is a, c, g, or t
tcagtgtactactccacgaccggtgctcgatttagagtagtgatcagggggagtcagactcagtcaggacacagcatggacatgagggtccccgctcagctcctggggctcctgctgctctggcctcccgaggtcgaccaaatgtgacatccagatgacccagtcctccttccaccctgtctgcatctgtaggagacagagccaccagtccgcgttcggcccggccactcgagtagttgttagcgtaggtggttcggccgttggtntacgacgacaacgaaccggagggaccgcccctagaaccttccgtagacttctagtgacgtcggaccaggtacgttaagggttttaacgggaaaacggttccggggtaccctaacgtaacgtaaaggttaccgttacggaacggtccgggaacgttagggtaacggtacgttaccggggtagggtaaacgtacggttacgttacctaacccgttcctaacccgtaaccgtattaccgacggtaccgaccggtccctacggacctaccggtaccgtagttaagtttacgttaacgtttcgtaaaccctttaactttacggttaaccttacccgtaaaccttaaaccgttaaagtttaaacgtttaacgtttaccgtttaccggtacccgggtttagggtaacccggttcccggggtaaccggaaaccgggtaccggggtaaggggtaacccggtaacgttaaacccggtaacggaaaaccggttcgggttacggtaccggtacgtaccgtaccggtacccttacgg

SEQ ID NO: 158707 - DNA, 812 bp, Homo sapiens
  misc_feature: GYAE6OF02IK26E.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctggctcccaggtgaccaaatgtgacatccagatcgacccagtcctcccttccaccctgtctgcatctaggtacggagacagacgtccaacctagtccgcgttcggcccgggtaccactcgaggtagttgtacgcgtagggttggttcggtccgttggtactcgaacgcaaacggaaaccggacgggaacggtaccccgtaggtaacccttccgtaggtacgttacgttagacggtaacgtcgaccgtaagtacgttaacggttttaacggtaaaacgggttcggggtaccccgtaagtaccgtaacgtacgttacgacgggacggtacgtaaggtcggtaacgtcggtacgggaacgttacggtacgttaccgaccgttaccgtaccgtaaccgtaacgtaccgaacggtaccgtacggtacccgtacgtccggtacgtacccgttagttaacgtttacgggtttaacttttaccggaacctttaaccgtttaagtttaccgttaaccgttaacctaacgttaaacgtttaaacgttttaaacgtttaacggttaaccggttacggttaccgggttaaccggttccggggaaccggtaacgggggtacgttaagggggttaccgaacgtaaaccgtaaacggaacccggtaggttaccgggtaccgtacgtacccgtacgtaaccgttaacg

SEQ ID NO: 158708 - DNA, 820 bp, Homo sapiens
  misc_feature: GYAE6OF02JE6G6.16.4.A04.1.454.CMB.1.raw
tcagtgtactactccacgaccggtgctcgatttagagtagtgatcagggggagtcagactcagtcaggacacagcatggacatgagggtccccgctcagctccgtggggctcctgctgctctggctcccaggtgaccaaatgtgacatccagactcgaccctagtcctccttccaccctgtctgctatcgtaggtaggagtaacaggtagtccaccgtagtccgtcgttcggcccgggacctactcgagtagttagttacgacggtagggttcggttacggtccgtaggtactcgagactaacggaaccgaggggaccgtccctagtaaccgtcgtagtactacgtatgacgtacgacgtagtacgttaaggttacggaaacggttccggggtaacctaagtacgtaaacggtcgttacggacgggcggtacgttaagggtacggtacggttacggtaacggggtacgtaacggttacgtttaccgtaccgttcccgaaccgtaaccgtacgttacccgaaacgggttaccctccgggtaccttacgggacccgttaaccggttacccggttagtaacggttttacggtttaaccgttttaaccggaacccgttttaaacgtttaccgtttaacgtaaccgtaaacccgttaaaagggtacttttaaacggttacgtttaaccggttaccggttaccggttaaccgggttaccgggttacccgggaaccgttaagggggaaccgttacggggaacgttaaccgtaacgttaaaccggtacgtacggttcggtacccggtaacacgtaccgttacctacgg

SEQ ID NO: 158709 - DNA, 870 bp, Homo sapiens
  misc_feature: GYAE6OF02GE7SW.16.4.A04.1.454.CMB.1.raw
tcagtgtactactccacgaccggtgctcgattttagagtagtgatcagggggagtcagactcagtcaggacacagcatggacatgagggtccccgctcagtcctcggtgggcctccgtgctcgctcgtcggcctccgaggtcgaacctaagttggtacgactactaccgaagtacgtaccgacccgtacgttcccctttccccttacccctacccgttgtccgtcgacctacgttcgtagggtaacggaacgaacgaaggtaccgtacccaaccgttacgttccgtccggttaccgggccccggtaccctaacgtacggaaggttacggttaggttacgacggttaggggtttcgggttccggtaccggttaggtactacgaacggaccgaaaacggaaaccgggaacggggacccgtaccccgtaacgtaacccttacgtagtacttacgtagtacgtacgtccgacgtacgtacggtttaaaggttaaggtaaaccgggttcggtacccaagtaacgtaaacgttacgttacggacggtacggtaacgtacgggtacgttaccggtacggggtaacgggaacgttaaacgggttaccgttacccttaaccgttaccacccccgtaaacgttaacgtccgaaaccgtcgtacccgttcgtaacggctaccggtaccgttagttacgtttacgttttacttaccgtaaccgttaactttacttcggaaccctaaccgtaaagttaagttaacgtttaacgtttacgttaccggttaccggttacggtaccggttacccggacgggtacggttaccgggaaggtactaacgaccgttaaacgacgttacgcggtagcaccgaccgtagttc

SEQ ID NO: 158710 - DNA, 692 bp, Homo sapiens
  misc_feature: GYAE6OF02JFJQF.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtacggagacagagtcaccatccgcttgcccgggccactcagagttgtagcgaggtggttggacctggtagtcagcagaaaccgagggaacgcccctagaacctcctagactctatgatcgaccagacagtttagaaaggttcggggtaccagtacgaagtacttcgacggcggtacgacggtggacttacgtagggacaggtacgttcgaccgtctaccaccgtacttcgacgaccgaagccgtcgacctacggtaccctggtaacgttgttaacgttttcggaaccctttaacttaacgttttactaccggtaaccctaaacgtacgtttaaacgttaaacgttttaacgggtttaacgttcccgggttaacgttaccgggtttaccgggacccggtaaaacgggggtacccggtaaaggggttaccgggaaccgttaacgtaaaccggttaaacccgtaacgggttaccggttaacgggtacctacggtaccctaaccgttaccgg

SEQ ID NO: 158711 - DNA, 891 bp, Homo sapiens
  misc_feature: GYAE6OF02INDZ2.16.4.A04.1.454.CMB.1.raw
  modified_base (198)..(198): a, c, t, g, unknown or other
  misc_feature (198)..(198): n is a, c, g, or t
tcagtgtactactccacgaccggtgctcgatttagagtagtgatcagggggagtcagactcagtcaggacacagcatggacatgagggtccccgctcagctcctggggcctcctgctgctctggctcccaggtgaccaaatgtgacatccagatcgacccagtctccttccaccctgtctgcatctgtaggagacagntcacatcgctgccggccactcagtagtgttagcgtaggttggttcggccgttaggtattcgacgtacgaaacggtaaaccggacggggtaaccggtaccccctaggtaaaacccttcccgttaaggtaacttacgttaacggttcggtaacgttacggacccgtaaggtccgttaaagggttttaacggtaaaaacgggttccgggggtaaccctaacggtacgtaaacgttacgttacgacgggtaccggtaacgtagggttacggtacgttacggtacggggtaacgtaacgggttacgttccgtaaccttaccgtacgtaaccccgtaaagtcccgaaggtacccgtaacggtccgtccggaaccgtaccggtaccgttaaggttacgtttaaccggttaagtttttccggaaacccttttaaaacccgtttaacgttttaaccgttaacccggtaaacccgttaaactttaaacgggttaaaacttttaaccgttaaaccgggttttacgttaaccccggggttaaggggttaacccggggtttacccgggtaacccgggtaaacccggggggtacccgggtaacgggggtaaaccggtaaccccgtaaggttaaaccccggttaaaacccgggtacggtttaacccgggttccggaacgttaccgggtaccccaacccgtttaaccgg

SEQ ID NO: 158712 - DNA, 758 bp, Homo sapiens
  misc_feature: GYAE6OF02IDZ8B.16.4.A04.1.454.CMB.1.raw
  modified_base (320)..(320): a, c, t, g, unknown or other
  misc_feature (320)..(320): n is a, c, g, or t
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatcgacccagtctcccttccacctgtctgcatcgtgtaggacgacacgacgtccacactcgtcgttcggcccgggccaccgtcgagtacgttggtacgacgtacgggttcggttacggccgttaggtactaccgaggaccaacggaaaccgaggggaaccgtccccgtanaacgttccgtagtacttacgttactacgtcgtacgaccgaagtacgttaaggtttaaggtaaacgggttccgggtaaccaacgtacgaaagttacgttaccgaagggccggtactacgggttacggtaaccgtttgggtaacgggtaaactaacgggtaccgttaaccgtccttacccgttaaccgacccttaagtaccgaacgccggaacccgttccgtacgaccgtaccggtcgtaacggttacgtttacgttactttaacgtaaccctaacttttgtaacctctaaaccgtacgtttaattaacgttaattaaccgtttttacggcccggtttaacgtaccggttaccggaacggtaacccgggacgggttaacgggcttaaccggaacgttaacgtaaacggtcggtccggtagtcggactccgtacgtaccgg

SEQ ID NO: 158713 - DNA, 623 bp, Homo sapiens
  misc_feature: GYAE6OF02JUMGI.16.4.A04.1.454.CMB.1.raw
  modified_base (350)..(350): a, c, t, g, unknown or other
  misc_feature (350)..(350): n is a, c, g, or t
  modified_base (367)..(367): a, c, t, g, unknown or other
  misc_feature (367)..(367): n is a, c, g, or t
  modified_base (399)..(399): a, c, t, g, unknown or other
  misc_feature (399)..(399): n is a, c, g, or t
  modified_base (404)..(404): a, c, t, g, unknown or other
  misc_feature (404)..(404): n is a, c, g, or t
tcagtgtactactccacgaccggtgctcgatttagagtagtgatcagggggagtcagactcagtcaggacacagcatggacatgagggtccccgctcagctcctggggctcctgctgctctggctcccaggtgaccaaatgtgacatccagatcgacccagtcctccttccaccctgtctagcatctgtaggagacagagtcaccatcgtctcgcccggcactcagtagtgttacgcgtaggttggttaggccgttgggtactcaggtaccgaacgaaaccggagggaacgcccctagaacctcgtagatacgtactgactgccgagtcgtagttagaaggtcggtaccntacaagtctcaagcganaggtgactcggtagatggtactcacgtcctanacctntacgacgtcacgtccgtgaccgtacgccttagtacgtgttattaccggactaacgttacttcgtacgaccgtaaacttagttaaacgttgttaacgttacgttcggtacggtaccgttaccggaccggtaacgggtccggtaagggtaaccgtaacgtacgtaaaccggtaaaccgggtgttcgggtacggtaacccgtacggtacctacccgttaagg

SEQ ID NO: 158714 - DNA, 649 bp, Homo sapiens
  misc_feature: GYAE6OF02HFTPY.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctggctcccgaggtgaccaaatgtgacatccagatcgacccagttcctcccttccaccctgtctgctatctggtaggagacagacgtcaccatcggtccttggcccgggcactcgagagtgtagcgaggtggttcggcctggtatcgagcgaacgaaaccgagggaacggccctaggtaactccgtagactcgttatggtacgtcgaccgaaggtcgttaagggtttaaggtaaacgggtcggggtaccctaagtaccgaaagtagttacggaggcggtacgtagggtaggtaacgttcggtaacggaacgtaggtacgtctacgtccgtaccacctacgacgtacggccaaccggtcctcggaccgtacgtaccttgaacgtttcgtacgttttcgaacttacctattactacgaactaagtataagttaattacgttatccggtagtaccggtacgaccggtaagggacgtagggtacgtactaactaacgaaacgttcgtacggtacggccgtacgtacctagtccg

SEQ ID NO: 158715 - DNA, 862 bp, Homo sapiens
  misc_feature: GYAE6OF02I4FGL.16.4.A04.1.454.CMB.1.raw
  modified_base (153)..(153): a, c, t, g, unknown or other
  misc_feature (153)..(153): n is a, c, g, or t
  modified_base (161)..(161): a, c, t, g, unknown or other
  misc_feature (161)..(161): n is a, c, g, or t
tcagtgtactactccacgaccggtgctcgatttagagtagtgatcagggggagtcagactcagtcaggacacagcatggacatgagggtccccgctcagctcctggggctcctgctgcctctggctcccaggtgaccaaatgtgacatccagntcgacccngtcctcccttccacccttgtctgctacgtctaggtaaggagacgacgacgttccaaccagtccgtcgttcggcccgggaccctaccgtcgagtacggtttgtacggcggtaggggttcggttcgggtcccgttgggttactaccggacgtaaccgaaacggaaaaccccggtacggggaaacccggtcccccgtacgtaaaccttccgtaacggtcttaaccggttagtcggtaactccggaccgtaaggtaaccgttaggggtttaaacggtaaaccgggttcccggggtaaccctagttaccgaaacggttacttaccgaacgggtccggacgtaggtacgggtccaaggggttaccggacggtaacgttaccggttacctaaccgttccgacctaaccctcgtacgacgtacgacgtccgtacgacctacgtccgtaggttaagttccgtttacgtttaccggaacctttaacctttaaccggtttaacgttacccgtaaacgttaccgtaagttaaacctttaacgtttaacgtttaaccggtcccgggttaacgggttaaccgtaacccggggttacccgggaaacggggtaccccgggttaacgggttaaccgggtaacccgtaaccggttaaccggaaacccggttacggttacgggtaccggtaccgttaccggaccgttaacccttcccggg

SEQ ID NO: 158716 - DNA, 732 bp, Homo sapiens
  misc_feature: GYAE6OF02JDGIE.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcattctgtaggagacagacgtcacatcgcgttgcccgggccactcagagtgttagcgtaggtggttggccgtggtatcagcaagaaaccgagggaacgccctagaacctccgtgtactctatgactcgccagtcgtaaggttaggaaaacggttcggggtacctagtacgtaagtacttcgacggcggacgtaggtaggtacgtacggtacgggaacgtaggtacgttaccgtacttaccgtacctaacccgtactacgaccggacgtacgtcccgtagcccgaaccggtcccgtagttaagttacggttactttttccgaacctttaaaccttagttttaacctacgtaaccctaaacgttaagttaaacttaaacgtttaacgttttaacgttacccgggttaacgggttaacccgggtttaccgggaccccgggttaaacgggggtaacccgggtaacggggttaacggtaaaccgtaaccggttaacccgtaaaaccgggtaacggtttacgggaccggttaccggtaacggacccgtaaccgttaaccg

SEQ ID NO: 158717 - DNA, 698 bp, Homo sapiens
  misc_feature: GYAE6OF02JIJBD.16.4.A04.1.454.CMB.1.raw
  modified_base (191)..(191): a, c, t, g, unknown or other
  misc_feature (191)..(191): n is a, c, g, or t
  modified_base (296)..(296): a, c, t, g, unknown or other
  misc_feature (296)..(296): n is a, c, g, or t
tcagtgtactactccacgaccggtgctcgatttagagtagtgatcagggggagtcagactcagtcaggacacagcatggacatgagggtccccgctcagctcctggggctcctgctgctctggctccaggtgccaaatgtagacatccagatcgacccagtctccttccacctgtctgctatctgtagganacagagtccaccgatcgcttgccgggcactcagagtgtagcaggtggtggcctggtatcgagacagaacgaggacgccctagactctagatctatgatcgcctancgtaagttaggaaaacggtcggggtaccctagtactaacgtacttacgacggacggtacgaaggttacggacttaccggtaggggtacgaacggtacgtttcctacccttacgtaccgtaccctacgttacgaagtacccgtacggtaccctacggtacgaccgtccgtaggttaacttcgttacttttacgacctttaaaccgttatttacgtacggtaacctaacgttaattaaacggtttaaccttaagttttaaccgtacccgggttaacgttaccgggtttaacccgggtaccggtaaacgggggtaccgtaaacgggggttacgaaccggtaacgtaaccggtaaaaccgttagggttacggttacggtaccggttacgtacccggaaacttccgg

SEQ ID NO: 158718 - DNA, 583 bp, Homo sapiens
  misc_feature: GYAE6OF02FS0B6.16.4.A04.1.454.CMB.1.raw
  modified_base (578)..(578): a, c, t, g, unknown or other
  misc_feature (578)..(578): n is a, c, g, or t
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtcctccttccacctgtctgcatctggtaggagacagagtcaccatcgcttggccgggccactcagtagtgttagcgtagggttggttggccgtaggtatcaggtccaacggaaaccgaggggaacggtcccctagaacctccgtgactcgtatgatcgaccagtacgtaaggtttaggaaaagggttcgggggtacccaagtacgaacgtacgtacgacggtccggacgtaggtaggtactcggtaggacgtaggtacgttacactcctaccgtacctatcgacgtcacgcgtcgacacgcgttagacgtgttattcgactacttagttactcacaacgtatagtaattagtacgtcggtagtaccgtgtaccgaaggtacggtggtagacagtacaagtacgtcgtcgcggtactacnctacg

SEQ ID NO: 158719 - DNA, 813 bp, Homo sapiens
  misc_feature: GYAE6OF02GLRXW.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatcgacccagtcctccttcccaccctgtctgcactcgtggtaggagacagagtccacctatccgtcttcggcccgggccacgtacgaggtagttggttacgcgtaggttgggttcggacccgttagggtactacgtaaggaccgtaacggaaaacccggagggggaaccggtccccccgttaacggtaacccttaccgttaacggtaaccgttacgtaagtaccggtagtccgaccgtacggtacgtttaaggtttaacgggtaaaacgggttccggggtaccctaagttaccgaaagtaccgttacggacggtaccggtacgtagggttacggtacgttcggtaacgggtaaccgtaggtacgttcccaaccgttccgtaacccgtaacctaaccgttcgaacggaccgtacggtcccgtacgccgtaaccggttccgtagttacgttacgtttacgttttaccgaccgtttaaacctttgttaccgttaccgaaccttaaacgtagtttaaacgtacgttttaaacgttccggtttaaccggtacgggtaacccggtttaccgggaacccgggtaaggggtacccgggtaacgggggtacaacgttaacgaaaccgtaaccggttagtaccggttcgaccggtacggtacctacttaccgg

SEQ ID NO: 158720 - DNA, 698 bp, Homo sapiens
  misc_feature: GYAE6OF02HPOFA.16.4.A04.1.454.CMB.1.raw
  modified_base (460)..(460): a, c, t, g, unknown or other
  misc_feature (460)..(460): n is a, c, g, or t
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtcctccttccaccctgtctgcatctgtaggagacagagtcacatcgcttcgccgggccacgtcagagtgtagcgaggtggttcggcctggtatcgagacaacgaaaccgaggggaacggcccccgtagaaccgtccgtacgtatacgttatagtagtcgccagtacgtaggtttaacggaaacggtcggggtaccaagtccaaaggtacttacggaggtaccggacgtaggtacggacgtacgtagggaccgaaggtacgttacctacgtcctacgacctatacgacgctacgccgtgccncgtccgtagtacttcggttacgttttacaccgtttaaaccttacgtttagttacctaaccgtaaagtaacgtttaattaaacgtttaacggtttacgttacggtaaccgggttaccgtttaccgggacccgttaacgggggtacccggaaaggggttacccggtaacgtaaacggttaaccggtaaaaccgttaacggtcggtaccgggtacccgttacggaccgtaaccgttaccgg

SEQ ID NO: 158721 - DNA, 656 bp, Homo sapiens
  misc_feature: GYAE6OF02GJJZ4.16.4.A04.1.454.CMB.1.raw
  modified_base (190)..(190): a, c, t, g, unknown or other
  misc_feature (190)..(190): n is a, c, g, or t
tcagtgtactactccacgaccggtgctcgatttagagtagtgatcaggggggagtcagactcagtcaggacacagcatggacatgagggtccccgctcagctcctggggctcctgctgctctggctcccaggtgccaaatgtgacatccagatgacccagtctcctccaccctgtctgcatctgtagganacagagtcaccatcgcttcggccggccatcagagtgttagcgtaggtggttggcctggtactcagcagaaaccagggaagcccctgaactctgatctatgatgccagctagtttagaaaggtcggggtaccctagtacaagtacgttgacggtcggcaggtaggacgtcgtaggggaacaggacggtttccaacgttcctaccaaccgtactacgaacgccgaacgcccttggacctaccggaccttaggtattcggttaactttttaggacctaaaacctttatttaacgttaccgttaaccgaaaccgtttaaggttaaagttaaacgtttaacgtttaacgttaccccgggttagggtaaccgggtttaccgggaccgaacgggggtaaccgtacgggggttacgaactaacgtaaccgtaaaacggtagttacgggtaggtcctacggtacctaccgtaacg

SEQ ID NO: 158722 - DNA, 775 bp, Homo sapiens
  misc_feature: GYAE6OF02G6R0B.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctggctcccaggtgaccaatgtgacatccagatcgaccagtctccttccaccctgctgcatctgtagagacagcgtcaccatcgcttcgccggccactcagtagtgttagcgtaggtcggttggccgttggtacttcgacgacaaggaacccgacggggaacgcccccttaggaacctccgtacacgtactataggactcgcctaagtcgtaagtttaagaaacggttcgggtaccctagtactaaggtacttacggacgtccgggactagggtacggtagtcggtacggactacggtacggtttacctaccgttacctaccgtaacccgttactaccgacgtaccggtaagtcccgttacgaccgtacggtcccgttagtaacggttacgtttaacgtttaccgaacccgtttaaacctttaacggtttaaccgttacggtaaaccccttaacggttaaacgtttaaaccgttaaaacggttttaccgtttaaacgggttacccggttaaccggggttaaccgtttacccgggggtaaccggttaccggggtaacccggtaagggggttaaccggtaaaccgtaacggttaaccggaaaccgggttaacgtttacggggtaacggtaccggtaaccgtacgtaacccgtttaccg

SEQ ID NO: 158723 - DNA, 724 bp, Homo sapiens
  misc_feature: GYAE6OF02FUB97.16.4.A04.1.454.CMB.1.raw
  modified_base (156)..(156): a, c, t, g, unknown or other
  misc_feature (156)..(156): n is a, c, g, or t
  modified_base (362)..(362): a, c, t, g, unknown or other
  misc_feature (362)..(362): n is a, c, g, or t
  modified_base (478)..(478): a, c, t, g, unknown or other
  misc_feature (478)..(478): n is a, c, g, or t
  modified_base (497)..(497): a, c, t, g, unknown or other
  misc_feature (497)..(497): n is a, c, g, or t
tcagtgtactactccacgaccggtgctcgatttagagtagtgatcagggggagtcagactcagtcaggacacagcatggacatgagggtccccgctcagctccgtggggcctcctgctgctcgtggcctcccgaggtcgaccaaatgtagaacctntccagatcgacccagtcctccttccacctgtctgcattcgtggtaggacgacgagtacgtaccacctagtccgtcgttcggccccggaccacttacgaaggtacgttagttaacgcggtagggttcggttcggcgttggtacttcgacgacgaaacgaaaccggacggggaaccgtccccgtagaccttcgtagtattcgttaagngtactcgaccgagtacgttaacggttaaggaaaccgggttcgggtacccaagtacgtaacgtattcgacggacgtacgaggttcggacttacggtaaggggacagggtacttaccncctactccacgtataccgngtaccgacgtaccgcgtaccgtacgtccgttagttacgttgttactttacccgaacttaacctttagttacgtaacaacccgtaaagttacgtttaacttaacggttaacgttaccgttacggtacgggttaccggttacccggaccgggaacgggtaccggtagggaacgtacctaacgtaacccggtaaaggtccgttgggtacgtccgcgttaccgacgttacg

SEQ ID NO: 158724 - DNA, 737 bp, Homo sapiens
  misc_feature: GYAE6OF02IH8L2.16.4.A04.1.454.CMB.1.raw
  modified_base (134)..(134): a, c, t, g, unknown or other
  misc_feature (134)..(134): n is a, c, g, or t
  modified_base (349)..(349): a, c, t, g, unknown or other
  misc_feature (349)..(349): n is a, c, g, or t
tcagtgtactactccacgaccggtgctcgatttagagtagtgatcagggggagtcagactcagtcaggacacagcatggacatgagggtccccgctcagctccgtgggctcctgctgctctggcctccgaggtnaccaatgtgacatcccgagagtcgaccctagttcctcccttaccacccgtgtctgactatcgtggaggacgtacgacggatccaaccgtgtccggtcgttacgggcccgggtaccaacgtctaggtacgtggtttagccggtaggttcgggttgccgttggtactcgacgacgaacgaaaccggtaggggaaccgtcccgtagaaccgtccgtanaacgttcgtatgtacgtcgcgacgtcgtaagtttaacggaaacggttcgggacctaagtacacggttactacgacggtacggtcgtaggtcggtaacgttccgggtaggaacctaggtccgttaacgtacccttcgaacccgtacctaagttaccgacgtaaccgtacggccttacgcccgtaacggcccgttaggtacgtttacggttatttaccggaaccttaacgttaacgtttcgtaaccgtaacctaccgtaaattaacgttaaacggtttcgtaccgttacggtaccgggttaacccgttaccgggacgtaaccgggtaccggaacggtacgactaacggtaaccgaacgtcgtcggccgttagaccgtaccggtactaccg

SEQ ID NO: 158725 - DNA, 782 bp, Homo sapiens
  misc_feature: GYAE6OF02JMMRU.16.4.A04.1.454.CMB.1.raw
  modified_base (765)..(765): a, c, t, g, unknown or other
  misc_feature (765)..(765): n is a, c, g, or t
tcagtgtactactccacgaccggtgctcgatttagagtagtgatcagggggagtcagactcagtcaggacacagcatggacagtgagggtccccgcgtcagctccgtggggctcctgctgctctggctcccaggtcgccaaatgtcgacgtactccagatcgaccctgtcctccttccacccgtgtctcgctacgtcttaggtacggacgacgacgtacgtaccaaccgtcttccggtccgttccggcccgggaccctacgtaccgaaggttacggttacggttacgcgttaaggggttcggtttcggaccgttgggtaactcggaacggtaccgaacggaacccggtaggggtaacccgtccccgtacgtaacccgttcccggtagtacgtaccgtagttacgacgttcgaccgtagtaccgttaacggtttaacgggaacgggttccgggtacctaggttaaccgagttacgttacgacggcgtacggtaggttacggagttaccggacgggtaacgtaacgtacggttacctaacggttcctaaaccgaccttaagccgtaagaccggtacgaccgttcaacggtccgtacgtagtaacttaccggttacgtttagaacccctttaagtttgtaaccgttaccggaaacttaacggttataacgttacgttacgttaccggtcggtaaccggttccgtaccggtaccggtaacgggtaacggtcgggtactaacgtaacgtacggaacgttacgcggttacncgtacgtcaaccgttcg

SEQ ID NO: 158726 - DNA, 714 bp, Homo sapiens
  misc_feature: GYAE6OF02HJLM7.16.4.A04.1.454.CMB.1.raw
  modified_base (93)..(93): a, c, t, g, unknown or other
  misc_feature (93)..(93): n is a, c, g, or t
  modified_base (185)..(185): a, c, t, g, unknown or other
  misc_feature (185)..(185): n is a, c, g, or t
  modified_base (221)..(221): a, c, t, g, unknown or other
  misc_feature (221)..(221): n is a, c, g, or t
  modified_base (300)..(300): a, c, t, g, unknown or other
  misc_feature (300)..(300): n is a, c, g, or t
  modified_base (334)..(334): a, c, t, g, unknown or other
  misc_feature (334)..(334): n is a, c, g, or t
tcagtgtactactccacgaccggtgctcgatttagagtagtgatcaggggagtcagactcagtcagacacagcatggacatgagggtccccgntcagctccgtgggctcctgctgctctggcctccgaggtgacaatgtgacactccgagtatcgacctgttcctcccttacctacccttgtccngtcagttcgtaggtagcgtagacgtcgtacaccgtntcgtcgtcccgggacccgtacctactacgagttacggttagttagaccggttaggttggtcgtacggtgtacgtacganaccgaagtaaccggacggacccgtacacgtacgntcgtattacgtaagccttaggacctacggtaacttagttaacggtaacgggttaacggttcccggtacttaaccgtacgtaaacgttcgaacctacgggtccggtaaaggacggttcggtaaacgttcggaacggttaacaccggtttacgccgtttacctacggtacccgtaactacgtactccgacgtacgtcagtccgattcggagttaccgttagttacgttaacctacttactttaggtaactacggtaccttaaggtaattacgttaacgttcgttaaccgttaggaccggttaccgtaacggacggtaacggccgtggataacggtaaccaaggttacgcggtaccgtggtacgacgttacccggtttaaccg

SEQ ID NO: 158727 - DNA, 1036 bp, Homo sapiens
  misc_feature: GYAE6OF02GD1FY.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctggctcccaggtgaccaaatgtgacatccaagatcgaccctagtcctcccttcccaccctgtctgcctatctggtaggacgaacgagtacgtaccacccgtactcggtccgttccggcccgggtaccctaccgtccgaaggtacgttaggttaacggccggtaaggggtttcgggttcgggtaccgttagggtacttcgaacggaccgaaaacgggaaaacccggaacgggggtaaaccgggtccccccgttaacggtaaaccccgttaccgttagtaacgttaccgttaacggttacgtacgtaccggaccgtaacggtaaccggtttaacgggtttaaacggggtaaaaccggggttaccgggggttaaccctaacggttaacggtaaaaccggttacgttaccggaacgggtccggtacggtaaggtacggttaacggttcgggtaacggggtaaaccggtaaggttacgtttacccgtaaccgttaccgtaccctaaaccgtaccgtacgtaacggacccgtaccggtccgtacggtaccgaccgttaccgttaagggtaacgttttacgttaaacggttttaccgtaaacccgttaaacctttttacgttaaaccggtttaacccggtaaacccttaaacggtttaaacgtttaaacgttttaaacggtttttaaccgtttaccgggttttaacccgggttaccggggtttaaaccggggttaacccccgggtaaacgggggtttaaaccccgggggtaaccggggttttaaacggggggttaaacccggtaaaacccggttaaaccccgggtttaaaaaccggtaaaaccccggttttaacggggggttaccgggttaaccccggggttactttaaccccggggacccgtttaaacccggtttaacccgg

SEQ ID NO: 158728 - DNA, 576 bp, Homo sapiens
  misc_feature: GYAE6OF02GDVUB.16.4.A04.1.454.CMB.1.raw
  modified_base (361)..(361): a, c, t, g, unknown or other
  misc_feature (361)..(361): n is a, c, g, or t
  modified_base (389)..(389): a, c, t, g, unknown or other
  misc_feature (389)..(389): n is a, c, g, or t
tcagtgtactactccacgaccggtgctcgatttagagtagtgatcaggggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttgccgggccactcagagtgttagcaggtggttggcctggtatcagcaagaaaccgagggaacggcccctggaacctcctggatctatgatcgccagctaagtttagaaaagtggggtacccatacaaagagttcaaggcggcaggtggatcgngggaacaggagttcactcgtaccaacgntcgagcagcctcgcgacgtcctagtagtagttacgttttcgacctaaacctttagttacttacgaacctaactagttaaataagttaagttactaccggtaggtaccgttacgggaccgtaacgggaccgtaagggtacgaacgtaactaacgtaaacgtaacgtcggtggacctacgacacctacg

SEQ ID NO: 158729 - DNA, 702 bp, Homo sapiens
  misc_feature: GYAE6OF02FQSIG.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatcgacccagtcctccttccacctgtctgcatctgtaggagacagagtcacctatcgcttcggcccggccactcgagagttgttagcgtagggttcggttcggccgttggtactcgacggacaacggaaccgagggaacggcccctagtaacctcgtagatctagtgactgccgagtcgtagtttaggaaacggttcgggtacctagtacgaagtacgttcgaggccggtacgtaggtcggtaacgtccggtaagggactaaggtacgttaccgaccgttcctaccaaccgtactacgacgtaccgtacgtcccgtacgcctaaccggtcgttagtacgttcggttacgtttaccggaaccttaaccgtttaagtttacgtaccgtaaccgttaacgtaacgtttaaagttaacgtttaacggtttacccgttacgggttacgggttaacccgttacccgggaacggtaaccgggtaccgggtaagggtacggtaaccctaacgttaaccgaacgttacggttggtaccgtagtccggtacctaccttacgg

SEQ ID NO: 158730 - DNA, 896 bp, Homo sapiens
  misc_feature: GYAE6OF02FINA5.16.4.A04.1.454.CMB.1.raw
  modified_base (190)..(190): a, c, t, g, unknown or other
  misc_feature (190)..(190): n is a, c, g, or t
tcagtgtactactccacgaccggtgctcgatttagagtagtgatcagggggagtcagactcagtcaggacacagcatggacatgagggtccccgctcagctcctgggctcctgctgctctggctccaggtgccaaatgtgacagtccagatcgacccagtcctccttccaccctgtctgcattctgtagngacagagtcacctagtccgcgttacgcccgggccactcagtagtgttagcgtagggtgtcggcctggtactcacgtacacgaaaccgacggggaacggtcccctaggaacctcctaggtacttcgtaatacgtacgtcgccgtaacgtcggttaagtttaacggaaacgggttccggggtaccctaagttaccgaaacggtaccttacggaccggaccgggtactaacgggttacgggaccgttacggtacgggtaaccgtaaggttacccgtttaccgaccgttcccgtaacctaacccgtaaaggtttcccaaaccgggttcccgtaacggttaccccgtacggtacccgtaaccgggtcccttttaggggtaacttttaacgggtttacgtttttacccgggttaaccctttaaaacccggttttaagttttaacccgttaacccggaaaccgtttaaaacgttaaaccggggtttaaactttttaaaaccggtttaccgggggttaaaccccgttttaccgggtttaaccggggggttaaccccgttaccgggggtaaccccggtaaacgggggttacccggtttaaacggggggtaacccgtaaaccccggtttaaggtttaaaaccccggaaaagggttacccggtttacggggtaacccggtttaccgtaaccggttacccgtacccggttttaacggg

SEQ ID NO: 158731 - DNA, 643 bp, Homo sapiens
  misc_feature: GYAE6OF02FS7OH.16.4.A04.1.454.CMB.1.raw
  modified_base (313)..(313): a, c, t, g, unknown or other
  misc_feature (313)..(313): n is a, c, g, or t
tcagtgtactactccacgaccggtgctcgatttagagtagtgatcagggggagtcagactcagtcaggacacagcatggacatgagggtccccgctcagctcctggggctcctgctgctctggcctcccgaggttgccaatgtgacatccagatcgacccagtcctccttccaccctgtctgcagttctggtaggagacagagtccaaccgtagtcggcgttcggcccgggccactcgagagttgtagcgtaggtggttcggccttggtactcgagacaacgaaaccggagggtaaccggcccctagacctcngtactcgtagtgagtcgcctagacgttagttacggaaggtcgggtaccagtaccgaagtacttacgagcggtacaggtagacgttcgtaggggaacctggtacgtcctacgtccaccactacgtacgagcgtacgacgtcgaccgtagtccgtagtctcgttactttcgaacccttaacgtttgttacgtactaacccgtaagtattaacttaagttagttacgtccggttaggtaaccgttcggtaccggtaacggaccggtaacgggttacgaccgtaacgttaacgaacgttacggcggttacggccgtcgaccgtacgttaacccg

SEQ ID NO: 158732 - DNA, 725 bp, Homo sapiens
  misc_feature: GYAE6OF02IL2S1.16.4.A04.1.454.CMB.1.raw
tcagtgtactactccacgaccggtgctcgatttagagtagtgatcagggggagtcagactcagtcaggacacagcatggacatgagggtccccgctcagctcctggggctcctgctgctctggcctcccgagggtcgaccaaagtgtgacatccagatgacccagtctcccttccaccctgtctgcatctagtaggagacagagtcacctatcgtcgttcggcccgggccactcgagagtgttagcgagggttggttggccgtggtatcagacaagaaccgagggaaccgcccctgaacctccgtagacttctagtgatcgaccagtacgttaggttaaggaaacggttcgggtacccaagtacgaagtacgttacgacggccggtactaggtacggtacgttacggtaggggaacctaaggtacgttacctaccgttacctaccaaccctacgtaccgaccgtaccgaccggtccgtacgccgtaacgtccgttaaggtagtttacgtttactttaccgaaccctttaaaccttagtttacgttacctaacccgtaaagttaacgttaatttaagtttaccgtttaacggtcccgggttaacgggtaccggtttaccgggaccggtaaacgggtaacccgggtaggggttaaccgaacgttaaccgtaaccggtaaaccgtaacggttcgggttacggtaccgtacggtacccgtaccgttacg

SEQ ID NO: 158733 - DNA, 666 bp, Homo sapiens
  misc_feature: GYAE6OF02G6BES.16.4.A04.1.454.CMB.1.raw
  modified_base (196)..(196): a, c, t, g, unknown or other
  misc_feature (196)..(196): n is a, c, g, or t
  modified_base (319)..(319): a, c, t, g, unknown or other
  misc_feature (319)..(319): n is a, c, g, or t
  modified_base (420)..(420): a, c, t, g, unknown or other
  misc_feature (420)..(420): n is a, c, g, or t
tcagtgtactactccacgaccggtgctcgatttagagtagtgatcagggggagtcagactcagtcaggacacagcatggacatgagggtccccgctcagctccgtggggctcctgctgctctggctcccaggtgaccaaatgtagacatccagatacgacccagtcctccttccaccctgtctgcatctagagganacagagtcaacctagtccgtcttcggcccggccactcgagtagttgtagcgagggttggttcggcctaggtatcgaggtacaacgaaaccgagggaaccgccccgtagacctctgatcgtaangatcgacagatagttaagaaaggtcggtaccaagtcaagtctacgagggcgacgtaggtacggtagtcgtaggggaactacgggtaacttctaacccgtanaccgaactacgtcgacggacgacgtccgtgaccgacgttcctaggttacttagtttaccgttacgaacttaaaccgttgttaacctaccgtaaacctaaacggtaaacttaaactaaagtttaccgttaccggtacggtaaccgggttaacgttacccgggaacggtaaccgggaacggttacggaccgaaacgttacgtaaaccgtaacggtcgtacggacgtacggttaccacggaccttacgg

SEQ ID NO: 158734 - DNA, 730 bp, Homo sapiens
  misc_feature: GYAE6OF02G05O8.16.4.A04.1.454.CMB.1.raw
  modified_base (191)..(191): a, c, t, g, unknown or other
  misc_feature (191)..(191): n is a, c, g, or t
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctggtagganacagagtcacatcgcttggccggccactcagagtcgttagcgaggtggttcggcctggtatcagacaagaaaccgagggaacgcccctagtaactcctagactcgtaatgactcgacagtacgtaacggtttaaggtaaaacgggtccggggtacctaagtaccgtaaaaggtacgtttacccgaagggccgggtacgtaacggttacggtaacgttacggtaacgggggaacctagggttaacggttacctaacttccgttaaccaaccctaagtaccgtaaggaccctaacgggtaccttagacgaaccggttaccctaggttaacgttaggtttactttacggtaaccttaaaccttaagtttaacttccggtaaacccgtaataacggtttaaattaacgttaagtttaaccgtacggttacgggtaacgttaccccgggacgttaaccgggaccggtaagggtaccgtaacggaacttaaccggtaaaacgtaccggttacgtaccggtacgtacccggacgtaaccttaccgg

SEQ ID NO: 158735 - DNA, 748 bp, Homo sapiens
  misc_feature: GYAE6OF02FNJHP.16.4.A04.1.454.CMB.1.raw
  modified_base (299)..(299): a, c, t, g, unknown or other
  misc_feature (299)..(299): n is a, c, g, or t
  modified_base (710)..(710): a, c, t, g, unknown or other
  misc_feature (710)..(710): n is a, c, g, or t
tcagtgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccacctgtctgcatctgtaggagacagagtcaccatcgtcgttcgcccggaccactcgagtagtgttacgcgtaggttggtcggccgttagtactcagccaacggaaccgagggaccgtccctagaacctcgngtactctatgtatcgactagtacgttaggttaggaacgggttcgggaccctaagtacgaacgttacttcgaggtccgggagtacggtaagtcgtacggtaacgggacgtaccggttacgttccacgttacctacgtacctacgttcaacgggtacctaacggtcctacgtacccgacggttccgtacggttaacgtttacggtttaacgtttaccggtaaacccttaaccgttttacgttaaagtttcccggtaaaccttaaaccgggtttagtttaaaaccgttacgtttttaaacgggtacccggttttaacccgggtcgggtttaaacccgggtccggggtaacccgtaaggggggtaccgttaacggggaaccggttactaaaccgttaaaccggtaaacccgggtnttaccgggttccggtacgtaaccgtccgtaacgttccg

SEQ ID NO: 158736 - DNA, 822 bp, Homo sapiens
  misc_feature: GYAE6OF02F9OBN.16.4.A04.1.454.CMB.1.raw
tcagtgtactactccacgaccggtgctcgatttagagtagtgatcagggggagtcagactcagtcaggacacagcatggacatgagggtccccgctcagctccgtggggctccgtgctcgctctggcctcccgaggtcgaccaaagtgtgacatccagatcgaccagtcctccttacccacccgtgtctagctacttcgtacggtaaggagtaacgacgtacgtaccaccagtccgtccggttacggcccgggaccactcgaggtagtcgttagcgtagggttcgggttacggccgtaggtactcgaagacgaaacggaaacggaacgggaccggtcccctaggtaaccctccgtagtaactcgttaacgtgtacgtacgaccgtacgtacgttaaaggtttacggaaaacgggttacccggggtaccaagttaacgtacggttaacttacggacggtacggtacgtacggtaggtacgtcgggtacgggtaacctaggttaccgttacgaccttccgacctacacgtacgtccgtaccgtacggccgtacgtaccgaccgtacgtagttactacgtttacgttaccgtaacttaaaccgtttacgttacgtacgttaaacctaaagttaacggtttaaattaaccgggtttacgtttaaccgacccggttaacggggttaccgttaacccggggaaccggggttacgggtaaacccggtaggggttaaccgtaaacccggtaacggtttaaacccgaaagggttcccggttaagggtaccccggtttaacggtacccgttaacgggtacccgtttaaccgg

SEQ ID NO: 158737 - DNA, 806 bp, Homo sapiens
  misc_feature: GYAE6OF02HN7M7.16.4.A04.1.454.CMB.1.raw
  modified_base (150)..(150): a, c, t, g, unknown or other
  misc_feature (150)..(150): n is a, c, g, or t
  modified_base (192)..(192): a, c, t, g, unknown or other
  misc_feature (192)..(192): n is a, c, g, or t
  modified_base (200)..(200): a, c, t, g, unknown or other
  misc_feature (200)..(200): n is a, c, g, or t
  modified_base (424)..(424): a, c, t, g, unknown or other
  misc_feature (424)..(424): n is a, c, g, or t
tcagtgtactactccacgaccggtgctcgatttagagtagtgatcagggggagtcagactcagtcaggacacagcatggacatggacgggtccccgctcagctccgtgggctcctgctgctctggcctcccgaggtcgaccaaatggtanaactctcccagaagtccgaaccctagttcccttcccttcccnccccgttntccgtgacctaatccgttaggaacggaacgacgtacggaagtaccaaccgtacgttcccggtacgttccgggacccggggtacctacctacgaagggtaggtttgtaacggcgttagggggttcggttcgggtccgttaggtacgtaccgtaaggaccgaaacgaaaccgggaacggggtaccggtacctacggtaaccctacgtcgtaacgttcctagtacgngttccgccgtacgagtttaggttaaggtaaccggttacggggacctacgtagaagttagtcgaacggcggacggtaggtacgtagtagggtacgtaactaggtaccgttcaccctacctacgcctaacggaccgtacgaccgtaggtaccgcgccgtacggtcagggttccgtagttacctttacgaaccttactacgttgttacccacgtaacttaacgtagttaaccggttagttaaccggtcggttaacggtaccggggttaacgtaccgggtaaccggggtcggttaacggggtacccggtattaaacccggtaacccggggtaacttaacggggtacggttaccggttaccgtaaccgggtaccttacgttacccgg

SEQ ID NO: 158738 - DNA, 903 bp, Homo sapiens
  misc_feature: GYAE6OF02FVEBH.16.4.A04.1.454.CMB.1.raw
  modified_base (96)..(96): a, c, t, g, unknown or other
  misc_feature (96)..(96): n is a, c, g, or t
  modified_base (139)..(139): a, c, t, g, unknown or other
  misc_feature (139)..(139): n is a, c, g, or t
tcagtgtactactccacgaccggtgctcgatttagagtagtgatcgagggggagtcagactcagtcaggacacagcatggacatgagggtccccgntcagctccgtggggctcctgctgctctggcctcccgaagggtnacctaatggtagaccatcccaggacgtacgacccctagttcccttcccttacccacccgttgtcctacggacctattccgtagggaaggacgaactaggacgttccaaccgtagtcccgtcggttccgggacccccgggtacctaacgtcgtaagggtagttacggttaacgccgggttaaggggttcgggttcggtccggttacggttactcggaacgtaaccggaaccgggtaaaaccggaccgggggaaccgtaccccccggttaagtaccccgtttacgtacgttacttacgtacgtacgtacttacgaccgtagtacgttaaggtttaacggtacgggttccggtaccaacgtacgtaaggttaccgtacgtacggacggtacgtaggtacggtactcgggaacggtataaccgggtacctacgttacctcgtaactaccgtacgactacgtaacggtctaccgtcgggtacctaaccggtccgtaaggtttccttagtttaaccgttacgttaaacctttaacgtttacgttaccgttaaaccgtaacgttaacgtaacgtttaaacgtttaacggtttaaccgttaaccgggtttaaccgggttaccgttacccgggggttaaacccgtaccggggtaaaacccgggggttgggtaaaccggggtaaccgtttaaaacccaaccggggtttaaacccgtaaacgttaccggttcggttaacccggttaaccgccctaaccgggtactttaacccggg

SEQ ID NO: 158739 - DNA, 362 bp, Homo sapiens
  misc_feature: GYAE6OF01EB2SF.18.75.G09.1.454.CMB.1.raw
  modified_base (357)..(362): a, c, t, g, unknown or other
  misc_feature (357)..(362): n is a, c, g, or t
tcagtacgagtatgcacgaccggtgctcgatttagtatagacatcaggggagtctggtgcgttttgggcattgatggacacccctgagccctatttcccagacgctcccccagcccctcagccccagaagtggaatgcgtttgcagtagggctttgggaatggggctgtgtcactgattatgcttttgatatctggggccaagggacaatggtcaccgtctcttcagcctccaccaaggcccatcgtctcccctggcgccctgctccaggagcacctccgagagcacagcggccctgggctgcctggtcaaggactacttcccatactcgtactgagcggctggcaaggcgcatagnnnnnn

SEQ ID NO: 158740 - DNA, 372 bp, Homo sapiens
  misc_feature: GYAE6OF01EJRWU.18.75.G09.1.454.CMB.1.raw
  modified_base (283)..(283): a, c, t, g, unknown or other
  misc_feature (283)..(283): n is a, c, g, or t
  modified_base (362)..(362): a, c, t, g, unknown or other
  misc_feature (362)..(362): n is a, c, g, or t
  modified_base (368)..(372): a, c, t, g, unknown or other
  misc_feature (368)..(372): n is a, c, g, or t
tcagtacgagtatgcacgaccggtgctcgatttagtatagacatcaggggagtctggtgcgttttgggcattgatggacacccctgagccctatttcccagacgcctcccccagcccctcagccccagaagtggaatgcgtttgcagtagggctttgggaatgggggctgtgtcactgattatgcttttgatatcgtggggccaagggacaagtggtcaccgtctcttcacgcctccaccaacgggcccatccggtccttcccctggccgccctgctccaggngccacctccgagagcacagcgccctgggctgcctggccaaggctacttcccatactcgtactgagcggctggacaggcncatagnnnnn

SEQ ID NO: 158741 - DNA, 394 bp, Homo sapiens
  misc_feature: GYAE6OF01BEVFH.18.75.G09.1.454.CMB.1.raw
  modified_base (385)..(394): a, c, t, g, unknown or other
  misc_feature (385)..(394): n is a, c, g, or t
tcagtacgagtatgcacgaccggtgctcgatttagtatagacatcaggggagtctggtgcgttttgggcattgatggacacccctgagccctatttcccagacgcctcccccagcccctcagccccagaagtggaatgcgtttgcagtagggctttgggaatggggctgtgtcactgattatgcttttgatatcgtgggccaagggacaatggtcaccgtctcttcacgcctccaccaaggcccactccggtcctcccctggccgccctgctccgaggcgccaccctcgagagcacacggccggccccgtgggcctggcctggtccaaaggtcctaccttcccataccgtcgtactgacggccgggctggacaaggcgacatagnnnnnnnnnn

SEQ ID NO: 158742 - DNA, 378 bp, Homo sapiens
  misc_feature: GYAE6OF01CWDZM.18.75.G09.1.454.CMB.1.raw
  modified_base (365)..(365): a, c, t, g, unknown or other
  misc_feature (365)..(365): n is a, c, g, or t
  modified_base (370)..(378): a, c, t, g, unknown or other
  misc_feature (370)..(378): n is a, c, g, or t
tcagtacgagtatgcacgaccggtgctcgatttagtatagacatcaggggagtctggtgcgttttgggcattgatggacacccctgagccctatttcccagacgctcccccagcccctcagccccagaagtggaatgcgtttgcagtagggctttgggaatgggggctgtgtcactgattatgcttttgatatctggggccaagggacaatggtcaccgtctcttcagcctccaccaaggcccatccggtcttcccctggccgccctgctccaggagcacctccgagacgcacagccggcccctgggctcgcctggtcaaggacctacttcccattactcgtactgagcgggctggcaaggcganatagnnnnnnnnn

SEQ ID NO: 158743 - DNA, 452 bp, Homo sapiens
  misc_feature: GYAE6OF01E2ZLS.18.75.G09.1.454.CMB.1.raw
  modified_base (287)..(287): a, c, t, g, unknown or other
  misc_feature (287)..(287): n is a, c, g, or t
  modified_base (407)..(408): a, c, t, g, unknown or other
  misc_feature (407)..(408): n is a, c, g, or t
  modified_base (410)..(410): a, c, t, g, unknown or other
  misc_feature (410)..(410): n is a, c, g, or t
  modified_base (413)..(414): a, c, t, g, unknown or other
  misc_feature (413)..(414): n is a, c, g, or t
  modified_base (416)..(452): a, c, t, g, unknown or other
  misc_feature (416)..(452): n is a, c, g, or t
tcagtacgagtatgcacgaccggtgctcgatttagtatagacatcaggggagtctggtgcgttttgggcattgatggacacccctgagccctatttcccagacgctccccccagcccctcagccccagaagtggaatgcgtttgcagtagggctttgggaatgggggctgtgtcactgattatgtcttttgatatctggggccaagggacaagtggtcaccgtctcttcagcctccaccaaggccccatccggtccttcccccgtggccgccctgcctccgaggacnccaccctccgagacgccacaggccggccctggggcctcggcccttgggtaccaaggtaccttaccttcccaattacctccgtactggacggcgggctcggacgaacggccgacagtagcnngnagnngnnnnnnnnnnnnnnnnnnnnnnnnnnnnnnnnnnnnn

SEQ ID NO: 158744 - DNA, 417 bp, Homo sapiens
  misc_feature: GYAE6OF01CJ994.18.75.G09.1.454.CMB.1.raw
  modified_base (269)..(269): a, c, t, g, unknown or other
  misc_feature (269)..(269): n is a, c, g, or t
  modified_base (402)..(402): a, c, t, g, unknown or other
  misc_feature (402)..(402): n is a, c, g, or t
  modified_base (409)..(417): a, c, t, g, unknown or other
  misc_feature (409)..(417): n is a, c, g, or t
tcagtacgagtatgcacgaccggtgctcgatttagtatagacatcaggggagtctggtgcgttttgggcattgatggacacccctgagccctatttcccagacgcctcccccagcccctcagccccagaagtggaatgcgttgcagtagggctttgggaatggggctgtgtcactgattatgtcttttgatatcgtgggaccaagggacaagtggtcaccgtctcttcacgcctaccaccgaagggccctatccggtcctttcccccgnggccgtccctcgcctccgaggacgccaccgtccgagacgcacgcgccggccctgggctacggtcctacggtcaaacggtaccttacctcccaataccgtcgtaaccgtgacggcgggcgtcggacaacgggcncatagcnnnnnnnnn

SEQ ID NO: 158745 - DNA, 380 bp, Homo sapiens
  misc_feature: GYAE6OF01A5L8W.18.75.G09.1.454.CMB.1.raw
  modified_base (301)..(301): a, c, t, g, unknown or other
  misc_feature (301)..(301): n is a, c, g, or t
  modified_base (373)..(380): a, c, t, g, unknown or other
  misc_feature (373)..(380): n is a, c, g, or t
tcagtacgagtatgcacgaccggtgctcgatttagtatagacatcaggggagtctggtgcgttttgggcattgatggacacccctgagccctatttcccagacgctcccccagcccctcagccccagaagtggaatgcgtttgcagtagggcttgggaatggggctgtgtcactgattatgcttttgatatctggggccaagggacaatggtccaccgtctcttcagcctccaccaagggccccatccggtccttcccccgtggccgccctgcctcccaggacgcacctccgagacgcacngcggccctgggcctggcctggtcaaggctactcccatactcgtactgacgcgggctggcaaggcgacatagnnnnnnnn

SEQ ID NO: 158746 - DNA, 442 bp, Homo sapiens
  misc_feature: GYAE6OF01DC231.18.75.G09.1.454.CMB.1.raw
  modified_base (413)..(413): a, c, t, g, unknown or other
  misc_feature (413)..(413): n is a, c, g, or t
  modified_base (421)..(442): a, c, t, g, unknown or other
  misc_feature (421)..(442): n is a, c, g, or t
tcagtacgagtatgcacgaccggtgctcgatttagtatagacatcaggggagtctggtgcgttttgggcattgatggacacccctgagccctatttcccagacgcctccccccagcccctcagccccagaagtggaatgcgtttgcagtagggctttgggaatgggggctgtgtcactgattatgtcttttgatatcgtggggccaagggacaagtggtcaccgtctcttcacgcctccacaacgggcccatccggtcctccccgtggccgccctgcctccgagggacgacctaccgtccgaagcgccgaacgacggccggccccgtggggcctgcccgttggtaccgaaacggtaccttaccttcccaattaccgtcggtactggacggcgggctacgggacaagggccganaagtagcnnnnnnnnnnnnnnnnnnnnnn

SEQ ID NO: 158747 - DNA, 467 bp, Homo sapiens
  misc_feature: GYAE6OF01DRPV9.18.75.G09.1.454.CMB.1.raw
  modified_base (442)..(467): a, c, t, g, unknown or other
  misc_feature (442)..(467): n is a, c, g, or t
tcagtacgagtatgcacgaccggtgctcgatttagtatagacatcaggggagtctggtgcgttttgggcattgatggacacccctgagccctatttcccagacgcctcccccagccccctcacgccccagaagtggaatgcgtttgcagtagggctttgggaatgggggctgtgtcactgattatgtcttttgatatcgtggggaccgaagggacaagtggtccaccgttctcttcacgcctaccaccgaacgggcccagttccggttcccttcccccgtcggccgccctgcctccgaaggcgaccacccgtacgagacaccaccgaggccccggtccctgggcctcggccgtcggacaacggtacctacccgttcccaacttaccgtcgtacgtcggtaccgggccgggtcgtacgggacggaacggccgaacgtagtagnnnnnnnnnnnnnnnnnnnnnnnnnn

SEQ ID NO: 158748 - DNA, 578 bp, Homo sapiens
  misc_feature: GYAE6OF01CISXP.18.75.G09.1.454.CMB.1.raw
  modified_base (547)..(578): a, c, t, g, unknown or other
  misc_feature (547)..(578): n is a, c, g, or t
tcagtacgagtatgcacgaccggtgctcgatttagtatagacatcaggggagtctggtgcgttttgggcattgatggaccacccctgagccctatttccccagacgccctcccccacgcccctcacgccccagaagtggaatgtcgtttgcaggtagggtcgtttaggggaagttgggggcttggttgtaccacgttagtaatttacgtggttctttttaggatttagttccggtacggggggacccgaaagggggtaaccaaagttcgggtcctaacccggttcttccttaccgacgtcccctaccgaacccgaacgggcccctacggttccccggttcccttccccccgtgggccctccccgtgtacccgtaccggacggaccgcccaacccggtaccgacgacgacccgaacgccggcccgggtcccggtcgggtcctcggtcccgttggaccgtaaacggtcccttaccgttaccctacgttaccgttacgtacgtcgggtacgggccgggtggtaccgacggaacggaccgacgacgagcgnnnnnnnnnnnnnnnnnnnnnnnnnnnnnnnn

SEQ ID NO: 158749 - DNA, 367 bp, Homo sapiens
  misc_feature: GYAE6OF02IC9OM.18.75.G09.1.454.CMB.1.raw
  modified_base (362)..(367): a, c, t, g, unknown or other
  misc_feature (362)..(367): n is a, c, g, or t
tcagtacgagtatgcacgaccggtgctcgatttagtatagacatcaggggagtctggtgcgttttgggcattgatggacacccctgagccctatttcccagacgctcccccagcccctcagccccagaagtggaatgcgtttgcagtagggctttgggaatggggctgtgtcactgattatgcttttgatatctggggccaagggacaatggtcaccgtctcttcagcttccaccaagggcccatcggtcttccccctggcgccctgctccaggagcacctctgggggcacagcggccctgggctgcctggtcaaggactacttcccatactcgtactgagcgggctggcaaggcgcatagnnnnnn

SEQ ID NO: 158750 - DNA, 367 bp, Homo sapiens
  misc_feature: GYAE6OF02HATTX.18.75.G09.1.454.CMB.1.raw
  modified_base (362)..(367): a, c, t, g, unknown or other
  misc_feature (362)..(367): n is a, c, g, or t
tcagtacgagtatgcacgaccggtgctcgatttagtatagacatcaggggagtctggtgcgttttgggcattgatggacacccctgagccctatttcccagacgctcccccagcccctcagccccagaagtggaatgcgtttgcagtagggctttgggaatggggctgtgtcactgattatgcttttgatatctggggccaagggacaatggtcaccgtctcttcagcctccaccaagggcccatcggtcttccccctggcgccctgctccaggagcacctccgagagcacagcggccctgggctgcctggtcaaggactacttcccatactcgtactgagcgggctggcaaggcgcatagnnnnnn

SEQ ID NO: 158751 - DNA, 365 bp, Homo sapiens
  misc_feature: GYAE6OF02HMYDM.18.75.G09.1.454.CMB.1.raw
  modified_base (361)..(365): a, c, t, g, unknown or other
  misc_feature (361)..(365): n is a, c, g, or t
tcagtacgagtatgcacgaccggtgctcgatttagtatagacatcaggggagtctggtgcgttttgggcattgatggacacccctgagccctatttcccagacgctcccccagcccctcagccccagaagtggaatgcgtttgcagtagggctttgggaatggggctgtgtcactgattatgcttttgatatctggggccaagggacaatggtcaccgtctcttcagcctccaccaagggcccatcggtcttccccctggcgccctgctccaggagcacctccgagagcacagcggccctgggctgcctggtcaaggctacttcccatactcgtactgagcgggctggcaaggcgcatagnnnnn

SEQ ID NO: 158752 - DNA, 366 bp, Homo sapiens
  misc_feature: GYAE6OF02HL8NN.18.75.G09.1.454.CMB.1.raw
  modified_base (361)..(366): a, c, t, g, unknown or other
  misc_feature (361)..(366): n is a, c, g, or t
tcagtacgagtatgcacgaccggtgctcgatttagtatagacatcaggggagtctggtgcgttttgggcattgatggacacccctgagccctatttcccagacgctcccccagcccctcagccccagaagtggaatgcgtttgcagtagggctttgggaatggggctgtgtcactgattatgcttttgatatctggggccaagggacaatggtcaccgtctcctcagcctccaccaagggcccatccggtcttcccctggcgccctgctccaggagcacctccgagagcacagcggccctgggctgcctggtcaaggactacttccatactcgtactgagcgggctggcaaggcgcatagnnnnnn

SEQ ID NO: 158753 - DNA, 367 bp, Homo sapiens
  misc_feature: GYAE6OF02H0OO8.18.75.G09.1.454.CMB.1.raw
  modified_base (361)..(367): a, c, t, g, unknown or other
  misc_feature (361)..(367): n is a, c, g, or t
tcagtacgagtatgcacgaccggtgctcgatttagtatagacatcaggggagtctggtgcgttttgggcattgatggacacccctgagccctatttcccagacgctcccccagcccctcagccccagaagtggaatgcgtttgcagtagggctttgggaatggggctgtgtcactgattatgcttttgatatctggggccaagggacaatggtcaccgtctcttcagcctccaccaagggcccatcggtcttccccctggccgcctgctccaggagcacctccgagagcacagcggccctgggctgcctggtcaaggctacttcccatactcgtactgagcgggctggcaaggcgcatagnnnnnnn

SEQ ID NO: 158754 - DNA, 363 bp, Homo sapiens
  misc_feature: GYAE6OF02GNPMU.18.75.G09.1.454.CMB.1.raw
  modified_base (352)..(352): a, c, t, g, unknown or other
  misc_feature (352)..(352): n is a, c, g, or t
  modified_base (358)..(363): a, c, t, g, unknown or other
  misc_feature (358)..(363): n is a, c, g, or t
tcagtacgagtatgcacgaccggtgctcgatttagtatagacatcaggggagtctggtgcgttttgggcattgatggacacccctgagccctatttcccagacgctcccccagcccctcagccccagaagtggaatgcgtttgcagtagggctttgggaatgggggctgtgtcactgattatgcttttgatatctggggccaagggacaatggtcaccgtctcttcagcctccaccaagggcccatcggtcttcccctggcgccctgctccaggagcacctccgagagcacagcggccctgggctgcctggtcaaggctactccatactcgtactgagcggctggcaaggcncatagnnnnnn

SEQ ID NO: 158755 - DNA, 365 bp, Homo sapiens
  misc_feature: GYAE6OF02GQECQ.18.75.G09.1.454.CMB.1.raw
  modified_base (362)..(365): a, c, t, g, unknown or other
  misc_feature (362)..(365): n is a, c, g, or t
tcagtacgagtatgcacgaccggtgctcgatttagtatagacatcaggggagtctggtgcgttttgggcattgatggacacccctgagccctatttcccagacgctcccccagcccctcagccccagaagtggaatgcgtttgcagtagggctttgggaatggggctgtgtcactgattatgcttttgatatctggggccaagggacaatggtcaccgtctcttcagcctccaccaagggcccatcggtcttccccctggcgccctgcctccaggagcacctccgagagcacagcggccctgggctgcctggtcaaggactacttcccatactcgtactgagcggctggcaaggcgcatagnnnn

SEQ ID NO: 158756 - DNA, 371 bp, Homo sapiens
  misc_feature: GYAE6OF02IFI9P.18.75.G09.1.454.CMB.1.raw
  modified_base (363)..(363): a, c, t, g, unknown or other
  misc_feature (363)..(363): n is a, c, g, or t
  modified_base (368)..(371): a, c, t, g, unknown or other
  misc_feature (368)..(371): n is a, c, g, or t
tcagtacgagtatgcacgaccggtgctcgatttagtatagacatcaggggagtctggtgcgttttgggcattgatggacacccctgagccctatttcccagacgctcccccagcccctcagccccagaagtggaatgcgtttgcagtagggctttgggaatggggctgtgtcactgattatgcttttgatatcgtggggccaagggacaagtggtcaccgtctcttcagcctccaccaagggcccatccggtccttcccccgtggccgccctgcctcccaggacgccacctccgagagcacagcggccctgggctgcctggtcaaggctactcccatctcgtactgagcgggctggacaggcncatgnnnn

SEQ ID NO: 158757 - DNA, 374 bp, Homo sapiens
  misc_feature: GYAE6OF02FSGOE.18.75.G09.1.454.CMB.1.raw
  modified_base (263)..(263): a, c, t, g, unknown or other
  misc_feature (263)..(263): n is a, c, g, or t
  modified_base (346)..(346): a, c, t, g, unknown or other
  misc_feature (346)..(346): n is a, c, g, or t
  modified_base (369)..(374): a, c, t, g, unknown or other
  misc_feature (369)..(374): n is a, c, g, or t
tcagtacgagtatgcacgaccggtgctcgatttagtatagacatcaggggagtctggtgcgttttgggcattgatggacacccctgagccctatttcccagacgctcccccagcccctcagccccagaagtggaatgcgtttgcagtagggctttgggaatggggctgtgtcactgattatgcttttgatatctggggccaagggacaatggtcaccgtctcttcagcctccaccaagggcccatcggtccttcccctggccnccctgcctccaggagccacctccgagacgcacagccggcccgtgggctggcctggtcaaggacctacttcccatactcgtacngagcggctggcaaggcgcatagnnnnnn

SEQ ID NO: 158758 - DNA, 373 bp, Homo sapiens
  misc_feature: GYAE6OF02H1429.18.75.G09.1.454.CMB.1.raw
  modified_base (360)..(360): a, c, t, g, unknown or other
  misc_feature (360)..(360): n is a, c, g, or t
  modified_base (366)..(373): a, c, t, g, unknown or other
  misc_feature (366)..(373): n is a, c, g, or t
tcagtacgagtatgcacgaccggtgctcgatttagtatagacatcaggggagtctggtgcgttttgggcattgatggacacccctgagccctatttcccagacgctcccccagcccctcagccccagaagtggaatgcgtttgcagtagggctttgggaatggggctgtgtcactgattatgcttttgatatctggggccaagggacaagtggtcaccgtctcttcagcctccaccaagggcccatccggtcttccccctggccgccctgcctccaggacgccacctccgagagcacaggcggccctgggctgcctggtcaaggactactcccatactcgtactgagcggctggcaggcncatagnnnnnnnn

SEQ ID NO: 158759 - DNA, 457 bp, Homo sapiens
  misc_feature: GYAE6OF02JW5RT.18.75.G09.1.454.CMB.1.raw
  modified_base (334)..(334): a, c, t, g, unknown or other
  misc_feature (334)..(334): n is a, c, g, or t
  modified_base (438)..(457): a, c, t, g, unknown or other
  misc_feature (438)..(457): n is a, c, g, or t
tcagtacgagtatgcacgaccggtgctcgatttagtatagacatcaggggagtctggtgcgttttgggcattgatggacacccctgagccctatttcccagacgcctcccccagccccctcacgccccagaagtggaatgcgtttgcagtagggctttgggatggggctgtgtcactgattatgtcttttgattatcgtgggccaagggactaatcggtcaccgtctcttcacgcctccaccgacgggcccatccggttccttccccgtcggccgccctcgcctccgtaggacgcctaccctcggagacgccacgacggccggcccgtgggccncggtaccgtcggtaccgaacgggaccttaccttaccccaattacccgtacgtcgttacgggacggtacgggtcggtacggaccgaacgggcccgtagatacggnnnnnnnnnnnnnnnnnnnn

SEQ ID NO: 158760 - DNA, 384 bp, Homo sapiens
  misc_feature: GYAE6OF02F2N0N.18.75.G09.1.454.CMB.1.raw
  modified_base (374)..(384): a, c, t, g, unknown or other
  misc_feature (374)..(384): n is a, c, g, or t
tcagtacgagtatgcacgaccggtgctcgatttagtatagacatcaggggagtctggtgcgttttgggcattgatggacacccctgagccctatttcccagacgctcccccagccccctcagccccagaagtggaatgcgtttgcagtagggctttgggaatgggggctgtgtcactgattatgcttttgatatctggggccaagggacaatggtcaccgtctcttcagcctccaccaagggcccatcggtccttccccgtggccgccctgctccgaggagccacctccgagacgcacagccggccctgggctgcctggtcaaggacctactccatactcgtactgacgcgggctggacaacggcgcagtacgnnnnnnnnnnn

SEQ ID NO: 158761 - DNA, 419 bp, Homo sapiens
  misc_feature: GYAE6OF02F3BMX.18.75.G09.1.454.CMB.1.raw
  modified_base (267)..(267): a, c, t, g, unknown or other
  misc_feature (267)..(267): n is a, c, g, or t
  modified_base (309)..(309): a, c, t, g, unknown or other
  misc_feature (309)..(309): n is a, c, g, or t
  modified_base (394)..(419): a, c, t, g, unknown or other
  misc_feature (394)..(419): n is a, c, g, or t
tcagtacgagtatgcacgaccggtgctcgatttagtatagacatcagggggagtctggtgcgttttgggcattgatggacacccctgagccctatttcccagacgctcccccagcccctcacgccccagaagtggaatgcgtttgcagtagggctttgggaatggggctgtgtcactgattatgtctttgattatcgtggggccaagggacaagtggtcaccgtctcttcacgcctccaccgaacggcccatccggtccttccccgnggccgccctgcctccgaggacgccaccgtccgagacgcacgnggccgcccgtggcctgccgtggacaaggacctactcccatacctcgtactggacggcgggactgggaccaagggcgacagtagcnnnnnnnnnnnnnnnnnnnnnnnnnn

SEQ ID NO: 158762 - DNA, 503 bp, Homo sapiens
  misc_feature: GYAE6OF01D2RQX.22.9.A09.1.454.CMB.1.raw
  modified_base (494)..(494): a, c, t, g, unknown or other
  misc_feature (494)..(494): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttccaaaagggccactggcatcccagccaggttcagtggcagtggtctggaagagacttcactctcaccatcaaacagcctagagcctgacgattctgcagtttattactgtcagcagcgtaccaagtgcctccgacttttggccgtaggggccaagctggagatcagacgaacgtggtggctgcaccatctgtcttcntcttccccg

SEQ ID NO: 158763 - DNA, 526 bp, Homo sapiens
  misc_feature: GYAE6OF01CDJ67.22.9.A09.1.454.CMB.1.raw
tcagacatacgcgtcacgaccggtgctcgatttagcgagacgcgcagggggaggaacgtgctcaggttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagagcctggccaggctcccaggctcctcatgtatgatgcttccaaagggccactggcatcccagccaggttcagtggcagtgggtctggaagagactttcactctcaccatcaacagcctagagcctgacgattctgctagtttattactgtcagtcagcgtacaagtcggacctccgtacgttttcggccgtagggggtaccaaggtcgtggagacgtcgacgacgaacgtggtggctggcaccatctacgtcttctatcttaccccg

SEQ ID NO: 158764 - DNA, 497 bp, Homo sapiens
  misc_feature: GYAE6OF01DBCGG.22.9.A09.1.454.CMB.1.raw
  modified_base (349)..(349): a, c, t, g, unknown or other
  misc_feature (349)..(349): n is a, c, g, or t
  modified_base (489)..(489): a, c, t, g, unknown or other
  misc_feature (489)..(489): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttccaaaagggccactggcatcccagccaggttcagtggcagtggtctggaagngacttcactctcaccatcaacagcctagagcctgacgattctgctagtttattatgtcagcagcgtaccaagtgcctcgactttggctaggggccaagctggagatcgagacgaacgtgtgctgacaccatctgtcttcntcttcccg

SEQ ID NO: 158765 - DNA, 512 bp, Homo sapiens
  misc_feature: GYAE6OF01D8PL3.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagagcctggccaggctcccaggctcctcatgtatgatgcttaccaaaagggccactggcatcccagccaggttcagtggcagtggtctggaagagacttcactctcaccatcaacagcctagacgcctgacgattctgctagtttattactgtcagcagcgtacaagtcggcctccgtactttggaccgtaggggccaagcgtaggacgatcagacgaacgtgtaggctgcaccatctgtccttcacttcttccccg

SEQ ID NO: 158766 - DNA, 542 bp, Homo sapiens
  misc_feature: GYAE6OF01CUM5G.22.9.A09.1.454.CMB.1.raw
  modified_base (255)..(255): a, c, t, g, unknown or other
  misc_feature (255)..(255): n is a, c, g, or t
  modified_base (515)..(515): a, c, t, g, unknown or other
  misc_feature (515)..(515): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaanagagcctggccagctccaggctcctcatgtatgatgcttaccaaaagggccactggcatcccagccaggttcagtggcaggtgggtctgggaagagacttcactctcaccatacaacagcctagacgcctagaccgtattctgctaagtttattactgtcaagcagtcgtaaccagtcgcctccgtacttttcggaccgtacggggccaagcgtaggagactcgaagaacgaaacgtggtggctgaccgaccacgtcttnttaccgtttctacttcccgttaccccg

SEQ ID NO: 158767 - DNA, 504 bp, Homo sapiens
  misc_feature: GYAE6OF01BSPWY.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctccaggctcctcatgtatgatgcttccaaaaggccactggcatcccagccaggttcagtggcagtggtctggaagagacttcactctcaccatcaacagcctagacgcctgacgattctgctagtttattactgtacagcagcgtacagtcgcctccgtactttcggccgtaggggccaagcgtaggacgatcgagacgaacgtgtggctgcaccatctgtcttcatctcccg

SEQ ID NO: 158768 - DNA, 528 bp, Homo sapiens
  misc_feature: GYAE6OF01BW81U.22.9.A09.1.454.CMB.1.raw
  modified_base (519)..(519): a, c, t, g, unknown or other
  misc_feature (519)..(519): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttaccgaaaagggccacgtggcatcccagccaggttcagtggcaggtggtctggaagagacttcactctcaccatcaaacagcctagagcctgacgattctgtctagtttattactgtcagcacgcgtaccgagtcggccgtccgtacttttcggaccgtacgggggccaaggcgtaggagagtacgagacgaacgtgtggcgtcgcacactctcgtacttctntcgttcccg

SEQ ID NO: 158769 - DNA, 504 bp, Homo sapiens
  misc_feature: GYAE6OF01C3OAM.22.9.A09.1.454.CMB.1.raw
  modified_base (496)..(496): a, c, t, g, unknown or other
  misc_feature (496)..(496): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttccaaaagggccactggcatcccagccaggttcagtggcagtgggtctggaagagacttcactctcaccatcaacagcctagagcctgacgattctgctagtttattactgtcagcagcgtacagtcggcctccgtactttcggccgtaggggccaaggctggagatcgagacgaacgtgtggctgcacatctgtcttcntcctcccg

SEQ ID NO: 158770 - DNA, 527 bp, Homo sapiens
  misc_feature: GYAE6OF01ETLHJ.22.9.A09.1.454.CMB.1.raw
  modified_base (515)..(515): a, c, t, g, unknown or other
  misc_feature (515)..(515): n is a, c, g, or t
tcagacatacgcgtcacgaccggtgctcgatttagcgagacgcgcagggggaggaactgctcagttaggacccagagggaaccatggaagccccagctccagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttaccaaaagggccacgtggcactcccagccaggttcagtggcaggtggtctaggaagagacttcactctcaccatacaacagacctagacgcctagacgtattctgactagtttatactgtcagcagcgtacaagtcgcctcgtacgtttcggccgtaggggccaagtcgtggagatacgagacgacgtggtagctgaccacacgttctcgttctctnttcccgtacccg

SEQ ID NO: 158771 - DNA, 515 bp, Homo sapiens
  misc_feature: GYAE6OF01B1F5S.22.9.A09.1.454.CMB.1.raw
  modified_base (352)..(352): a, c, t, g, unknown or other
  misc_feature (352)..(352): n is a, c, g, or t
  modified_base (373)..(373): a, c, t, g, unknown or other
  misc_feature (373)..(373): n is a, c, g, or t
  modified_base (506)..(506): a, c, t, g, unknown or other
  misc_feature (506)..(506): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttccaaaagggccacgtggcatcccagccaggttcagtggcaggtggtctgggaagngactcactctcaccatcaacngacctagacgcctgacgtattctgactagtttattactgtctagcacgcgtaacaagtcgtcctccgtactttcggccgtaggggaccaggcgtaggagagtcagacgacgtgtgctgcacatctgtcttctntccgtcccg

SEQ ID NO: 158772 - DNA, 503 bp, Homo sapiens
  misc_feature: GYAE6OF01BLKFF.22.9.A09.1.454.CMB.1.raw
  modified_base (496)..(496): a, c, t, g, unknown or other
  misc_feature (496)..(496): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttccaaaagggccactggcatcccagccaggttcagtggcagtggtctggaagagacttcactctcacatcaacagcctagagcctgacgattctgctagtttattactgtcagcagcgtacagtcgctccgtacgtttcggccgtaggggccaagcgtaggagagtcagacgacgtgtggccctgcaccatctgtcttcntctcccg

SEQ ID NO: 158773 - DNA, 516 bp, Homo sapiens
  misc_feature: GYAE6OF01C10D5.22.9.A09.1.454.CMB.1.raw
  modified_base (373)..(373): a, c, t, g, unknown or other
  misc_feature (373)..(373): n is a, c, g, or t
  modified_base (498)..(498): a, c, t, g, unknown or other
  misc_feature (498)..(498): n is a, c, g, or t
  modified_base (504)..(504): a, c, t, g, unknown or other
  misc_feature (504)..(504): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttaccaaagggccactggcatcccagccaggttcagtggcagtggtctgggaagagacttcactctcaccatacaacngacctagacgcctgacgtattctgctagtttattactgtcagcagcgtacagtcggcctccgtacgtttcggccgtaggggccaagcgtgagatcgagacgacgtggtggcgtcgcacactcgtntcttcncttccgtccccg

SEQ ID NO: 158774 - DNA, 550 bp, Homo sapiens
  misc_feature: GYAE6OF01B0N3E.22.9.A09.1.454.CMB.1.raw
  modified_base (344)..(344): a, c, t, g, unknown or other
  misc_feature (344)..(344): n is a, c, g, or t
  modified_base (350)..(350): a, c, t, g, unknown or other
  misc_feature (350)..(350): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttaccaaaagggccaactggcatcccagccaggttcagtgcagtggtcnggaagngactcgactctcaccatcaacagcctagacgcctagacgattctgctagtttattactgtcagcagcgtacctagtcgtcctccgtactttcggaccgtaggggcctaaggcgtagggacgtacgtacgacgacgtaacgtggtaggcgtcgacctaaccgtagtccgttacgttaccttcctacgttccgttacccccg

SEQ ID NO: 158775 - DNA, 589 bp, Homo sapiens
  misc_feature: GYAE6OF01C5TSD.22.9.A09.1.454.CMB.1.raw
  modified_base (353)..(353): a, c, t, g, unknown or other
  misc_feature (353)..(353): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggcctcctcatgtatgatgcttaccaaaagggccactggcatcccagccaggttcagtggcagtggtctgggaaagngactttcactctcaccaatccaaacacgcctaagacgcctgacgtattctgctagtttattactgtacagcagtacgtaacgaagtcggccgttaccgtacgttttcggaccgtacgggggaccaacggtcgtagggagtaacgtcgaacggtaaccggaacgttacgggtagggtaccgtcggacctaacccgtattaccgttcgttacctttaccgtacttccgttaccccccg

SEQ ID NO: 158776 - DNA, 657 bp, Homo sapiens
  misc_feature: GYAE6OF01CX0PG.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagcccaccctgtctttgtctccaggagagcgggccaccctctcctgcagggccaatgagagtattagcgactacttagcctggtaccaacagaggcctggccaggctcccaggctcctcatgtatgatgcttaccaaagggccactggcatcccagccaggttcagtggcagtggtctgggaagagacttcactctacaccatacaacacgacctagacgtccgtagaccgtattcgtgtacttaagttttaacttacgttcgtacagtaccgacggtaccgtaaccgtaaggttccgggtacccgttacccggttaccggtttttccgggacccgggtacggggggtacccgtaacgggtaccggtagggaacggtacgttaccggaaacgggtaaccggtaacggttcgggtacgggtaccgtacggtacccgaaccgtacgtttaccgttacggtttacctttaccgtccgtttccccgttacccccg

SEQ ID NO: 158777 - DNA, 516 bp, Homo sapiens
  misc_feature: GYAE6OF01DVZBL.22.9.A09.1.454.CMB.1.raw
  modified_base (255)..(255): a, c, t, g, unknown or other
  misc_feature (255)..(255): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaanagaggcctggccaggctcccaggctcctcatgtatgatgcttaccaaaagggccacgtggcatcccagccaggttcagtggcaggtgggtctagggaagagacttcactctcaccatcaacagcctagacgcctgacgattctgctagtttattactgtcagcagtcgtaccaagtcgctccgtacgtttcggccgtaggggccaggctaggagatcgagacgaacgtggtggctgaccacatctgtcttctctcctcccg

SEQ ID NO: 158778 - DNA, 508 bp, Homo sapiens
  misc_feature: GYAE6OF01C121Q.22.9.A09.1.454.CMB.1.raw
  modified_base (499)..(499): a, c, t, g, unknown or other
  misc_feature (499)..(499): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttccaaaagggccactggcatcccagccaggttcagtggcagtggtctgggaagagactttcactctcaccatcaaacagcctagagcctgacgattctgtctagtttaattactgtcagcagcgtacaagtggcctccgacttttggccgtaggggccaagcgtggagatacagacgaactggtggctgcacatctgtcttcntccttcccg

SEQ ID NO: 158779 - DNA, 509 bp, Homo sapiens
  misc_feature: GYAE6OF01DM55T.22.9.A09.1.454.CMB.1.raw
  modified_base (256)..(256): a, c, t, g, unknown or other
  misc_feature (256)..(256): n is a, c, g, or t
  modified_base (499)..(499): a, c, t, g, unknown or other
  misc_feature (499)..(499): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacngaggcctggccaggctcccaggctcctcatgtatgatgcttccaaaagggccactggcatcccagccaggttcagtggcagtgggtctggaagagacttcactctcaccatcaacagcctagacgcctgacgattctgctagtttattactgtcagcagcgtaccaagtcgccttccgacttttcggccgaggggccaagctaggagatcagacgaacgtgtggctgacaccatctgtcttcntccttccccg

SEQ ID NO: 158780 - DNA, 595 bp, Homo sapiens
  misc_feature: GYAE6OF01CKWJX.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggcctcctcatgtatgatgcttaccgaaagggtccacgtggacactcccagccaggttcagtggcagtggtctagggaagacgacttcactctcaccatccaaacacgccctaagacgcctaggacgtattctgtacgtaagtttaacttatcgtacgagcgagtaccgtaaccgtaaggtcgtccgttccggtaacgtttcgggacccggtaggggaccgaaggcggtaggacgtagtacacggtaacgaacgttcggtaggtactcggacctaaccgacttccgttacgttaccgttctaccgttccgttacccccg

SEQ ID NO: 158781 - DNA, 553 bp, Homo sapiens
  misc_feature: GYAE6OF01CVHCV.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtcttgtctccaggagagcgggccaccctctcctgcagggccaatgagagtattagcgactacttagcctggtaccaacagaggcctggccaggctcccaggctcctcatgtatgttgcatccagcagggccactggtaccccagccaggttcagtggcagtggtctggggacagagttcactctcaccatcagcagctgcagtctgaagtattttgactaagtttattactgtacagcagtataatttactgtttactcgtactcgtaccgttcggacctaaggggaccaacgtacgtaggaagtaacgttaaaacggaacgttaggtcggtaccgttacgaccaacctagttaccttgtccttcctacgttccccg

SEQ ID NO: 158782 - DNA, 547 bp, Homo sapiens
  misc_feature: GYAE6OF01BFDXM.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttccaaaagggccactggcatcccagccaggttcagtggcaggtggtctggaagagacttcactctcaccatcaacagcctagacgcctagacgtattctgctagtttacttactgtcagcagctacgaagtcgtcctcgtacttttcgggaccgtacggggccaagcgtaggacgtagtacgagaacgaacgtcggtagggctggaccgacccgtaacgttctacggttacttctacttcccgttaccccg

SEQ ID NO: 158783 - DNA, 544 bp, Homo sapiens
  misc_feature: GYAE6OF01BK7EK.22.9.A09.1.454.CMB.1.raw
tcagacatacgcgtcacgaccggtgctcgatttagcgagacgcgcagggggaggaacgtgctcagttaggacccagagggaaccatggaagccccagctcagcttctcttcctcctgctactctggctcccagagaccaccggagaagttcgtgttgacacagtttccagccaccctgtctttgtctccaggagagcgggccaccctctcctgcgagggccaatgagagtattagcgactacttagcctggtaccaacagagcctggccaggctcccaggctcctcatgtatgatgcttccaaagggccactggcatcccagccaggttcagtggcaggtggtctggaagagacttcgactctcaccatcaacagcctagagcctgacgattctgctagtttattactgtcagcacgcgtaccgaagtcggtccttccgtacgttttcggcctacgggggacctaaggtcgtaggacgtagtacgagaccgaacgtggtggtctcgcgacctagtcctcgttaccttctcgttccgttaccccg

SEQ ID NO: 158784 - DNA, 541 bp, Homo sapiens
  misc_feature: GYAE6OF01B7Y80.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggcctcccaggctcctcatgtatgatgcttaccgaaaagggccactggcactcccagccaggttcagtggcaggtggtctgggaagagacttcactctcaccatcaacacgacctagacgcctgacgtattctgctagtttattactgtacagcagcgtaccaagtcggtcctccgttacgtttcggaccggtacggggccaacggtcgtggagatcgacgaacgacgtggtggcgtgaccaccacgtctcgttacttctctcccgttccccg

SEQ ID NO: 158785 - DNA, 510 bp, Homo sapiens
  misc_feature: GYAE6OF01ALRUU.22.9.A09.1.454.CMB.1.raw
  modified_base (498)..(498): a, c, t, g, unknown or other
  misc_feature (498)..(498): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttccaaaagggccactggcatcccagccaggttcagtggcagtggtctggaagagacttcactctcaccatcaacagcctagagcctgacgattctgctagtttattactgtcagcagcgtaccagtcgcctccgtactttggccgtaggggccaagcgtggagatcgagacgaacgtggtggctgcaccactctcgtcttcncttccttccccg

SEQ ID NO: 158786 - DNA, 575 bp, Homo sapiens
  misc_feature: GYAE6OF01CQS1R.22.9.A09.1.454.CMB.1.raw
  modified_base (254)..(254): a, c, t, g, unknown or other
  misc_feature (254)..(254): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggaccaanagagcctggccaggctcccaggctcctcatgtatgatgcttaccaaaagggccactggcatcccagccaggttcagtggcagtggtctaggaagagtacttcactctacaccatcaacagacctagacgcctgactattctgtctagtttacttactgtacgagcagtacgtacgaagtcgtcctccgtacgttttcgggaccgtacgggggacctaaggcgtagggacgtacgtacgacgtaacggaacgtggtacggtacgttcgacccgtaccgtacgttccgttacgttacctttacgtacgttcccgttacccccg

SEQ ID NO: 158787 - DNA, 518 bp, Homo sapiens
  misc_feature: GYAE6OF01E5JDC.22.9.A09.1.454.CMB.1.raw
  modified_base (341)..(341): a, c, t, g, unknown or other
  misc_feature (341)..(341): n is a, c, g, or t
  modified_base (369)..(369): a, c, t, g, unknown or other
  misc_feature (369)..(369): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctccaggctcctcatgtatgatgcttccaaaagggccactggcatcccagccaggttcagtgcagtggtcnggaagagacttcactctcaccatcaacngcctagagcctagacgtattctgtctagtttattactgtcagcagcgtacagtcgcctccgtactttggccgtaggggaccagcgtaggagagtcgagacgtaacgtggtaggcgtgcaccacttctgttccttctcttccgttccccg

SEQ ID NO: 158788 - DNA, 509 bp, Homo sapiens
  misc_feature: GYAE6OF01CMTCS.22.9.A09.1.454.CMB.1.raw
  modified_base (255)..(255): a, c, t, g, unknown or other
  misc_feature (255)..(255): n is a, c, g, or t
  modified_base (345)..(345): a, c, t, g, unknown or other
  misc_feature (345)..(345): n is a, c, g, or t
  modified_base (351)..(351): a, c, t, g, unknown or other
  misc_feature (351)..(351): n is a, c, g, or t
  modified_base (466)..(466): a, c, t, g, unknown or other
  misc_feature (466)..(466): n is a, c, g, or t
  modified_base (491)..(491): a, c, t, g, unknown or other
  misc_feature (491)..(491): n is a, c, g, or t
  modified_base (501)..(501): a, c, t, g, unknown or other
  misc_feature (501)..(501): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaanagaggcctggccaggctcccaggctcctcatgtatgatgcttaccaaaagggccaactggcatcccagccaggttcagtggcagtggtcngggaanagactcactctcaccatcaacagcctagacgcctgacgattctgtctagtttattactgtacagcagcgtacaagtcgcctccgtactttcggccgtaggggccaagcgtggagntcgagacgaacgtggtggctgcacntctgtcttcntcttcccg

SEQ ID NO: 158789 - DNA, 518 bp, Homo sapiens
  misc_feature: GYAE6OF01DGJN7.22.9.A09.1.454.CMB.1.raw
  modified_base (349)..(349): a, c, t, g, unknown or other
  misc_feature (349)..(349): n is a, c, g, or t
  modified_base (355)..(355): a, c, t, g, unknown or other
  misc_feature (355)..(355): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttccaaaagggccactggcatcccagccaggttcagtggcagtggtctggaagngacttnactctcaccatcaacagcctagacgcctgacgattctgtctagtttattactgtcagcagcgtaccaagtggcctccgtacgttttcggccgtacgggggccgaacggcgtggagagtcgagacgaacgtggtggctgcaccatctagtcttctatcttcccg

SEQ ID NO: 158790 - DNA, 583 bp, Homo sapiens
  misc_feature: GYAE6OF01EBDQR.22.9.A09.1.454.CMB.1.raw
  modified_base (383)..(383): a, c, t, g, unknown or other
  misc_feature (383)..(383): n is a, c, g, or t
tcagacatacgcgtcacgaccggtgctcgatttagcgagacgcgcagggggaagggaacgtgctcagttaggacccagagggaaccatggaagccccagctcagcttctcttcctccctgctactctggctcccagagaccaccggagaagttgtgttgacacagtttccagccaccctgtctttgtctccaggagagcgggccacccgtctcctgcagggccaatgagagtattagcgacgtacttagcctaggtaaccaacagagcctggccaaggctcccaggctcctcactgtatgatgacttaccgaaaagggccactggcatcccagccagtcagtgcagtggtctggaagacgcttcactctacgaccatcaaacngcctagacgcctgaacgattcgtagctaagtttactacgtgtacagtcagtaccgtaacaggtcgacctcgtaacgtttggaccgtaggggacctaaagcgtaggagtacgttacgacggaacggtaacgtcggttagggaccgtcggacctaaccgacgttccgtaacgttccgttacctacgttccccgttacccccg

SEQ ID NO: 158791 - DNA, 520 bp, Homo sapiens
  misc_feature: GYAE6OF01BMVJ1.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttccaaaagggccactggcatcccagccaggttcagtggcaggtggtctgggaagagacttcactctcaccatcaaacagcctagacgcctgacgattctgtctagtttattactgtcagcagcgtacaagtcgctccgtacgtttcggccgtacggggccaagtcgtaggagacgtcgacgacgaacgtggtggcgtgcaccactctgtctctatcctaccccg

SEQ ID NO: 158792 - DNA, 545 bp, Homo sapiens
  misc_feature: GYAE6OF01C84SV.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctccaggctcctcatgtatgatgcttacgaaaagggccacgtggcatcccagccaggttcagtgcagtggtctggaagagacttcactctacaccatacaactagcctagacgcctgacgattctgctagttattactgtcagtcagcgtacaagtcggccctccgtacgtttcggaccgtacgggggaccaagcgtaggaagtacgtcgagaacgtaacgtcggtaggcgttgccgaaccacgttctcgtacctttctacttcccgttaccccg

SEQ ID NO: 158793 - DNA, 873 bp, Homo sapiens
  misc_feature: GYAE6OF01CDZ6A.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcggacgacagtgagagttatagacgtacttacgtacgcgtacgtaaccagaggacgtcgtcgacgacgtccctaccgacggtcctcctactagttacgtagtagtagtcgttaccgtaaaacgggaaccggaccgtacggtacgacctacccgaccgaccgtaccggttacggttacgtacgggtacgacggtacgggttcggtacgggtaaggaacggtacgttaccttaccgtaccgttacctaaccctaaacctaacgtaaacccgaaaccgtacccgtaaccggtaacggtaccccgttaccggtaaacggtaacgtttaccttacggtacgttaaccgtttttaaacgttttaaccgtaccggttacgtaaccggtacgtaaccggtaacccggttaacccgttaaaacggtaccggggtttcccccgttacccggttaaccgggttttttcgggtacccccggggaaccgggggggttaacccggtaaccggtaccgggttacgggtaacgggaacgtttaacccgacgggtaaaccgggttaaacccggtttacggttcgggggttacccgtaccgggttaccaacccccggttaaattcccggtttcgttaccgtttaacccgtacctttacccggtttccccccgtaaccccg

SEQ ID NO: 158794 - DNA, 585 bp, Homo sapiens
  misc_feature: GYAE6OF01DCGRH.22.9.A09.1.454.CMB.1.raw
  modified_base (378)..(378): a, c, t, g, unknown or other
  misc_feature (378)..(378): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgctccaggagagcggccaccctctcctgcagggccaatgagagtattagcgactacttagcctggtaccaacagaggcctggccaggctcccaggctcctcatgtatgatgcttaccgaaaaggccactggcatcccagccagggttcaggtggcagtgggtctagggaagagacttcaactctcaccatacaaacngacctagagcctagacgtattcgtgtacgtagtttattactgtcagtcagtacgtaaccaaggtcggccttccgtacgttttcggcccgtaacgggggaccgtaaggccgtagggaacgtagtaccaacggacgtaaacgtggtacggcgttcggaccgtaaccctattccgttacttacgtttacctcgttccccgtttacccccg

SEQ ID NO: 158795 - DNA, 757 bp, Homo sapiens
  misc_feature: GYAE6OF01CH9A9.22.9.A09.1.454.CMB.1.raw
tcagacatacgcgtcacgaccggtgctcgatttagcgagacgcgcaggggagaactagggctcagttaggacccagagggaaccatggaagccccagcgtcagctcgtccttcctcctgctactcgtgcctccagagaccaccggagaacgttggtgttcgacactagtttccagccaccctgtctttgtcctaccgaggtacgagtccgggtcccacccgttctccgtcgcacgggccaagtggacgagtattacgcgactacttacgtccgtcgggtaccaacacgaggacctaggtaccgaggcctacccgtaaggttaccttccgtactactgtactagaactacggtaccttacccgaaacggtcctacgtggacctacgtcccgacgtccgtacggttacacgtcggtcaacggttgggtacgtaggaacgacgtacgttcgtactcgtacaccgagttacgaacgtcggacctagacgtccgtacgaccgtacttaccgtagtacgttacgtttaacgttaccgtcgtaccgtaacgtacgtaacggtaccgttaaccgtaacggttaccggtcccgttaccggttacgttttaccggacccggtaacgggggtaaccctaacgggttacgttacggaaccgtacttaccggtaaacggtaccggaaccggttacggtacggtacggtcggtaccgtaaccgtaacgttaccgttacggtttaccttaccgtacgttcccgttaccccgg

SEQ ID NO: 158796 - DNA, 506 bp, Homo sapiens
  misc_feature: GYAE6OF01D7EYU.22.9.A09.1.454.CMB.1.raw
  modified_base (349)..(349): a, c, t, g, unknown or other
  misc_feature (349)..(349): n is a, c, g, or t
  modified_base (498)..(498): a, c, t, g, unknown or other
  misc_feature (498)..(498): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttccaaaagggccactggcatcccagccaggttcagtggcagtggtctggaagngacttcactctcaccatcaacagcctagagcctgacgattctgcagtttattactgtcagcagcgtacaagtcgcctcgacttttcggccgtagggggccaagcgtaggagagtcaggacgaacgtgtggctggcaccatctgtcttcntctccccg

SEQ ID NO: 158797 - DNA, 531 bp, Homo sapiens
  misc_feature: GYAE6OF01DNMXY.22.9.A09.1.454.CMB.1.raw
  modified_base (351)..(351): a, c, t, g, unknown or other
  misc_feature (351)..(351): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctccaggctcctcatgtatgatgcttaccgaaaagggccaactggcactcccagccaggttcagtgcagtggtctggaagngacttcactctcaccatcaacagcctagacgcctagacgattctgtactagtttattactgtcagcagcgtaaccagtcgtcctccgtactttcggccgtaggggccaaggcgtaggagacgtcgacgacgaacgtggtaggctgaccacacgtcttcgtacttcattcccgttaccccg

SEQ ID NO: 158798 - DNA, 641 bp, Homo sapiens
  misc_feature: GYAE6OF01AOJO1.22.9.A09.1.454.CMB.1.raw
tcagacatacgcgtcacgaccggtgctcgatttagcgagacgcgcgagggggaggaactgctcacgttaggacccagagggaaccatggaagccccagctcagcttctcttcctcctgctactctggctcccaagaggaccaccggagaaggtttcgtgtttgactacaggtttccagccacctgtctttgtctccaggagtagcgggcctaccggtctccgtggccaagggccaaggtcgagagtattagcgactactagcctggtaccaagagacggcctggcctaggctccgaggcctcctcatcggtactgactcgacgttaaccggaaacgggtccaacgtggaccactccccgaagcctaggttcaggtggctaggttcggtactagggaaacgtacgacctttcaccttctacgaccacgtacgaacacgtcctaagacgtccgtacgacgtactactacgtactaagtttactactgtactagcgacgtacgtaaccgaagtcgcctacgtacgtttcggaccggtacgggacctaacggtcgtaggtacgtacgtacgtacggtacgtacggtcggtgggcggtcggacctacgtacgtcgtacggttaccgtccgtacgttcccgtacccg

SEQ ID NO: 158799 - DNA, 502 bp, Homo sapiens
  misc_feature: GYAE6OF01CE83C.22.9.A09.1.454.CMB.1.raw
  modified_base (494)..(494): a, c, t, g, unknown or other
  misc_feature (494)..(494): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttaccaaaagggccactggcatcccagccaggttcagtgcagtggtctggaagagacttcactctcaccatcaacagacctagagcctgacgattctgctagtttattactgtctagcagctacaagtcgctccgtactttggccgtaggggccaagcgtaggagatcgagagaacgtgtggctgcacatctctcttcntctccccg

SEQ ID NO: 158800 - DNA, 506 bp, Homo sapiens
  misc_feature: GYAE6OF01B0R27.22.9.A09.1.454.CMB.1.raw
  modified_base (497)..(497): a, c, t, g, unknown or other
  misc_feature (497)..(497): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttccaaaagggccactggcatcccagccaggttcagtggcagtggtctggaagagacttcactctcaccatcaacagcctagagcctgacgattctgctagtttatactgtcagcagcgtacagtcggcctcgtactttggcgtacggggccaaggctggagtatcgagacgaacgtgtggctgcaccgatctcgtcttctntccttcccg

SEQ ID NO: 158801 - DNA, 507 bp, Homo sapiens
  misc_feature: GYAE6OF01CS60U.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttacaaaagggccactggcatcccagccaggttcagtggcagtggtctgggaagagacttcactctacaccatcaacacgacctagacgcctgaccgattctgtctaagtttattactgtcagcagcgtaccagtggctcgactttggccgaggggcaagcgtggacgatacgagacgaacgtgtggctgcacatctgtcctctctctcccg

SEQ ID NO: 158802 - DNA, 512 bp, Homo sapiens
  misc_feature: GYAE6OF01DO4MV.22.9.A09.1.454.CMB.1.raw
  modified_base (378)..(378): a, c, t, g, unknown or other
  misc_feature (378)..(378): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggggaaagagccaccctctcctgcagggccagtcagagtgttaactactacttagcctggtaccaacagaaacctggccaggctccaggctcctcatctatgatgcatcttacagggccactggcatcccagccaggttcagtggcagtgggtctggggacagacttcactctcacatcagcagcctagngcctgaagtattttgctagtttattactgtcagcagcgtagcaactccctcgacgttcggcggagggaccaagggtggagactacgaaacgatgtggcgtgcacatctgtcttcacttccttcccgcctatccg

SEQ ID NO: 158803 - DNA, 578 bp, Homo sapiens
  misc_feature: GYAE6OF01CAT0E.22.9.A09.1.454.CMB.1.raw
  modified_base (363)..(363): a, c, t, g, unknown or other
  misc_feature (363)..(363): n is a, c, g, or t
  modified_base (388)..(388): a, c, t, g, unknown or other
  misc_feature (388)..(388): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaaccaacgagaggcctggccaggctcccgaggcctcctcatgtatgatgcttaccgaaaagggccacgtcggacactcccagccgaggttcagtggcaggtgggtactggaagngtacttcactctacaccatacaacncgacctagactccgtagacgtattctgtactagtttattacgtgtacagcgacgtacgtaactagtcgtaccgtccgtacgtttcggaccggtacggggacctaacgcgtagggacgtacgtacgaacgtaacggacgtggtcgcgtcgaccgaacctcgtcgttacgttacttctacttccgtaccccg

SEQ ID NO: 158804 - DNA, 573 bp, Homo sapiens
  misc_feature: GYAE6OF01C4TYW.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactactagcctggtaccaacagaggcctggccaggctcccaggcctcctcatgtatgatgcttaccgaaaagggccactggcactcccagccaggttcagtggcaggtgggtctagggaagagtacgttcacgtctacaccatcaacagcctagacgcctgacgtattctgtactagtttattactgtcagcagtaccgtacctaagtcggtaccctccgtacgttttcggaccggtacggggtacccaaggccgtagggacgtacgtacgacgaacgtaacgtcgtagggccttggaccctacgtactcttacggtacctttctcgttccttccccgg

SEQ ID NO: 158805 - DNA, 589 bp, Homo sapiens
  misc_feature: GYAE6OF01AKFFN.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtatagcgactacttagcctggtaccaacagaggcctggccaggcctcccaggcctcctcatgtatgatgcttaccaaaacgggccacgtggacactcccacgccgaggttcaggtggcgtaggtggtcgtaggaagagtacttcgactctacacctatacaacacgacctagacgcctagacgtacttcgtcgtacttagtttacttactgtactagtcagtccgtaactaggtcgtcccttccgtaccgtttcgggaccggtacggggaccaaggtcgtagggagtactcgaaggtacgaacgtcggtaggtcgtcgaccctaccgtactcgttacgttcttcctacgttcccgttaccccg

SEQ ID NO: 158806 - DNA, 511 bp, Homo sapiens
  misc_feature: GYAE6OF01CTAMC.22.9.A09.1.454.CMB.1.raw
  modified_base (479)..(479): a, c, t, g, unknown or other
  misc_feature (479)..(479): n is a, c, g, or t
  modified_base (496)..(496): a, c, t, g, unknown or other
  misc_feature (496)..(496): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccagggctcccaggctcctcatgtatgatgcttccaaaagggccactggcatcccagccaggttcagtggcagtggtctggaagagactcactctcaccatcaacagcctagagcctgacgattctactagtttattactgtcagcagcgtacagtcgcctcgtacgtttggccgagggggccaagtcgtaggagagtcgagacgactggtggntgcaccatctcgtcttntactcctcccgtacc

SEQ ID NO: 158807 - DNA, 590 bp, Homo sapiens
  misc_feature: GYAE6OF01BBD02.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggcctcccaggcctcctcatgtatgatgccttaccgaaaaggggccacgtggcactcccagccaggttcagtggcaggtgggtcgtggaagagactcactctcacatacaacacgacctagacgacctacgacgtacttcgtcgtactagtttaacttacgttgtacagcgacgtaccgtaaccgtaacggtcggtcccttaccggttaccgttttcggacccgggtacgggggaccgaacggtcgtagggacgagtacgagaccgtaacgtggtggtacgtcgacaccagttccgttagttccttctcttcccgttccccg

SEQ ID NO: 158808 - DNA, 576 bp, Homo sapiens
  misc_feature: GYAE6OF01B8CJ0.22.9.A09.1.454.CMB.1.raw
  modified_base (255)..(255): a, c, t, g, unknown or other
  misc_feature (255)..(255): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaanagaggcctggccaggctccaggcctcctcatgtatgatgcttaccaaaaggccactggcatcccagcccaggttcagtggcaggtggtctgggaagagacttcactctcacatacaacagcctagacgcctagacgtattctgactagtttaattactcgtcagcagaccgtacgaagtcggtccttccgtacgttttcgggaccggtacggggaccctaaggtcgtagggaagacgttacgaaacggtaacgtaacgtggtacgggtctcggacctacccgtattccgttacgttacttcctaacgttcccgttaccccg

SEQ ID NO: 158809 - DNA, 554 bp, Homo sapiens
  misc_feature: GYAE6OF01BW7FD.22.9.A09.1.454.CMB.1.raw
  modified_base (256)..(256): a, c, t, g, unknown or other
  misc_feature (256)..(256): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaaccaanagaggcctggccaggcctccaggctcctcatgtatgatgctacaaaggccactgcatccagccaggttcagtggcaggtggtctaggaagagtactcgactctcacatacaacacgcctagacgcctagacgtattcgtgactagtttattactgtacagcagacgtacgtaagtcgtaccgtaccgtacgtttcggaccggtacggggaccaacggtcgtacgggaacgagtaccgacggtacgaacgtggtacggctcgacacgtacgtccgtgttcctctacgtccgttaccccg

SEQ ID NO: 158810 - DNA, 570 bp, Homo sapiens
  misc_feature: GYAE6OF01EDJZ4.22.9.A09.1.454.CMB.1.raw
  modified_base (197)..(197): a, c, t, g, unknown or other
  misc_feature (197)..(197): n is a, c, g, or t
  modified_base (299)..(299): a, c, t, g, unknown or other
  misc_feature (299)..(299): n is a, c, g, or t
  modified_base (310)..(310): a, c, t, g, unknown or other
  misc_feature (310)..(310): n is a, c, g, or t
  modified_base (360)..(360): a, c, t, g, unknown or other
  misc_feature (360)..(360): n is a, c, g, or t
  modified_base (558)..(558): a, c, t, g, unknown or other
  misc_feature (558)..(558): n is a, c, g, or t
tcagacatacgcgtcacgaccggtgctcgatttagcgagacgcgcagggggaggaactgctcagttaggacccagagggaaccatggaagccccagcgcagcttctcttcctcctgctactctggctcccagataccactggagaaatagtgatgacgcagtctccagccaccctgtctgtgtctccgaggggaaancgcccaccctctcctgcagggccagtcagagtgttagcaacacttagtctggtaccagcagagacctggccaggcctcccgaggcctcctcatctagtggtntcttctaccgngggccagtcggtactccccgctagggttcaggtcgccgtaggtcgggtcngggacaggtacgttcactcacaccatcagccacgcctgcagtctagtaagtacttttgacttacttttacttactcgtacagtactaatataagtcgttacttcggttactacgtacttcctaccgttcggaccgaagggccaacggtacgtaggaacgtaagttaaacggtacgttggtggaccgtacgacctaccncttcgtcgttcc

SEQ ID NO: 158811 - DNA, 621 bp, Homo sapiens
  misc_feature: GYAE6OF01D4UQM.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggcctccaggctcctcatgtatgatgcttaccgaaaagggccactggcactcccagccaggttcaggtcggcaggtgggtctgggaagagtacttcactctcaccatcaacagcctagacgcctgacgtattctgctagtttattacgtgtcagcagtcgtacgacctaacctcccctacgaccggtttccgggaccggggtaacggggacccgtaaggggttacgggaacgtaacgtaaccgaaaaccggtaacgtacgggttacggggtcctacgggaccctaaacccgacgttaccgttacggttaccctttccgtaacctttccccgttttacccccgcccgttaaccg

SEQ ID NO: 158812 - DNA, 585 bp, Homo sapiens
  misc_feature: GYAE6OF01ALO68.22.9.A09.1.454.CMB.1.raw
  modified_base (193)..(193): a, c, t, g, unknown or other
  misc_feature (193)..(193): n is a, c, g, or t
  modified_base (257)..(257): a, c, t, g, unknown or other
  misc_feature (257)..(257): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagngcggccaccctctcctgcagggccaatgagagtattagcgactacttagccttggtaaccaacngaggcctggccaggctcccaggctcctcatgtatgatgcttccaaaagggccacgtggcactccccagccctaggttcagtcggccaggtcgggttctagggaagagtactttccgactcctcaccctatacaaccagtccctaagacgtcctagtaccgtattcgtagtactacgtttatttaactgtctacgtcgacgtacgtacctagtacggtcctccgttacgtttcggtaccgtaggggtaccaacggtcgtagacgtatcgagacgtacgtcggtgacgtcggactaccgacttcgtacgttactccttcgtccgttcccg

SEQ ID NO: 158813 - DNA, 552 bp, Homo sapiens
  misc_feature: GYAE6OF01C96VI.22.9.A09.1.454.CMB.1.raw
  modified_base (254)..(254): a, c, t, g, unknown or other
  misc_feature (254)..(254): n is a, c, g, or t
  modified_base (332)..(332): a, c, t, g, unknown or other
  misc_feature (332)..(332): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactactagcctggtaccaanagaggcctggccaggctcccaggctcctcatgtatgatgcttacaaaggtccactgcactccagccaggttcaggtgngtggtggtctaggaagagacttcactctacaccatacaactagacctagacgccgtgacgtattcgtgtactagtttacttatcgtctagcacgacgttaccaaggtcgcccgttaccgtacgtttcggaccggtacggggaccagcgtggagatcgagaacgtacgtggtacggcgtcgaccacgtactcgtacgttccttactcgttcccgtaccccg

SEQ ID NO: 158814 - DNA, 566 bp, Homo sapiens
  misc_feature: GYAE6OF01AWFGY.22.9.A09.1.454.CMB.1.raw
  modified_base (389)..(389): a, c, t, g, unknown or other
  misc_feature (389)..(389): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggcctcccaggctcctcatgtatgatgcttaccaaaagggccacgtggcactcccagccaggttcagtggcaggtggtctagggaagagacttcactctcaccatacaacagacctagacnctagacgtattctgactatttacttactgtacacgcacgcgtaaccaagtcgtacctccgtacgtttcggaccgtacggggacctaaggcgtaggacgacgtcgacggacgtaacgtggtacggcgttcgaccgtaaccacgttccttacggttaccttctacttcccgttaccccg

SEQ ID NO: 158815 - DNA, 666 bp, Homo sapiens
  misc_feature: GYAE6OF01B8JS2.22.9.A09.1.454.CMB.1.raw
tcagacatacgcgtcacgaccggtgctcgatttagcgagacgcgcagggggaggaactaggcctacagttacggacccaggagggaaccactggaagccccagctcagcttctcttccgtccgtcgctactctggccttccctaggagaccaccggagaagttgtagttgacacagttccagccacctgtcttgtctccaggagagcgggccaccctctcctgcgacgggccaatgagagtattagcgactacttagctggtaccagagagcctgccaggcctccaggctcctcatgtagtgagtgtccttaccgaaaagggccacgtggacacgtcccgacgccgacggtttaccgaggtacggacgtaggtcgggtacgtagggaagacgtaccgtacactacgtcacctactacaacacgaccgtagaccgtccgtacgaccgtaacttccgtacgtcttaagttttaactacgttacgtacaggtacgaacgtaccgtaacccgaggtaccggtaccttacccggtacgtttaccgggacccggtaacggggacctaacggtcgtagggtaaccgtacgtacgacgtaacgtaacgttcggtacggtcggtcgccgtaccgtacgtaccgttacgtacctttcgtcgttcccgttaccccgg

SEQ ID NO: 158816 - DNA, 547 bp, Homo sapiens
  misc_feature: GYAE6OF01B3JL5.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttaccgaaaagggccacgtggcactcccagccaggttcagtggcaggtggtctgggaagagacttcactctcaccatacaacacgacctagacgcctagacgtattctgtactagtttacttactgtacagcacgtacgtacgagtcgcctaccgtacgtttcggaccgtacggggaccaggcgtacggagacgtacgagaacgacgtggtggctcgacacgactcgtcgttacttctcgttccgttccccg

SEQ ID NO: 158817 - DNA, 565 bp, Homo sapiens
  misc_feature: GYAE6OF01C1UDV.22.9.A09.1.454.CMB.1.raw
  modified_base (255)..(255): a, c, t, g, unknown or other
  misc_feature (255)..(255): n is a, c, g, or t
  modified_base (357)..(357): a, c, t, g, unknown or other
  misc_feature (357)..(357): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaanagagctgcaggctccagctcctcatgtatgatgcttacaaaaggccactggcactccagccaggttcagtggcaggtggtctagggaacgagacttcactcnctacatcaacagcctagacgcctgacgtatctgctagtttattactgtctagcagcgtaaccaagtcgccttccgtaacgttttcgggacccgtagggggacccaaggccgtagggaagtataccgaaggtaccgaaacgttcggtaggtcctcggaccaacccgtagttccctcggttacctttaccgtacttccgtttacccccgg

SEQ ID NO: 158818 - DNA, 577 bp, Homo sapiens
  misc_feature: GYAE6OF01EDRDX.22.9.A09.1.454.CMB.1.raw
  modified_base (256)..(256): a, c, t, g, unknown or other
  misc_feature (256)..(256): n is a, c, g, or t
  modified_base (351)..(351): a, c, t, g, unknown or other
  misc_feature (351)..(351): n is a, c, g, or t
  modified_base (373)..(373): a, c, t, g, unknown or other
  misc_feature (373)..(373): n is a, c, g, or t
tcagacatacgcgtcacgaccggtgctcgatttagcgagacgcgcagggggaggaactgctcagttaggacccagagggaaccatggaagcccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaangagtctggccaggctcccaggctcctcatgtatgatgcttaccaaaagggccacgtggcactcccagcctaggttcagtgcagtggtctaggaangacttcactctcaccatcaacngacctagacgcctagacgtattctagtactaagtttacttacgtgtacagcagtaccgtacaaggttcgcttaccgtactttcgggaccgtaggggacctaaggcgttaggagtaacgtacgaggtaaccggacgtaggtaggtctcggaccaacccgtagttccgttagttaccctttcgtaaccgttccgtttaccccccgg

SEQ ID NO: 158819 - DNA, 676 bp, Homo sapiens
  misc_feature: GYAE6OF01C4TSJ.22.9.A09.1.454.CMB.1.raw
  modified_base (253)..(253): a, c, t, g, unknown or other
  misc_feature (253)..(253): n is a, c, g, or t
  modified_base (402)..(402): a, c, t, g, unknown or other
  misc_feature (402)..(402): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtatagcgactacttagcctggaccaanagagctggcagctccagctcctcatgtatgatgcttaccaaaagggccactggcatcccagccaggttcagtggcagtgggtcagggaagagacttcactctacaaccatacaaacagaccctaagacgcccttaggacgtaactttcngtacctaaggttttaattaactggttacaaggactaacggacccgtaaacccgtaaggtaccgggaccccttacccggttaaccggttttcgggaccccgggaacgggggggtaaccctaaacggccgggttacgggaagtaacgttaccgaaaggggtaaacgggtaaaaccggtttcgggtaaggggccgttagggacccctaaaccccgtaagttccccggttttaagtacccggttttacccttaacttcccccggtttaacccccccgg

SEQ ID NO: 158820 - DNA, 576 bp, Homo sapiens
  misc_feature: GYAE6OF01D70MO.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgctccaggagagcgggccaccctctcctgcagggccaatgagagtattagcgactacttagcctggtaccaacagagcctggccaggcctcccaggctcctcatgtatgatgccttaccaaaaggggccacgtggccactccccagcccagggttcaggtggcaggtgggtcgtgggaaagagtacttcactcctcaacccatacaacagcctaagacgcctgacgattccgtgtactaagttttacttactgtacagtacacgtaccgtacaaggtcgtccgtccgtacgtttcggccgtacggggacctaggccgtggagtactacgacgacgtaacgtcggtggacgtcgaccacctacgtcgttacgttaccttctcctcccgttaccccg

SEQ ID NO: 158821 - DNA, 557 bp, Homo sapiens
  misc_feature: GYAE6OF01A8QUC.22.9.A09.1.454.CMB.1.raw
  modified_base (357)..(357): a, c, t, g, unknown or other
  misc_feature (357)..(357): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggcctcccaggcctcctcatgtatgatgcttaccgaaaagggccacgtggacactcccagccaggttcagtggcaggtggtctggaagngacttcactctcaccatcaacagcctagacgcctgacgtattcgtgtactagtttattactgtacagcacgtccgtacgtaacgtcgtccctaccgtaccgtttcggccgtacgggggacctaacggcgtaggagtactcgagaacgtacgtggtaggcgtcgaccactacgtcttgttcttcctcgttcccgttccccg

SEQ ID NO: 158822 - DNA, 758 bp, Homo sapiens
  misc_feature: GYAE6OF01DW4HM.22.9.A09.1.454.CMB.1.raw
  modified_base (256)..(256): a, c, t, g, unknown or other
  misc_feature (256)..(256): n is a, c, g, or t
tcagacatacgcgtcacgaccggtgctcgatttagcgagacgcgcagggggaggaactgctcagttaggacccagagggaaccatggaagcccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaanagaggcctggccaggcctccaggcctcctcatgtatgatgtcttaccgaaaagggcccaacgtcggccactcccgagcccgtaggttccaggtcggacgagggttcgggtacgtaggggaacgaacggtaccttaccaccgttcctacctaacccacgttaacccaaaccgtaccgtacccgttaagggaccgtacccgtacggtaaccgtaacgtttccgtacgttacgttaacgttttaacgtttacgttacgttacgtacgaccgtaacgtaccgttaaacccggtaaggttccgggaccgtttacccggttaaccgtttttccggggacccggtaaccgggggtaccctaacgggtaccggttacgggtaacggtaaccgttacgaaaccggtaaccggtaaacggtttcgggtacggtaccggtccggtaacccgtaacccgttacgtttaccgttcgtttacccgtttccgttaccgtttccccgtttacccccgg

SEQ ID NO: 158823 - DNA, 538 bp, Homo sapiens
  misc_feature: GYAE6OF01B1TFR.22.9.A09.1.454.CMB.1.raw
  modified_base (255)..(255): a, c, t, g, unknown or other
  misc_feature (255)..(255): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaanagaggcctggccaggctcccaggcctcctcatgtatgatgcttaccaaaagggccactggcatcccagccaggttcagtggcaggtggtctgggaagagacttcactctcaccatcaacagcctagacgcctagacgtattctgtctagtttacttacttgtcagcacgtacgtaccaagtcggcctccgtactttcggccgtagggggaccacggcgtaggagagtcgacgacgaacgtggtggcgtcgcaccacgttcttcgttacttctctccttccccg

SEQ ID NO: 158824 - DNA, 737 bp, Homo sapiens
  misc_feature: GYAE6OF01ERT0B.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacactagtttccagcccaccctgtctttgtctccaggagagccgggccaccctctcctgcgagggccaatgagagtattagcgactacgttagcctaggtaaccaacaggacggcctggccgaggcctcccgaggcctcctcatgtatgatcgacttaccgaaaagggccacgtggaccactacccagccgtaggttccgaggtcggacgtaggttcgggtacgtagggaaagtacgtaccttacgtacctactcctaacccgtataccaaaccgacgtacccgtaagacggtaccccgtaggaccgttatttccgtacgtacgtttaagttttacttacgttcgtaccgtacggtaccgtaacgtacccggtaaccgtaacggtccggtacccgtttcccggttacggttttaccgggacccgggtaaccgggggtaccctaaacgggtccggttagggtaacgtacgtaaccgaacggtaaccggttaaacggtcgggtacgggtaccgttaccgacccgtaaccgttacgttccgttacggtttacccttaccgttaccgtttcccccggttacccccg

SEQ ID NO: 158825 - DNA, 570 bp, Homo sapiens
  misc_feature: GYAE6OF01ETGIG.22.9.A09.1.454.CMB.1.raw
  modified_base (378)..(378): a, c, t, g, unknown or other
  misc_feature (378)..(378): n is a, c, g, or t
  modified_base (387)..(387): a, c, t, g, unknown or other
  misc_feature (387)..(387): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggcctcccaggctcctcatgtatgatgcttaccaaaaggggccacgtggcactcccagccaggttcaggtggcaggtggtctggaagagacttcactctcaccatacaanagcctagancctgacgtattctgctagtttattacttgtcagtcagtacgtacctaagtcggtccttccgtactttcgggaccgtagggggtaccaggtcgtaggacgtagtacgaacggaccgtaacgtggtaggctcggacctaacctagttccgttacggttcctttaccctcgttcccgttacccccg

SEQ ID NO: 158826 - DNA, 508 bp, Homo sapiens
  misc_feature: GYAE6OF01AN4TO.22.9.A09.1.454.CMB.1.raw
  modified_base (255)..(255): a, c, t, g, unknown or other
  misc_feature (255)..(255): n is a, c, g, or t
  modified_base (351)..(351): a, c, t, g, unknown or other
  misc_feature (351)..(351): n is a, c, g, or t
  modified_base (490)..(490): a, c, t, g, unknown or other
  misc_feature (490)..(490): n is a, c, g, or t
  modified_base (498)..(498): a, c, t, g, unknown or other
  misc_feature (498)..(498): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaanagaggcctggccaggctcccaggctcctcatgtatgatgcttaccaaaagggccactggcatcccagccaggttccagtggcagtggtctgggaangacttcactctcaccatcaacagcctagagcctgacgtattctgctagtttattactgtcagcagcgtacagtgcctccgactttggccgtaggggccaagctaggagatcgagacgaacgtggtggctgcacactctntacttctnttccttcccg

SEQ ID NO: 158827 - DNA, 753 bp, Homo sapiens
  misc_feature: GYAE6OF01B0SVR.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcggccaccctctcctgcagggccaatgagagtattagcgactacttacgcctaggtaaccaacgaggacggcctgggaccaggcctaccgaggcctcctcatgtatgatgtcttaccgaaaacgggccaacgtcggccacgtccccagcccgtaaggttccaggtcggacgtaggtcgggtacctaggggaaagtacggtacctttaccgaccgttaccttaccaaaccccattaaccccgaaaacgtaccggtacccttaaagggaccgtacccgttacggtaaccggttacgtttaccgttacggtaaccttaaggtttttaactttaacgttccgtacgttaacggacgtaacggcccgttaaaccgtaacgggtaccggttaccccgtttacccggttaccgggtttttaccgggacccgggtaaccggggggtacccgtaaacggtccggtacgggaagtaccgtaccggttaacgaaccggtaccgtgggtcgtacgtcggaccctaaccgtacgttaccgtcgttaccttaccgtacttcccgttacccccg

SEQ ID NO: 158828 - DNA, 852 bp, Homo sapiens
  misc_feature: GYAE6OF01BU0KO.22.9.A09.1.454.CMB.1.raw
  modified_base (140)..(140): a, c, t, g, unknown or other
  misc_feature (140)..(140): n is a, c, g, or t
tcagacatacgcgtcacgaccggtgctcgatttagcgagacgcgcagggggaggaactgctcagttaggacccagaggaaccatggaagccccagctcagcttctcttcctcctgctactctggctcccagagtccacgngaagtagtgttgacacagttccacgaccaccctcgtctttcgtctccgaggacgaagggcggaccacctcctcctgcaggccaagtcgagagtagtagcgatactagcctaggtaccaactaggaacgaccgtaggacctacggcctacccaagggtccctaccgtctaacgtgtataggtaatagaccgttaaccgaaaaccgggtcctaacggtacgggaccctaggtaccccgaacgtccccgtaaacgggtttccgaaacggttcgggacgtacggggtttacggggtacggttacggggaaacgggacgttacgttaccgtaaccgtttcctaacccgaacctaaccgttaaccaaaaccgtacggacccttaagggaaccgtccggttaacggaacggttacttaccgttacggtaccgtttaggttttaaacttacgttttccggttaactacggttaccgtaacgggtaccgttaacccgttaaccggttacggtaaccccgtttaacccggttacgtttttacccggggacccggggttaacgggggtttacccaaacgggtccggtaaccggggtaacgtaaacgggttcccgaaacggttaaacccggaacgggtttacggtcgggtaccgttacggacccgtaaacgtacccgttacggtttccctttaactcccgttaaacgttccccttaaccccggg

SEQ ID NO: 158829 - DNA, 533 bp, Homo sapiens
  misc_feature: GYAE6OF01BHJCM.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagagcctggccaggctcccaggctcctcatgtatgatgcttccaaaagggccactggcatcccagccaggttcagtggcagtggtctggaagagacttcactctacaccatcaacagcctagcgcctgacgattctgctagtttattactgtcagcacgtcgtaccagtcggtcctccgtacgtttcggccgtacggggtaccaaggtcgtggagagtcgacgacgtacgtggtggtctggccaccgagtcttcgtacttccgtcttccgttaccccg

SEQ ID NO: 158830 - DNA, 669 bp, Homo sapiens
  misc_feature: GYAE6OF01C2903.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacactagtttccagccaccctgtcttgtctccaggagagcggccaccctctcctgcagggccaagtgagtagtattagcgtactacttagcctggtaaccaacgtagacggccgtggccgaggcctcccaggtcctccgtcatcgtatgatcgaccttaccgaaagggtccacgtcggcactcccgagtccgtagttcaggtcggcgtaggtggtacgagggaagtacggtactttacgaccgtactaccacgtaactaccaaactacgaccgtaacgacgtccgtacggtaacttacgttactaggtacgttaacgttttattaacgtgttacgtacgtacgacgtaccgtaaccgaggttaccgtccgttacccgttacggtttccgggaccggtaacggggtccgaacggttccgtagggacgtacgtacgaacggtacgtaacggtcggtacgtacgtccgaccgtaacgtcgttacgttcgttaccgtacctccgttcccgttaccccg

SEQ ID NO: 158831 - DNA, 523 bp, Homo sapiens
  misc_feature: GYAE6OF01DBJC4.22.9.A09.1.454.CMB.1.raw
  modified_base (476)..(476): a, c, t, g, unknown or other
  misc_feature (476)..(476): n is a, c, g, or t
  modified_base (501)..(501): a, c, t, g, unknown or other
  misc_feature (501)..(501): n is a, c, g, or t
  modified_base (513)..(513): a, c, t, g, unknown or other
  misc_feature (513)..(513): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttaccgaaaagggccacgtggcatcccagccaggttcagtggcaggtggtctggaagagacttcactctcaccatcaacacgcctagacgcctgacgtattctgtctaagtttacttactgtctagcagcgtaccagtcggtcctccgtacgtttcggccgtacggggaccaggcgtaggngatcgagacgacgtgtggctgcacncgtctctcttcntccgttcccg

SEQ ID NO: 158832 - DNA, 733 bp, Homo sapiens
  misc_feature: GYAE6OF01B2GW5.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacactagtttccagccaccctgtctttgtctccaggagagcgggccaccctctcctgcaggccaatgagagtattagcgactacgttagcctggtaccaacaggacggcctggaccaggctcccaggctcctcatgtatgatgcttaccgaaaaggccactggcacgtcccagccaggttcaggtcgcgtaggtcggtcgtaggaagacgacgtttcaacgttcacgtaccaagtaccaaacagacctaggacgtcctagaacgtactttcgtacgtacgttaacgtttaacgtttacgtagttacctaacggtacctaacggtaccgttaaacccgtaaggttacccgggttacccgtttacccggttaaccgggtttttccgggacccgggtaacccggggggtacccgtaaacgggtacccggttaggggaaaccggtaacgttacccggaacgggtaaaccggtaaaccgggttcgggttacgggacccgttacgggacccgtaacccggttaacgtttcccgtttaccgtttacccgtttaccccggtacctttacccccgtttaccccccgg

SEQ ID NO: 158833 - DNA, 617 bp, Homo sapiens
  misc_feature: GYAE6OF01B1XD8.22.9.A09.1.454.CMB.1.raw
tcagacatacgcgtcacgaccggtgctcgatttagcgagacgcgcgagggggagggaacttgctcagttaggacccagagggaaccatggaagccccagctacagcttctcttcctccttgcctactctggctcccagagacccaccgggagaaggttcgtgttcgacacagtttccagccaccctgtctttgtctccaggagagcgggccaccctctcctgcacgggccaatgacgagtattagcgactacttagcctggtaccaacagaggcctggcctaggctcccgaggctcctcactcgtacgtggagtcgtcgttaccgaaaagggccacgtggacctactcccgaggccgaggtttccacgttcggacctacggtcggtacgtagggaacggacgtacttcactctacaccactcaaaccacgacctagacgcctagacgtattctagtctagtttatacgtcgtacacgcgacgtccgtaccgtagtcgtcctccgtacgtttcgggccgtacgggggccaggcgtcggacgtagtcgtagaccgtacgtcggtggtcgtcgaccgaccgtacgttcgtacgttacgttcctcgttcccgttaccccgg

SEQ ID NO: 158834 - DNA, 644 bp, Homo sapiens
  misc_feature: GYAE6OF01AVIJU.22.9.A09.1.454.CMB.1.raw
  modified_base (197)..(197): a, c, t, g, unknown or other
  misc_feature (197)..(197): n is a, c, g, or t
  modified_base (412)..(412): a, c, t, g, unknown or other
  misc_feature (412)..(412): n is a, c, g, or t
tcagacatacgcgtcacgaccggtgctcgatttagcgagacgcgcagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaangccaccctctcctgcagggccagtcagagtgttagcaacaacttagtctggtaccagcagagacctggccaggcctcccgaggcctcctcatctatggtgcttctaccgagggcctactggtactccccgctaggttcagtcgccaggtcgggtctgggacagtacgttcactctcaccatcacgcacgtctgacgtacgtcgtaagtaacgttntttacgactttaacttttacgttacgtcgtacgacgtaacttaaattaattaacgtcgttaccggtttcgtttacccgtacgttaccttacccgttacccgggttaccggaaaccgggtaacgggaacctaaccgggtacggtaacgggtaaactttaaacggttaaaacccggtggttacgggtaccggttacgtaccggaaccctaacgttacttccgttacgtttaccc

SEQ ID NO: 158835 - DNA, 551 bp, Homo sapiens
  misc_feature: GYAE6OF01AM24I.22.9.A09.1.454.CMB.1.raw
  modified_base (255)..(255): a, c, t, g, unknown or other
  misc_feature (255)..(255): n is a, c, g, or t
  modified_base (331)..(331): a, c, t, g, unknown or other
  misc_feature (331)..(331): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaanagaggcctggccaggctcccgaggcctcctcatgtatgatgcttccaaaaggccagtggcatcccagccaggttcngtgcaggtggtctggaagagacttcactctcaccatcaacagcctagcgcctgacgattctgctagtttacttactgtctagctagacgtacagttcggacctccgtacgtttcggacccgtagggggacctaagggctagggagtactcgacggtacgaacgtcggtaggccgtgaccaccgtactccgttcgtacctttcctacttccgttacccccg

SEQ ID NO: 158836 - DNA, 596 bp, Homo sapiens
  misc_feature: GYAE6OF01CQMSZ.22.9.A09.1.454.CMB.1.raw
  modified_base (254)..(254): a, c, t, g, unknown or other
  misc_feature (254)..(254): n is a, c, g, or t
  modified_base (284)..(284): a, c, t, g, unknown or other
  misc_feature (284)..(284): n is a, c, g, or t
  modified_base (349)..(349): a, c, t, g, unknown or other
  misc_feature (349)..(349): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcggccaccctctcctgcagggccaatgagagtattagcgactacttagcctggtaccaanagaggcctggccaggctcccgaggctcctnatgtatgatgcttacgaaagggccactggcatcccagccaggttcagtggcagtggtctggaagngacttcactctcaccatacaacagacctagacgacctgacgtatcgtgacttagtttattactgtacacgtcagtccgtaacgtagtcggtccgttaccgtacgttttcggacccggtacgggggacctaacggtcgtagggacgtacgtacgtaggaaccggtaaagttcggtaggtaccggttcggacccgtaacctaccgttacgttacgtttaccttaccttacgttccccgtttacccccgg

SEQ ID NO: 158837 - DNA, 718 bp, Homo sapiens
  misc_feature: GYAE6OF01ARMB1.22.9.A09.1.454.CMB.1.raw
  modified_base (260)..(260): a, c, t, g, unknown or other
  misc_feature (260)..(260): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtcggtccaggagagcgggccaccctctcctgcagggaccaatgagagtattagcgtactacttagcctggtaaccaanagaggcctggccaggcctcccgaggcctcctcatgtatgtatgtaccttaccgaaaagggcccacgtcggccactccccgagtcccgtaggttccaggtcggacgtagggttgggtacgtagggaacgacggtacctttccaccgttcctaccaacccgtataaccgaaacgacgtaccgtaaggaccgtccgtacggacgtactttccgtcgtacgttaacgttttaactttaccgttgttaccgagtaccgtacgtaccgttaaccgtaaggtcccgggtacccgttcccggttaaccggttttaccgggacccgggtaaccgggggtacccgtaacggtccggtacgggaacgtacgtaccggtaacggtaccgtaaacggtcgggtacggtcggtcgacccgtaccgtacgttccgttacgttacccttcgttacccgttcccgttacccccgg

SEQ ID NO: 158838 - DNA, 762 bp, Homo sapiens
  misc_feature: GYAE6OF01DI5RC.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgctccaggagagcggccaccctctcctgcagggccaatgagagtattagcgtactacttagcctggtaaccaacagacggctcggccacggctcccaggcctcctcatgtatgatgtccttaacgaaagggccaacgtcggacctactcccgagtcccgtaggttccgaaggtcggactagggtcgggtcgtacggggaacgaggtacggtttccacgttcctaccgaacctagttccgaacgtccgaaccggtcctacggaccggttaacgttacccgttagggtaaacggtttacgtttttacggtaaccgtttaagtttttaccgttaacgttcggttaccgtacggtaaccgttaaggttaactttaaacgtttaccggttacgggtaccccgttttaccggggaccggttttacccgggtaccgggtaaaccgggggtaaccgtaaggggttaacggaaacggttaacggaaaaacggttaaggttacgggtacggtcccgaagggtacccctaacgtacgttaccgtttcgttaccttacgtaccgtttacccccggttccctcggtttaacccg

SEQ ID NO: 158839 - DNA, 552 bp, Homo sapiens
  misc_feature: GYAE6OF01A7PIW.22.9.A09.1.454.CMB.1.raw
  modified_base (255)..(255): a, c, t, g, unknown or other
  misc_feature (255)..(255): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaanagagcctggccaggctcccaggctcctcatgtatgatgcttccaaaagggccactggcatcccagccaggttcagtggcagtggtctggaagagacttcactctacgaccatcaacagcctagacgcctgacgtattctgctagtttacttactgtacagcagcgtacacgtcggcctccgtacgtttcggaccgtacggggaccaaggtcgtacgggagacgtacgagaccggaacgtcggtaggcgttcggaccacgtacgttccgtacgttccttccgtactcccgttaccccg

SEQ ID NO: 158840 - DNA, 777 bp, Homo sapiens
  misc_feature: GYAE6OF01CK5WC.22.9.A09.1.454.CMB.1.raw
  modified_base (210)..(210): a, c, t, g, unknown or other
  misc_feature (210)..(210): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagacgaccaccggagaagttgtgttgacacagttccagccaccctgtctttgctccaggagagccgggccaccctctccngcagggccaatgagagtattagcgtactactagcctggtaaccaagagacggcctggccaggcctccgaggtcctcctcatcgtatgatcgtaccttaaccgaaaacgggccctaacgtcggaccacgtccccaaggcccgtaagggtttcagggtcgggaccgtaggttcgggtacgttaggggaaacgtagtaacctttacgaaccttcctaccgtaaacccacttaaccgaaaccgtaacgaccccgttaaggaccgtacccgttaacggaccgttaacgtttccgtaggtacgtttaaacggtttaactttacgtacgtacccgtaaggtaccgtaacggtaccgttaaacccgaacggttaccgggtacccctttaacccgggttaacccggttttcggggaccccggggtacgggggtaacccgaaggttccggttaacgggaacggtacgtaaccgtaaccgggtaaacgtaaccggttcggtacgggccttaccgggacccctaaccgtacttacccggtttcttacccgtttaccctccgttacccgtttaccccccg

SEQ ID NO: 158841 - DNA, 661 bp, Homo sapiens
  misc_feature: GYAE6OF01BP9RX.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactactagcctggtaccaacgagaggcctggccaggcctccaggctcctcatgtatgatgacttaccaaaagggccaacgtcggcaatccccgagcccgaggtttccaaggtggcaggtggtctagggaaagagtaccttcaccgttcacgtaaccatacaacacgctaagacgccgtagacgtacttcgtgacgtaagttttaattacgttgtacacgtacgacgtaccgtaaccgaagttccggtccgttacccggttacgttttccggacccgggtaacggggggtaccctaaacgggtccgtacgggtaacgtacgtaccggaaacggtaaccggtaaacggttcgggttacggaccgttaccggacctaacccgtaacgttcggttacgttacctttaccgtacgttccccgtttacccccg

SEQ ID NO: 158842 - DNA, 512 bp, Homo sapiens
  misc_feature: GYAE6OF01EVJQJ.22.9.A09.1.454.CMB.1.raw
  modified_base (501)..(501): a, c, t, g, unknown or other
  misc_feature (501)..(501): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttccaaaagggccactggcactcccagccaggttcagtggcaggtggtctggaagagacttcactctcaccatcaacacgcctagagcctgacgattctgctagtttattactgtcagcagcgtacaagtgcctcgtactttcggccgtaggggccaagcgtaggagatacgagacgaacgtgtggctgacaccagtctgtcttcnctccttccccg

SEQ ID NO: 158843 - DNA, 562 bp, Homo sapiens
  misc_feature: GYAE6OF01B8EM1.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtatagcgactacttagcctggtaccaacagaggcctggccaggcctcccaggctcctcatgtatgatgcttaccgaaagggccactggcatcccagccaggttcagtggcaggtgggtctggaagagacttcacgtctacaccataccaaacagaccctagacgtcctacgacgtattctgactagtttattactgtcagcgacgtacgtaactaagtcggaccgtccgtacgtttcggaccgtacggggacctaacggtcgtaggacgtagtacgagaacgtacgtggtggactcgaccacgacgtcttacgttacttctacgttccttaccccg

SEQ ID NO: 158844 - DNA, 714 bp, Homo sapiens
  misc_feature: GYAE6OF01DMW5T.22.9.A09.1.454.CMB.1.raw
  modified_base (202)..(202): a, c, t, g, unknown or other
  misc_feature (202)..(202): n is a, c, g, or t
  modified_base (219)..(219): a, c, t, g, unknown or other
  misc_feature (219)..(219): n is a, c, g, or t
  modified_base (321)..(321): a, c, t, g, unknown or other
  misc_feature (321)..(321): n is a, c, g, or t
  modified_base (375)..(375): a, c, t, g, unknown or other
  misc_feature (375)..(375): n is a, c, g, or t
  modified_base (449)..(449): a, c, t, g, unknown or other
  misc_feature (449)..(449): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagtaagttgtgttgacactagtttccagcccaccctgtctgtgtcctacgaaggggaaancgccctaccctctccgngcgaggccagtcagtagtgttagactaaactaacgttagtcgtacggtaccagaccgaagacgaccgtggacccgaggccctacccgaggtccttaccctanacgttccttagttcggtcgtcctttaccgaccgacggcctacggttcgtacccnccccgtcgtaggttcacggtcgaccgtagggttcggcgtagggactaggtacttccacgttaccaccaaccgtntacgacgcctacgtccctaggctacgttcgtaagttaagtttctttacgactttacgtttaacttacgtgaactagtaactaaatagttaaacgtgtacgttacggttacctacgtaccgttacccgtacccggttacgaaccggtaacggacgtaacggtacgtaagggaaacttaaacggtaaacggtaccgtttgggaaccgtccgttaacgaccttaacctgtttacccgtagtttaccccttagtacccggtttcccccg

SEQ ID NO: 158845 - DNA, 668 bp, Homo sapiens
  misc_feature: GYAE6OF01AU30P.22.9.A09.1.454.CMB.1.raw
  modified_base (255)..(255): a, c, t, g, unknown or other
  misc_feature (255)..(255): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcggccaccctctcctgcagggccaatgagagtattagcgtactacttagcctggtaccaanagaggcctggccaggctccgaggcctcctcactgtatggatgccttaccgaaaagggcccacgtcggcatccccagcctaggttcagtggcaggtggtctaggaagagtactcactcgtacaccgatacaacagaccgtagacgaccgtgacgtacttcgtagtacgtacgtttacttacttcgtacgtaacgtctacggtacccgtaaccgtaacggtccggtacccgttaccggttaccgttttaccgggacccggtaacggggggtaccctaaacgggtcggttacgggaacgtacggtaccgtaaccgggtaaacggtaaccgttcgggtacgggtacttacggaccctaaacccgtatttacccggttacgttaccgtttacctaaccgtttcccgttaaccccccgg

SEQ ID NO: 158846 - DNA, 540 bp, Homo sapiens
  misc_feature: GYAE6OF01CL7KR.22.9.A09.1.454.CMB.1.raw
  modified_base (375)..(375): a, c, t, g, unknown or other
  misc_feature (375)..(375): n is a, c, g, or t
  modified_base (527)..(527): a, c, t, g, unknown or other
  misc_feature (527)..(527): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggcctcctcatgtatgatgcttaccaaaagggccactggcatcccagccaggttcagtggcagtgggtctgggaagagacttcactctcaccatcaacncgacctagacgcctgacgtacttctgtactagtttattactgtactagcagtcgtacgagtcggccttccgtacgtttcggccgtacggggaccgaaggtcgtggacgagtccgagacgaacgtggtggctcgcaccgatccgttctcttcncttccgttccccg

SEQ ID NO: 158847 - DNA, 577 bp, Homo sapiens
  misc_feature: GYAE6OF01CR8QL.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccacagagcctggccaggctcccaggcctcctcatgtatgatgaccttaccaaaagggccacgtcggcactcccagccgtaggttcagtcggcaggtggtctagggagagacttcactctacacatacaacacgactagacgcctgacgtattcgtgtactagtttaattctgtacagcacgccgtaccagtcgccgtccgtacgtttcggaccggtaggggacctaaggccgtaggaacgcgtacgaacggtacgtaaaccgtggtcgggacgtcggcccgtaacgtacttcgttacgttcctttaccgtattccccgttaccccg

SEQ ID NO: 158848 - DNA, 668 bp, Homo sapiens
  misc_feature: GYAE6OF01CQ35X.22.9.A09.1.454.CMB.1.raw
  modified_base (256)..(256): a, c, t, g, unknown or other
  misc_feature (256)..(256): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagccgggccaccctctcctgcagggccaatgagagtattagcgactacttagcctggtaccaanagaggcctggccaggcctcccgaggtcctcctacattctagtggtgtccttcctaccgacgggtccacgtcggtacctccccgctaggttcaggtcgccgtaggtcgggtcgtgggacagtacgtacactctcactatcagcagcctgcagtctaggtaagtacttttcgactttaacttttaattacgtgtaccgaagtactaaaattattaagtcgtaaccgtttggtttactacgtacttccgtaacccgttcgggaaccgtaaacgggacctaacggtaaccgtaggggaaaaccttaaaacggtttaaaaccggaccgtttgggtaaccgggccttaaacggaccctaaacccgtttagttcccgtttagttaccccttttacaccgtttcccccgttaccccccgg

SEQ ID NO: 158849 - DNA, 600 bp, Homo sapiens
  misc_feature: GYAE6OF01EP674.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcgagggccaatgagagtattagcgactacttagcctggtaccaacagaggcctggccaggcctcccaggcctcctcatgtatgatgccttaccgaaaacgggccacgtcgtacacgtcccagcctaggttcagtggcgaggtggtcgtgggacaggtagtcactctacaccatcagcacgtcctagctagtctagaagttatttgacttactttattactgtacagtactaattaattaatcgtacgtttcggttacttacgtacttaccgtacccgttcgggacccgaagggtaccaacgtaacgtagggaacgttaacgttaaaacggtaacgttcggtcggtcctaggaccctaaccgtacttaccgtcgtttccttcgttacccg

SEQ ID NO: 158850 - DNA, 633 bp, Homo sapiens
  misc_feature: GYAE6OF01BVM9P.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccgaggagagccgggccaccctctcctgcagggccaatgagagtatagcgactacttagccctggtaaccaacaggacggcctggccaggctcccaggcctctcatgtatgatgcttaccgaaaagggtccacgtggcacgtcccagccgtaggttcaggtcggactaggtcgggtctagggaagagtacttcaccttctccgaacctacttaccgaaacacgtacccgtaagacgtaccctaggaccgtagttctgtacctagttttaacttacgttgtactacggctacgtaccgttaacgtaacggtcggtcccgttccggttacgtttcgggacccggtacggggtacctaacggtcgtacggacgtacgtacgacggaacgtacgtggtcggcgtcgaccgtactacgttacgtcgttaccttccgtagttcccgttaccccg

SEQ ID NO: 158851 - DNA, 597 bp, Homo sapiens
  misc_feature: GYAE6OF01CQLY5.22.9.A09.1.454.CMB.1.raw
  modified_base (168)..(168): a, c, t, g, unknown or other
  misc_feature (168)..(168): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccanccggaccctgtctttgtctccaggagagcggccaccctctcctgcgagggccaatgagtagtattagcgactacttagcctaggtaccaacgagacggcctggccaggcctccgaggcctcctcatcgtatgatcgacttaccgaaaagggccacgtggacactcccagccaggttcaggtcgcgtaggtcggtcgtaggaagtacgtacttcgacctctacacattacaacgacgtacctaagacgtaccgtacgacgtattcgtagtaccttagtttacttactgttacagtacgtacgaccgtaacgagtccgccttaccgtacgtttcggccggacgggacctagccgtaggacgtagtacgaggtacgtaacgtggtggctcgacctaccacgttctcgttacttccgtacttcccgttacccg

SEQ ID NO: 158852 - DNA, 559 bp, Homo sapiens
  misc_feature: GYAE6OF01C6Q14.22.9.A09.1.454.CMB.1.raw
  modified_base (356)..(356): a, c, t, g, unknown or other
  misc_feature (356)..(356): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggcccaccctctcctgcagggccaatgagagtattagcgactacttagcctggtaccaacagaggcctggccaggctcccaggcctcctcatgtatgatgcttaccgaaaagggccacgtggcatcccagccaggttcagtggcagtgggtcgtggaagngtacttcactctacaccatcaacacgacctagacgtccgtagacgtattctgtctaagtttattactgtactacgcacgtccgtacaaggtccggtccgttccgttacgtttcggaccgggtaggggacccgtaagcgtaggacgacgtcgacgtacgacgtggtggctgaccactactcgtcgtcttctcttccgtaccccg

SEQ ID NO: 158853 - DNA, 595 bp, Homo sapiens
  misc_feature: GYAE6OF01EQ4H4.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactactagcctggtaccaacagaggcctggccaggcctcccaggcctcctcactgtatgatgcttaccgaaaagggccactggcactcccagccaggttcagtcggcaggtggtcgtagggaagagtacttcactcacaccactacaacagacctagacgcctagaacgtacttctgacttagtttacttactgtcagcagcgtaaccaagtcgcccttacgtaccgtttcggacccggtaggggaccctaaggccgtagggaacgtacgtacgtacgaaccgtaacggttggtacggtaccggtcgacccgtaacctacgttccgttacgttacctttcgtaccgttcccgttacccccg

SEQ ID NO: 158854 - DNA, 888 bp, Homo sapiens
  misc_feature: GYAE6OF01C04PV.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagcccaccctgtctttgtctccaggagagcgggcccaccctctcctgcgacgggtaccaagtgagagttaagttagcgtacttacttacgccgttacggtaaccaacgaggacggccgtcggaccgacggccctacccgaggtccctccgtacagttagtatgtattcgtaccgtttaaccggaaaaacgggccctaacgtcggaccaaccgttccccgaagcccgtaacggttcgaagggttcggacggtaggttcgggtaccgtagggaaaggacgttaccgttctaactctacctaccgaattaccgaaacgacgtacccgtaagaccgtcccgtacggtaacctaacgtttccgttacggtaacctttaggtttttaactttaccgttagtacccgtaacgtacgtaaccggttaaccggttaacccgtaaacggttcccgggttaccccttttaccccgggtttaaccgggtttttaccggggacccccgggggttaaaccggggggttaacccgtaaaccgggttaccggggttaggggaaaccggttaaacccgttaaccggggaaaacccggggttaaccggttaaaaccgggttcgggggttacccgggttaaccgttacccggaacccgttaaaccccgtacgtttacccggtttaacccggttttcctttaacccccggttaccgttttacccccgtttaacccccccggg

SEQ ID NO: 158855 - DNA, 662 bp, Homo sapiens
  misc_feature: GYAE6OF01B2KW9.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtatagcgactacttagcctggtaccaacagaggcctggccaggcctcccaggctcctcatcgtatgatcgcttaccgaaaagggccaacgtcgggcactcccacgcctaggttcagtggcaggtggtctaggaagagtactcgactctcaccgtatcaacacgacctaacgagccgtacgaacgtagttccgtacgacttaacggttttaacttacgttacgttacgtagacgtacggtccgttaaacccgtaacggtacgggttcccgttacccggttaacggttttccgggacccgggtacgggggaacccgtaacggtcggttacgggaacggtacgtaacggaacggaacgaaccggtggttacgggacctcgggacctaaccgtaacttccgttcggttacccgttctaaccgttcccgtttaacccccgg

SEQ ID NO: 158856 - DNA, 830 bp, Homo sapiens
  misc_feature: GYAE6OF01CQ9AD.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctccagacgaccaccggagaagttgtgttgacactagtttccacgcccacccttgttctttcgtcctaccgaggagacggccgggccctacccgtctcctcggaccgacgggaccaagtaggaaggtagttaagttagaccgtaacttacgttacgtaccgtacggtaaccaacgaggacggccgtcggccgacggtcctacccgacggtcctacctactacgttagtatcgtactacgtaccgtaaccggaacggtacctacgtacggacctaccgtacccgacgtaccggtacggttacgaacgggtcgggtacggtacggggtacgggtacggtaacgggtaacgtacgttacctaccgtaccttacctaacccgaacctaacctaaccgaaacgtaccggtaaccgttaggacccgttacccgtagggtaccttaacgttcgtacgtttaacgttaactttacgtaccgttcgtacggtaacgtccgtaacggttaacccgtaaccggtaccggtccccgttaccggttaccgggttacgggttccggggaacccgggtaccgggtacgtacgggttacggtacggaaccgtaacggaaccgtaaccgggtacgtcgggttacggtaccggacccggtactacccgttacgttcgttacccgtttaaccgtccctttacgtccccgtttcccgtaaacccg

SEQ ID NO: 158857 - DNA, 642 bp, Homo sapiens
  misc_feature: GYAE6OF01ACJBB.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactactagcctggtaccaacagacggcctggccaggcctcccgaggcctcctcatgtatgatgtccttaccgaaaagggccaacgtcggacactcccagccgtaggttcagtggctaggtcggtcgtagggaagagtactttcgactctaccacctatacaaccacgtacctagacgtcccgtagaccgtattctcgtacgttacgtttacttacgtgtacagtccgagtaccgtaaccgtacgtccggtaccgttccgttacgtttcgggacccggtaacgggggaccctaaggtccggtaggaacgtacgtacgaacggtaaccggtaacgttcggtacggtcgtcggtaccctaacccgtacgttcgttacgttacctttaccgtaccgttcccgttaccccccg

SEQ ID NO: 158858 - DNA, 545 bp, Homo sapiens
  misc_feature: GYAE6OF01E41HO.22.9.A09.1.454.CMB.1.raw
tcagacatacgcgtcacgaccggtgctcgatttagcgagacgcgcagggggaggaactgctcagttaggacccagagggaaccatggaagcccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggcctcccaggctcctcatgtatgatgcttaccaaaagggccactggcatcccagccaggttcagtggcagtggtctggaagagacttcactctcaccataccaacacgcctagacgcctagaccgattctgtctaagtttattactgtcagcagcgtacaagtcggcctccgtacgtttcggccgtacggggaccaacggtcgtaggagtatcgagaacgaacgtggtaggcgtcgaccacctactcctcgttaccttctactcccgttaccccg

SEQ ID NO: 158859 - DNA, 575 bp, Homo sapiens
  misc_feature: GYAE6OF01ET5CD.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttccaaaagggccactggcatcccagccaggtcagtggcagtgggtctggaagagacttcactctcaccatcaacagcctagagcctgaccgtattctgctagtttattacttgtacagcagccgtaacaaggtcgtacctccggtacttttcgggacccggtacgggggccctaaggcgtagggacgtagtaccgacggaacgtaaccgtggtacgggcctcggaccctaacccgacgttccgttcgttacccgtttcctactttccccgttacccccg

SEQ ID NO: 158860 - DNA, 695 bp, Homo sapiens
  misc_feature: GYAE6OF01CGF1X.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctccagagaccaccggagaagttgtgttgacactagtttccagcctaccctgtctttgtctccaggagacgcggccaccctctcctgacagggccaatgagagtatagcgactacttagcctgaaccaacgagacgcctgccaggctccgagcctctcatgtatgatgcttaaccgaaacggccaacgtggcactccgagccgtaaggttcgagtaggcgtaggtcggtactaggaagagtacttcgacctctacacctatacaaactgtacctaagacgtcctagtacgtacttactacggtaacttacgttttaactacgttcgtaacgtacgtaccgtaacgttaacccggtaaccgtaacggttccggtaccccgtttaaccgtttaaccggttttaccggggaaccccgggttaacgggggtaccctaaacgggtccggtaagggtaaccgtaaccgtaaccggtaacggtaacggtaacgtcgggtacggtccgttaccgaccccgtaaacgtacccgtttacgttaccgttaccgtttaaccctccgtttcccccgtaacccg

SEQ ID NO: 158861 - DNA, 609 bp, Homo sapiens
  misc_feature: GYAE6OF01C39F4.22.9.A09.1.454.CMB.1.raw
  modified_base (253)..(253): a, c, t, g, unknown or other
  misc_feature (253)..(253): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctcaggagagcggccaccctctcctgcagggccaagtgagagtattagcgactacttagcctggaaccangaggcctggccaggctacccgaggcctcctcatgtatgatgccttaacgaaagggccaacgtggcatcccagccagttcaggtggcaggttggtcgtaggaagacgtaacttcactcctacacaatacaaacacgacccttagaacgtcctagacgtattctagtactaagtttattacgtgtacgagtacagtccgttaacgacgtcgtcctaccgtacgttttcgggaccggtacggggacccgaacggtccggtaggtaacgtacgtacgaacggtaaccgtaacgtcgggtggacgtcgaacctaccgttactaccgttacgttacttaccgtaccgttccccgttaccccg

SEQ ID NO: 158862 - DNA, 574 bp, Homo sapiens
  misc_feature: GYAE6OF01BF5F1.22.9.A09.1.454.CMB.1.raw
  modified_base (359)..(359): a, c, t, g, unknown or other
  misc_feature (359)..(359): n is a, c, g, or t
  modified_base (370)..(370): a, c, t, g, unknown or other
  misc_feature (370)..(370): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttccaaaagggccacgtggcatcccagccaggttcagtgcagtggtctggagagacttcactcncaccatcaacncgactagacgcctacgacgtattctgtctagtttacttactgtctagtcacgtaccgtaacgaacgtcggcccttaccgtacgttttcggaccgtacgggggtaccaacggtcgtacggagtacgtaccgacgaccgaacgtcggtcgggtccgtcgaccgaccgtacgtccgttacgtcctttcctacgttcccttcccccgg

SEQ ID NO: 158863 - DNA, 567 bp, Homo sapiens
  misc_feature: GYAE6OF01BM50A.22.9.A09.1.454.CMB.1.raw
tcagacatacgcgtcacgaccggtgctcgatttagcgagacgcgcagggggaggaactgctcagttaggacccagagggaaccatggaagcccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccagcagaacctggccaggcctccaggctcctcatctatggtgcatctacggagggccacgtggtactcccagcctaggttccaggtgggcaggttcgggtcgtaggggacaggtacgtttcaacgtctaccacctatcacgcacgccgtgactgtctagaagttatttgacttagtttattactgtcagctataatactactcgcctaccgtacgttagtttcggccgaacgggtaccagtcgaggtagacgtaaccgaaacgtacgttggacggtctacgacctactactccttagttccttctcgttaccccg

SEQ ID NO: 158864 - DNA, 509 bp, Homo sapiens
  misc_feature: GYAE6OF01BHNDX.22.9.A09.1.454.CMB.1.raw
  modified_base (349)..(349): a, c, t, g, unknown or other
  misc_feature (349)..(349): n is a, c, g, or t
  modified_base (371)..(371): a, c, t, g, unknown or other
  misc_feature (371)..(371): n is a, c, g, or t
  modified_base (489)..(489): a, c, t, g, unknown or other
  misc_feature (489)..(489): n is a, c, g, or t
  modified_base (499)..(499): a, c, t, g, unknown or other
  misc_feature (499)..(499): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttccaaaagggccactggcatcccagccaggttcagtggcagtggtctggaagngacttcactctcaccatcaacncgcctagagcctgacgattctgtctagtttattactgtcagcagcgtacaagtcgcctccgtactttcggccgtaggggccagcgtaggagagtccgagacgaacgtgtcgctgcacntctgtcttcngtccttcccg

SEQ ID NO: 158865 - DNA, 680 bp, Homo sapiens
  misc_feature: GYAE6OF01AR6H6.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacgagacggcctggccaggcctcccaggcctcctcatgtatgatgaccttaccgaaaaggccacgtggcactcccagcctaggttcagtggactaggtcgggtacgtagggaagacgtacttacgactcgtaccaacctactaccaaacgacgtaccgtaaggaccgtaccgtaggaaccgtacttccgtcggtacgttacgtttaactttaccgttagtacctaggtaccgtacgtaccgtaaccgacggttacgggtaccccgtttacccggttaccggttttcgggacccgggtacgggggaccctaagggtaccgtacgggacgtacgtacgtaacggaaccggtaacgttcggggtacggacgtcggaccctaccgtacgttaccgttcgttaccttaccgtacgtttccccgttacccccg

SEQ ID NO: 158866 - DNA, 601 bp, Homo sapiens
  misc_feature: GYAE6OF01A1UG0.22.9.A09.1.454.CMB.1.raw
  modified_base (255)..(255): a, c, t, g, unknown or other
  misc_feature (255)..(255): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaanagaggcctggccaggctcccaggctcctcatgtatgatgtccttaccgaaaagggccaactggcatcccagcctaggttcaggttggctaggtgggtctagggaagacgacttcactctccaccgtatacaacacgcctagacgcctagacgtattctagctagtttattactgtcagcagtccgtaactaaggtcggtcccgttccgtacgttttcggacccgggtacgggggaccctaaggtccggtagggagtacgtacggaacgtacggtaaacgtcggtacggtccgtcgacccgacctacgttcgtttcgttacctttccgtacttcccgttaccccccg

SEQ ID NO: 158867 - DNA, 779 bp, Homo sapiens
  misc_feature: GYAE6OF01DXYKL.22.9.A09.1.454.CMB.1.raw
  modified_base (199)..(199): a, c, t, g, unknown or other
  misc_feature (199)..(199): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagacgaccaccggagtaagttgtgttgacactagtttccagccctacctgttctttgtctccgaggagnggccggccctaccctctccgtgcgacggccaatgagtagttatagcgtactacgttacgccgtaggtaaccaacgaggacggtccgtcggaccgacggtcctcccgacggtcctccctctatgtatgatcgtaccgtaccgaaacggcctacgtgactacgtccgacgtcctaggttcaggtggacgtaggttcggtacgtagggtaagtacgttacttcgtactcctaccaacctacgtaccaaacgtacgtaccgtaagaaccgtaccgtacggtaacgtctttaccgtacgtacgtttaacgttttaacttaccgtagtaccgtagaccgtaaccgtaccgtaacccgtaagggttcccggtaccgtaccggtttaccggtttaccgggacccggggttaaccggggaccgttaacgggtaccgtacggggtaacgtaaccgttaccggaaccggtaaccggtaacggttacgggtaccgggttaccgttaacccggacccgttaacccggttacctttacccgggttaccgtttacccgttaaccccgtttaccgttccccccggtttaacccccg

SEQ ID NO: 158868 - DNA, 831 bp, Homo sapiens
  misc_feature: GYAE6OF01BGYID.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagacgccgggccacccttctccgtcgccgagggccaagtgaagtagtattacgcgtactacgttacgccttaggtaccaagaggacggccgtaggcccaagggcctcccgaggtcctcctcatgtatgatcgacttaaccgaaagggcccatcggaccacgtacccgagcccgtaggttccgaggtcggtaccgtagggttacgggtaccgttaaggggaaaggtaccgtaccgttttaccgaacctttaccgtaccgtaacccctaaagttacccgaaaccgtaaccggtcccgttaaacggaaccggtacccgttacgggtaacgttaacgtttccgttaacggttacgtttaacgttttaacgtttaccggttacgttaccggtaacgtaaccgtaaccgggttacccgttaaacggtaaacggggttcccgttacccggtttacccggggttaccttttcccgggggaccgggttaacccgggggacccgttaacgggtaccggttacgggaaacgtacggttaaaccggaaaccggtacgtaacggttcgggtaccggtacgtaccggtacccgttaccgttaacgttcccgttacgttcccgttttaacccttaccgtttccccggttaaccccg

SEQ ID NO: 158869 - DNA, 656 bp, Homo sapiens
  misc_feature: GYAE6OF01AWMKJ.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagttatagcgtactacttagcctggtaaccaacagaggcctggccaggctcccaggctccgtcatgtatgatgccttaccgaaaacgggccacgtggcacgtcccagccaggttcaggtgcgtaggtgggtcgtagggaagacgttacttacgacttaccgtacaaccctagttacaaacacgaccgtagacgtccgtagaccgtacttctagtacttaaggtttaacttacgttacgtctaagccgtacgaaccgtaaccgtaaggttccggtaccgtacccggttaaccggttttcgggacccgggtaggggtacccgtaaacggtccggtaggtaacgtacgttaccgaagtaaccggtaacgtcgggtcggaccgtacgaccgtaaccgtacgtccttcgttaccttcttaccgttcccttaccccgg

SEQ ID NO: 158870 - DNA, 617 bp, Homo sapiens
  misc_feature: GYAE6OF01C40G4.22.9.A09.1.454.CMB.1.raw
  modified_base (322)..(322): a, c, t, g, unknown or other
  misc_feature (322)..(322): n is a, c, g, or t
  modified_base (325)..(325): a, c, t, g, unknown or other
  misc_feature (325)..(325): n is a, c, g, or t
  modified_base (414)..(414): a, c, t, g, unknown or other
  misc_feature (414)..(414): n is a, c, g, or t
  modified_base (441)..(441): a, c, t, g, unknown or other
  misc_feature (441)..(441): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcggccaccctctcctgcagggccaagtgagtagtattagcgtactactagcctaggtaccaacgagacggcctggccaggcctccgagcctcctcatgtatgactgcttacgaaaacggccagtcggnacnccagccgaggttcaggtgcgtacggtggtcaggtagacgtactcgtactctacaactatacaacacgtacgtaagacgcctagaacgtnttcgtgtacttagttacttactcgtanacgactacgaccgtaacgaagttcgcccgttaccgtacgtttccgggaaccgacggggtccgaaacgtcggtaggtaacggtactcggaaacggtaacgaacggttggtaccgggtcgtaccgaccgtaccgtaacttccgttacgttacctaccgttacctccccggtttacccc

SEQ ID NO: 158871 - DNA, 513 bp, Homo sapiens
  misc_feature: GYAE6OF01CCLST.22.9.A09.1.454.CMB.1.raw
  modified_base (489)..(489): a, c, t, g, unknown or other
  misc_feature (489)..(489): n is a, c, g, or t
  modified_base (493)..(493): a, c, t, g, unknown or other
  misc_feature (493)..(493): n is a, c, g, or t
  modified_base (507)..(508): a, c, t, g, unknown or other
  misc_feature (507)..(508): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcatggtaccaacagaggcctggccaggcctcccaggctcctcatgtatgatgcttccaaaagggccactggcatcccagccaggttcagtggcaggtgggtctggaagagtacttcgactctcaccatcaacagcctagacgcctgacgtattctgtctaagtttattactgtcagctagcgtaaccgagtcggcctaccgtacgtttcggccgacggggccaagcgtggagatcgagacgactgnggcngcactatctgtctnntcccg

SEQ ID NO: 158872 - DNA, 607 bp, Homo sapiens
  misc_feature: GYAE6OF01A9P29.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtatagcgactacttagcctaggtaccaacaggaggcctggccaggcctcccaggcctcctcatgtatgatgcttaccgaaagggtccacgtggaccactccccagcccaggttccgaggtggcgtagggtcgggtacgtgggaagtacggacctttcacttctaccacactaccaacacgaccgttaagacgcctagacgtattctagtactagtttacttacctgtactagtcgacgtaccgtaaccgtaggtcggtcctaccggttaccgtttcgggaccgtacgggggtaccacggtacgtaggacgtagacgacggacgtacggtgtcggtacgtcgaccaccgtactacgttcgttactcctacttccgtaccccg

SEQ ID NO: 158873 - DNA, 694 bp, Homo sapiens
  misc_feature: GYAE6OF01C118S.22.9.A09.1.454.CMB.1.raw
  modified_base (213)..(213): a, c, t, g, unknown or other
  misc_feature (213)..(213): n is a, c, g, or t
tcagacatacgcgtcacgaccggtgctcgatttagcgagacgcgcagggggaggaactgctcagttagggacccagagggaaccatggaagccccagctcagcttctcttcctcctgcttactctggctcccaggacgaccaccggagaagttggtgttgacactagtttccagccaccctgtcttgctcgaggagagcggccaccgtctccngcgagggcctaagtgagagtattagcgtaactacttagcctacggtaaccaacgagaggtccgtggaccagggcctcccgaggtcctacctcacgtagtatggatgtaccttaacgaaaacgggtccacgtcggacaactcccaggcccgttaaggtccaagggtcggacgaagggttcggtacttaggggaagtacgtactttacgacttccgtacaaccgtatacccgaaacgacgtaccgtacggacgtccgtacggtacgtacttcgtactacttaagtttacgttacgtcgttacaccgtaccgacgtaccgtaaccgtaacgtcggtcccgttacccgttacgtttccgggaccggtacggggaccgtaacggtacggtacggtacgtacgtacgacggtacgaacggtcggtacgtacggtacgaccgttaaccgtcgttccgttatacccgttctccgtttcccgtaccccgg

SEQ ID NO: 158874 - DNA, 640 bp, Homo sapiens
  misc_feature: GYAE6OF01D8670.22.9.A09.1.454.CMB.1.raw
  modified_base (284)..(284): a, c, t, g, unknown or other
  misc_feature (284)..(284): n is a, c, g, or t
  modified_base (357)..(357): a, c, t, g, unknown or other
  misc_feature (357)..(357): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctnactgtatgatgcttaccaaaggggccacgtggcactcccagcctaggttcagtcggctaggtggtctgggaanagtacttcactctcactatcaacagacctagacgcctgacgtattcgtagtctaagttttacttactcgtcacggtactacgtaccgtaccgtaacgttcgggtacccgttccggtaccgttttacggggacccgtaacggggggtaccctaagggtaccgtacgggtaacgtaacgtacgtaaggaacccggtaacgttacgggttacgggacgttcggaaccgtacccgtacgttaccgttacggttaccttttaccgtaacgtttccccgttacccccgg

SEQ ID NO: 158875 - DNA, 538 bp, Homo sapiens
  misc_feature: GYAE6OF01B2YTW.22.9.A09.1.454.CMB.1.raw
  modified_base (255)..(255): a, c, t, g, unknown or other
  misc_feature (255)..(255): n is a, c, g, or t
  modified_base (371)..(371): a, c, t, g, unknown or other
  misc_feature (371)..(371): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaanagaggcctggccaggctccaggctcctcatgtatgatgcttaccgaaagggccactggcatccagccagttcagtgcaggtggtctaggaagagacttcactctcaccatcaaacngacctagacgcctagacgattctgtctagtttattactgtcagcagcgtacaagtcgcctcgtacgtttcggaccgtacggggaccgaacggcgtggagactacgagtacggaacgtggtaggtcgtcgaccgacctacttctacgttacttctacttccttacccc

SEQ ID NO: 158876 - DNA, 549 bp, Homo sapiens
  misc_feature: GYAE6OF01EAAZ9.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggcctcccaggctcctcatgtatgatgcttaccgaaaagggccacgtggcactcccagccaggttcaggtgcgagtgggtctaggaacgagcttcactcgtacaccatccaacacgcctagacgcctagaaccgtattcgtcgctaagtttacttactcgtactacgctacgaccgtaccgaagtccggaccttccgtacgtttcgggccgtaggggaccagtcgtaggagactcgaggacgactggtgcgtgcgtacatcgtacttctctctccgtcccg

SEQ ID NO: 158877 - DNA, 665 bp, Homo sapiens
  misc_feature: GYAE6OF01BDZQ2.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacactagtttccagccacctgtctttgtctccaggagagcgggccaccctctcctgcacgggccaatgagagtattagcgactacttacgcctacggtaaccaacgaggacggcctcggaccaggcctcccgaggtcctcctcatgtatgatcgccttaaccgaaaacgggccacgtggacctactcccagcctaggttcaggtggaccgtaggttcgggtcgtagggaacgtacgtactctacgttcctaccgaaccactaacgaaaccgtacgtaccctaaggaccgccgttacgacgtacttcgtacgtacttaagtttacttacttcgtactacgaccgtacgtaccgttaaccgtaacggtccgtacccgtaccggttacggtttccgggaccgggtaccggggtacaacggtccgttagggaacgtacgtacgaaggtaaccgtacggtcgtacggctcgaccctacacgttcgttacgttaccttctacccgttcctaccccg

SEQ ID NO: 158878 - DNA, 665 bp, Homo sapiens
  misc_feature: GYAE6OF01CKL4C.22.9.A09.1.454.CMB.1.raw
  modified_base (253)..(253): a, c, t, g, unknown or other
  misc_feature (253)..(253): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagttccagccacctgtctttgtctcaggagagcggccaccctctcctgcgagggccaatgagagtattagcgactacttagcctggtaaccaanagagcctggaccaggcctccgaggcctcctcacttgtactgatcgtaccttaaccgaaaacgggcccagtcggcactaccccgaggtccctaagggttcgagtcgggactagggttggttcgtaagggaagtacggtaaccttcactctaccacctaagtacaacgagtacctagacgcctacgacgtacttacgtagtacttaagttttaacgttactcgtacgtagaccacgtaccgtaacgtaacgtaccggtcccgtaccgttacgttttaccgggacccgggtacggggtaccgtaacggtcggtacggaacgtagtaaccgtacggtaacggtaagtacgggtgtaccgtacggccgtaaccctacgttacgttacgttacttaccgttcgttccccttaccccgg

SEQ ID NO: 158879 - DNA, 693 bp, Homo sapiens
  misc_feature: GYAE6OF01B3ZF9.22.9.A09.1.454.CMB.1.raw
  modified_base (264)..(264): a, c, t, g, unknown or other
  misc_feature (264)..(264): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagccgggccaccctctcctgccgagggccaaagtgacgagttattagcgactacgttagccgtggtaaccanaggacgcctggccaggcctcccgaggtcctcctcatgtactgatgcttaccgaaaaggccacgtcggctacgtccccgagtaccgtagggttccgaaggtcgggtacgacgggttcgggttacgtacgggaaaaggtacgttaccgtttaccaccgttctacgaacctacgtacaaacgtacgaccgtagacgtccgtagactacttccgtgacgttagtttacttacgttcgtacgtagacgacgtaccgtaacgtaacgtccgtaccgtacccgttacgtttaccgggaccgtacggggtaccgtaacggtccggttaggacgtacgttacccgaaggtaacccggtaacgtacgggttcggacgtccgtaccggaaccgtacttaccggcttttaacccgttcctcccgtttccccgtttaccccg

SEQ ID NO: 158880 - DNA, 638 bp, Homo sapiens
  misc_feature: GYAE6OF01A54WE.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttagacacagtttccagccaccctgtctttgtctccaggagagcgggccacccgtctcctgccagggccaatgagagtattagcgactacttagcctggtaccaacagacggcctggccaggctcccaggcctcctcatgtatgatgcttccaaagggccactggcatcccagccaggttcagtcggcaggtggtctaggagagacttcgactctcgaccatcaacagcctagcgccgtgacgtattctgtactagtttacttacgtgtctacggctacggtccgtaaccgtaaggttccggacccgttaccggttacgttttaccgggcccggttaaggggggacccgtaagggaccggttacgggaacggtaacgtaccggaacggtaccggtaaaccggtttgggacggtaccggttcggacccgtacccgttacgttcccgttggttaccctttcccgttacgttccccgttttacccccgg

SEQ ID NO: 158881 - DNA, 726 bp, Homo sapiens
  misc_feature: GYAE6OF01EZ9M8.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccaggtgccagtgcagaagtagtgatgacgcagtctccaggccaccctgtctgtgtctccgaggggaaagacgccaccctctcctgcgacgggccagtcagagtattagacaactaacttagcctaggtaccaacagacggcctggaccaggcctcccgaggcctcctcatgtatgatcgtcgttaccgaaaacgggccacgtcgacactaccccgacgaccgtaggttccgaaggtcggaccgtagggttcggggttacgtagggtaaagtacggtaactttaccgaaccgttcctacctaacccgtaactaacccgtaaacgaaccggtacccgttaacggaaccggtacccgttaacggtaaaccgtaaccgtttcgttaccggtaaccgtttaaggtttttaacctttaaccgtttacggttaacctacggtaccgtaacggtaacccgttaacccgtaaacgggttcccggtaccccggtttaccggttaacccgttttcgggacccgggtacggggaccgtaacggcgtaacgggagtacgtacgaaggaacgtacggtcgtaggacctcgtacacgtacttccgtgttacc

SEQ ID NO: 158882 - DNA, 723 bp, Homo sapiens
  misc_feature: GYAE6OF01BX6TG.22.9.A09.1.454.CMB.1.raw
  modified_base (286)..(286): a, c, t, g, unknown or other
  misc_feature (286)..(286): n is a, c, g, or t
tcagacatacgcgtcacgaccggtgctcgatttagcgagacgcgcagggggaggaactgctcagttaggacccagagggaaccatggaagccccagctcaacttctcttcctcctgctactctggctcccagagaccaccggagaagttgtgttgacacagtttccagccaccctgtctttgtctccaggagagcgggccaccctctcctgcagggccaatgagagtattaggcgactacttagcctggtaccaacagaggcctggccaggctcccaggcctcctnatgtatagatgtcttaccgaaaacggtccactggcactcccacgccgtaggttcaaggtcggaccgtaggttcggggtacgtaggggtaaagtacggtacctttaccgacctttaccgtacctaacccctaagttaccaaaccgacggtacccgtaaggaccggtaccgttacgggtaacctacgttccgtagtacgttaaggttttaacttaacgttcgttacgtacgtacgtacggtacccgtaaccggtacggtcggtacccgtttaccggttaccggttttaccgggacccggtacggggggaccctaacgggtccgtacgggaataccggtacgaacgggtaaccgtaacggtacggtcgggtacgtaccggtaccgtacccgtacttaccgttcggttacctttaccgtaccttcccgttccccgtaaccg

SEQ ID NO: 158883 - DNA, 672 bp, Homo sapiens
  misc_feature: GYAE6OF01D5OLS.22.9.A09.1.454.CMB.1.raw
tcagacatacgcgtcacgaccggtgctcgatttagcgagacgcgcaggggggagggaactgtctcagttaggacccagagggaaccatggaagccccagctcagcttctcttcctcctgctactctggctcccagagaccaccggagaagttgtgttgacaacagtttccagccaccctgttctttgtctccaggagagcgggccaccctctcctgcagggccaatgagagtattagcgactacttagcctggaccaacagacgcctggccaggcctcccaggtctcctcatgtatgatgaccttaccgaaaacgggccacgtggcactcccgaagcccgaggttcaacggttggcaggttcggtcgtagggaagtacgacctttcaaccgtcctcctaccctacttaccaaaccgtacgtaccctaaggtacgtacccgtaggaaccgtagtttccgtggtacttaaggttttaacgttaccgttgttaccgtacggtacgtacgtaaccggtaacgtacggttccggtacccttcggtttaaccggtttccgggacccgggttaccggggaccgtaacgtcggtaggaacgtacgtacgacggtaaccgtacgtgggtacggctcgaacctacctattccgttacttccttactccgttcccgtaccccg

SEQ ID NO: 158884 - DNA, 742 bp, Homo sapiens
  misc_feature: GYAE6OF01BPUOL.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagccgggccaccctctcctgcgagggccaatgagagtattagcgactacttagcctggtaccaacagaggcctggccaggcctcccgaggcctcctcatgtatgatcgaccttaccgaaaacggccaacgtcggactactcccagaccgtaggttcagtggacgtaggtcgggtacgtagggaaacggtacgtacctttaccgaaccctacccgaacctaacgtaccaaacgtacgtacccgtaacggtaccgacccgttacggaaccgtacgtttaccgtacgttaccgttaaggttttaacgttaccgttacgtaccgtaacggtaccgtacggtaccgttaaccgtaacgggttacccggtcccgtttacccgggttaaccgttttaccggggacccgggtaacgggggtaccctaaacgggtccggtagggtaacgtcggtaacgaaccggtaaccggtaacggttggtaccggtacgtaccgaccgttaacccgtacggttaccttcgttaacctttacgtaccctttcccgtaccccgtaaccg

SEQ ID NO: 158885 - DNA, 732 bp, Homo sapiens
  misc_feature: GYAE6OF01DCHJX.22.9.A09.1.454.CMB.1.raw
  modified_base (222)..(222): a, c, t, g, unknown or other
  misc_feature (222)..(222): n is a, c, g, or t
  modified_base (571)..(571): a, c, t, g, unknown or other
  misc_feature (571)..(571): n is a, c, g, or t
tcagacatacgcgtcacgaccggtgctcgatttagcgagacgcgcagggggaggaactgctcagttaggacccagaggaaccatggaagccccagctcagcttctcttcctcctgctactctgctcccagacgaccaccggagaagttgtgttcgacactacgtttccacgccctacccgttgttctttgtcctccgaggagacgccggcccaccctctccngcgacggccaagtgagagtatagcgtactacgtacgcctagtaaccaagaggacgcccgtcggacccgacggtccctacccgacggtcctccgtactagtgtatggtacttacgtacccgttaaccgaaaacgggccctaacgtcggtacctacccgtaccccgaacgtaccgtacggttacgaacgggtcggtaccgtggggttacgggttaccgtaagggaaaccgtacggttaaccctttactacccgtacgtaacccaacccgtacttaaccgaacgtaccggtacccgttaagccgtaccgtacggtaactacgttcgtacgttacttacgtttactatcgtanacggtcgtacgaccgtaacgtcggtaccgtaccgttccgtacgtttccggaccgttacgggaccttacggacgtaggtacgacgtacgaacgaccgtaacggttggaccgtcgtccggactacctacgttctcgttaccttccgttcgtccccgttacccg

SEQ ID NO: 158886 - DNA, 777 bp, Homo sapiens
  misc_feature: GYAE6OF01BN9MM.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccacctgtctttgtctccaggagagcgggccaccctctcctgcacgggccaatgagtagtattagcgtactacttagcctggtaaccaacaggacgcctcggaccgaggcctccgacggtcctccctactatgtacgtgtaacgtcggtaccttaacccggaaaacgggccctaacggtcggacctacgttaccccgacgcccgttaacgggtttaccagggttacgggcgtaacggggttcgggtacgtaaggggaaacgtacggttacctttaccaccgttctacctaacctaactaccaaacgtaacggtacccttaagaccgtaccgtaccgacgtactttaccgtacgtactttacgtttaatttaccgttacgtacgacgtaccgtaacgtaccgttaaccgtaacggtaccggttacccgttacccggttaacggttttacccgggccgggtaaccgggggtaccgtaaccggtacggttacggacgtaacgtaccggtaaccggaaccggtaacgttcgggtacggtacgttaccggacccgtaacccgttagttaccccggttacgttaccgtttacctacccgtttccccgttaccccg

SEQ ID NO: 158887 - DNA, 707 bp, Homo sapiens
  misc_feature: GYAE6OF01AGAOD.22.9.A09.1.454.CMB.1.raw
tcagacatacgcgtcacgaccggtgctcgatttagcgagacgcgcagggggaggaactgctcagttaggacccagagggaaacatggaagccccagctcagcttctcttcctcctgctactctggctcccagagaccaccggagaagttgtgttgacactagtttccagccacctgtcttgtctccaggagagcggccacctctcctgcgagggaccaatcgagagtattacgcgactacgttagcctaggtaccaagacggacggcctcggccgaggcctcccgaggtcctcctcgactgtactgtatcgtaccgttaccgaaacggcccagtcggacacgtcccgagccgtacgttcgaggtcggacgtaggtcggtcgtaggaagtacgtacttcgacttcgtaccaacgtactaccgaacgtacgtaccgtaacggacgtaccgtaggtaccgttacttcgtacgtaccgtttaacgtttaacgttaccgttcgtacgtaacggtcgtacgtaccgttaacgtaacggttccggtacccgttaccggttacggtttccgggaccgggtaccggggtaacctaacgggttccgtacgggacgtacgtaccggaacggtaccgtaacggtccggtaggtcccgttacgacccgtaccgttacgtccgtttaccgttacctttcccgtccgttccccgttaccccg

SEQ ID NO: 158888 - DNA, 620 bp, Homo sapiens
  misc_feature: GYAE6OF01BJ8XZ.22.9.A09.1.454.CMB.1.raw
  modified_base (334)..(334): a, c, t, g, unknown or other
  misc_feature (334)..(334): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcggccaccctctcctgcagggccaatgagagtattagcgactacttagcctggtaccaacagaggcctggccaggctccaggctctcatgtatgtatcgcttaccgaaaagggccacgtggccactcccagccaggttcngttggcgagtgggtctgggaagacgtacttcactctacacctatcaaacacgacctagactccgtagacgtattctgtacgttagtttaataccgttagtacgtacgcgtaggacccgtaaccgtaacgtccggtaccgtcccgttaccggtttacgtcccgggtaacggggtaccgtaacggtacggtaggtaacggtactaacgacggaacggtaacgtacgggtgaccggttcgaccgtaactaccgttacgtacttcgttaccctgttccccgttacccccg

SEQ ID NO: 158889 - DNA, 806 bp, Homo sapiens
  misc_feature: GYAE6OF01CA8FX.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgactacagtttccagccaccctgtctttgtctccaggagagcgggccaccctctcctgcagggccaatgagagtattaggcgactacttagcctggtaccaacagaggcctggccaggcctcccgaggcctcctcatcgtatgatcgccttaccgaaaagggtccaacgtcggacctacgcccagccctagggtttccaggttaggcgtagggttcgggtacgtagggaaagtacggtacctttaccaacgttcctaccgaaccctaattaccaaaaccacggtacccgttaaggacgtaccccgtacggtaaccgtaactttccgtacggttaaccgttaacggtttttaactttaaccgttacgttaccgtaacggtaccgtaaccgggtaccccgttaaacccggtaaccgggtttacccgggttaccccgttaccccggtttaaccggtttttacccggggaacccgggtaaccggggggtaacccgttaaacgggtaccggttacggggaaccgtaacggttaccggaaaccgggtaaccggttaaacggtcgggttacgggtacccgttacggacccgttaaacccgtacgtttaccgttaccggtttaccctttacccgtaacccgtttccccgtttaccccccg

SEQ ID NO: 158890 - DNA, 556 bp, Homo sapiens
  misc_feature: GYAE6OF01DX1DG.22.9.A09.1.454.CMB.1.raw
  modified_base (406)..(406): a, c, t, g, unknown or other
  misc_feature (406)..(406): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagagcctggcaggctccagctcctcatgtatgatgtacttaccgaaaacgggtccactcggctactcccagccaaggttcaagtggcagtgggtctggaagagtactcactctcacatacaaacacgacctagagcctacgacgtattctnctaagtttattactgtacagcgacgtcgtaacgaagtcggccttaccgtacgttttcggaccggtacggggaccaaggtcgtaggagtactcgacggtacgtaacgtgtaggcgtcgccaccattctagttccttctcttccgtaccccg

SEQ ID NO: 158891 - DNA, 551 bp, Homo sapiens
  misc_feature: GYAE6OF01EIT6E.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaaccaacagacggcctggccaggctcccaggctcctcatgtatgatgcttccgaaaagggccactcggcatcccagccaggttcagtggcaggtggtctggaagagacttcactccacaccatacaacagacctagacgtccctagacgtattctgtctagtttacttacttgtcacgcagcctaaccagtcgtcctccgtacgtttcggccgtacggggaccaaggcgtagggacagtcgagacgaacgtggtaggcttggacccactacgttctacgttccttctacgttccttaccccg

SEQ ID NO: 158892 - DNA, 750 bp, Homo sapiens
  misc_feature: GYAE6OF01EE73R.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgacttacttagcctaggtaaccaacagacggcctggccaggcctcccgaggcctcctcatgtatgatcgtccgttaccgaaaacgggcccaacgtcggcctactacccgagcccgtaggttcaggtcggccgtaagggttcgggtacgtagggaagtacgtactttaccactcctacctacctactacgaaacacgaccgtaagacgtacctacgaacgtactttccgtagtacgttaagtttttacgttacgttgttaccgacgacgtacggtacccgttaacgtaaggttccgggtaccctttacccggttaccggttttaccggggacccgggtaacggggggtaccctaacggggtccgtaacggggtaacgttacggtaaccggtacgggtaaacccggttaaccgggttcgggttacccgggtaccgttccggaaccccgttacccgttaaccgtttccgtttaccggtttacccctttaccgttaacccgtttccccgtttaccccccgg

SEQ ID NO: 158893 - DNA, 714 bp, Homo sapiens
  misc_feature: GYAE6OF01EHBL9.22.9.A09.1.454.CMB.1.raw
  modified_base (237)..(237): a, c, t, g, unknown or other
  misc_feature (237)..(237): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagccgggccaccctctcctgcgaggccaatgagagtattacccgngactacttagcctaggtaccaacaggacggtcctcggccaggcctcccgaggcctccgtcagtgtatgatcgacttaccgaaaagggcctacgtggccactcccgagtccgtaaggttcgaggtcggacgtaggtcgggtacgtagggaagtacgtacttacaccgttctaccaactactacgaaaccgtacgtaccgtaagacgtccgtagtaccgtacgttcgtacgtacttaagtttacttacgttacgtacgtacgtacgtacgtaccgtacgtaacgtccggtacccgttaccggttaccggttttacgggacccgggtaacgggggtaccctaacgggtcggtacggggaacgtaacgtaccgtaacggtaaccggtaacgtacgggttaggtaccggtaccggtaacccgaacccgttacgttaccgtttaccgtttaccgtttaccgtacccgtttccccgttaccccg

SEQ ID NO: 158894 - DNA, 805 bp, Homo sapiens
  misc_feature: GYAE6OF01EPZF3.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctctgctactctggctccagagaccacggagtaagttgtgttgacactagtttccagcccaccttgttctttgtctccgaggagagccggccaccctctcctgcgaggaccaagtggagtagttatacgcgtactacttacgcctaggtaaccaacgaggacggtccgtcggaccgacggcctacccgacggtccttcctacgtagtgtacgtggtacgttacgtaccgttaaccggaaaacggggccctaacggttcggacctaccgtacccgacggtaccgtaacgggttacgtacgggttcgggacggtacggggtttacggggttacgtaaggggtaaacggtaacgttacctttacccgtaaccttacccgtaaccgtaaccgtaaccttaaccgaaacgtaccggtaccgtaacgggtaccgtaccgttaacggtaccgttaacgtttccgttacggttacctttaacggtttttacttacgttacgttacgacgtaccgtacggtaaccgtaaccggtaacggttccgtacccgttaccggtttacggtttccgggaccgggtaacggggtaccgtaaggtccggtaggtaccgtacgtacggtacggtaacgtacggttcggtacggacttaccggaccctaccgtacgttccgttacgttactttccctacgttcccccgtacccg

SEQ ID NO: 158895 - DNA, 773 bp, Homo sapiens
  misc_feature: GYAE6OF01CKQ2W.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacactagtttccagccctaccctgttctttgtctccgaggagagccgggccaccctctccgtgcgacgggaccaagtcgaagtagttaattacggcgtaaccttacgttacgtcccgttaggtaaccaagacggacggccgtacggaccacgggtccctcccgacggtcctccgtcaacgttgtactggtatcgtaccttaaccgaaaacgggtccacgtcgcaacctccgacgtccgagttccgaggtcggacgtaggtggtacgtaagggaacaggttacccttacaccttacctaacctaaccccgtaataaccgaaacgtacccggtaccgttaacgaccgtaccgtacggtaaccgttacgtttccgtacgtttaccgttaaggtttttaacttacgttacgtacgtaacggaccgtaacggttacccggtaaccgtaacggttcccggtaccgtttacccggttaacggttttcccggggaccgggtaaccggggacgtaacggtacgtacgggacgtaccgtacggaacgtaccggtacgttcgggtacgtcgtacgtacccgtacgttacttccggttacgtttaccgttactcccgttcccgtaccccg

SEQ ID NO: 158896 - DNA, 692 bp, Homo sapiens
  misc_feature: GYAE6OF01CSG78.22.9.A09.1.454.CMB.1.raw
  modified_base (664)..(664): a, c, t, g, unknown or other
  misc_feature (664)..(664): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagacgaccaccggagaaggttgtgttgacactagtttccagccctaccctgtctttgtctcaggagacggccgggcccaccctctccgtgccgacgggccaagtcgaagtagttaattaggacgtacttacttacgccctagggtaaccagaggacggcctcggacccaggcctacccgaggtccctaccgtcattggtatagtactcgtaccttaaccggaaaacgggcccacgtacggccactaccccgagtcccgtaggttaccgaggttacggcgtaggttcggtcgttaaggaacggtacgtactttacgaccttacctaccaccgtactaccgaaactacgtacctagaccgtccgtaacgtaccgtacttcgtacgttacttaacgttttaactacgttacgtacgtacgacgtacgtaccgtacgtaacggtccgtacccgttccgttacgtttcggaccgggtacgggccgaacgtcgtaggtacgacgtacgaccgtacgacggttggtacgtcgcaccgtacngtcctctacctactccgttccctacccg

SEQ ID NO: 158897 - DNA, 621 bp, Homo sapiens
  misc_feature: GYAE6OF01DMFUG.22.9.A09.1.454.CMB.1.raw
  modified_base (365)..(365): a, c, t, g, unknown or other
  misc_feature (365)..(365): n is a, c, g, or t
  modified_base (390)..(390): a, c, t, g, unknown or other
  misc_feature (390)..(390): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctcaggagagcgggccaccctctcctgcacgggccaatgagagtatagcgactacttacgcctaggtaccaagagacggcctggaccaggcctcccgaggtcctcctcatgtatgatgaccttacgaaaggccacgtggcactccagcctaggttcaggtggctaggtcggtacagggaagngtacttcactctacaccatacaacncgtacctagacgcctagacgtattcgtgtacttaagtttattacgtgtacgagtcgacgtaccgtacgtaacggtccggtaccttaccgttacggttttccgggaccgggtacggggtaccacggtacggtagggaacgtacgtacgaacggtacggtaacgttcgggtaggtcgtcggaccctaccgtacttaccgttcgttacctttaccgtctttccccgttaccccg

SEQ ID NO: 158898 - DNA, 615 bp, Homo sapiens
  misc_feature: GYAE6OF01CRGA4.22.9.A09.1.454.CMB.1.raw
  modified_base (536)..(536): a, c, t, g, unknown or other
  misc_feature (536)..(536): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccgggagaagttgtgttgacactagtttccagccaccctgtctttgtctccaggagagccgggccaccctctcctgcacgggccaatgagagtattagcgactacttacgcctaggaccacagacgcctggccacggcctacccgaggtcctaccgtctattcggtatgatcgtaccttaaccgaaacgggcctacgtcggacctactccccgagcccgtaggttccaggtcggctaggtggtcagggaagtacgtactcactctaccactactacacgtacacgtagcgtactacggtactactcgtacgtacttagtttactcgtcgaacgacgtcgacgtaccgtaacgtacggtccgttcccgtacgttcggtaccggaccgggtacggtacgngtacggtgacgctacgaacgtacgtagtcggctacgtcaccgtacttacgtcgttactcttactccgttcccgtacccg

SEQ ID NO: 158899 - DNA, 652 bp, Homo sapiens
  misc_feature: GYAE6OF01EWC5D.22.9.A09.1.454.CMB.1.raw
  modified_base (348)..(348): a, c, t, g, unknown or other
  misc_feature (348)..(348): n is a, c, g, or t
  modified_base (362)..(362): a, c, t, g, unknown or other
  misc_feature (362)..(362): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccacggagaagttgtgttgacactagtttccagccaccctgttcttgtctccaggagagccgggccaccctctcctgcgagggccaatgaagagtattagcgactacttagcctaggaaccaacgagacggcctggccaggcctcccaggcctcctcatgtatgatgcttaccgaaaacgggccacgtcgcactcccagccagttcaggtgcnggtcggctaggganagtacttcgactcacacatcacgcagcctgcgtacgtcgtagtaagtacgtttagtacttagtttagttactacgtactactaccgtaactaattaactaaccgtacggtacccgtaaccggttacgttacgggttttacgggacccggtaacggggaaccgtaacggtaccggtaagtaacgggtaacgttaaaccgtaaaacggtaaccgtagggttaccgggcgttaccgtacgtaaccctacgtttaccttaccggtttacctttaaccgtaccgtttaacccccg

SEQ ID NO: 158900 - DNA, 756 bp, Homo sapiens
  misc_feature: GYAE6OF01D0P5A.22.9.A09.1.454.CMB.1.raw
  modified_base (192)..(192): a, c, t, g, unknown or other
  misc_feature (192)..(192): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacactagtttccagccaccctgttctttgctccaggngagcggccaccctctctgcaggccaatgagtatattagcgacttactagcctaggtaccaacgaggacggcctcggaccgacggccctacccgacggtcctcctactacttggtatgtagtcgtaccgttaaccgaaaaacgggtcccaacgtcggacctaccgtaccccgaacgtacccgtaagggttaccgtacggtcgggtacgtacggggttacgggtccgtaaggggtaaacgtaacggtacctttaccgtaccgttactacccgtaacctaactaacctaaaccgtacgtacccgtaagaccggtaccgtacgtaccgtaacgtttcgtagttacgttaacgttttaacttaccgttacgtaccgtacggtaccgtaacggttacccgttaaccgtaacggttcccggtacccgttaccgttaccggtttcggacccgggtacggggtacctaacggcgtacggaacgtaacgtaaccgaaacgtacggtacggtcggtacgtacggtactaccgttacgtcgttacgttcttacctacctttcccgtacccgtaccg

SEQ ID NO: 158901 - DNA, 591 bp, Homo sapiens
  misc_feature: GYAE6OF01CGNO6.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggcctcccaggcctcctcatgtatgatgcttaccaaagggccactggacatacccagccaggttcaggtggcgaggtggtcaggaagagactttcactctacaccatacaacagacctagacgccgtacgacgtattctgtactagtttacttacgtacgtcgagacgtacgaccgtacgaacgtcggcccgtaccgtacgtttcggccggtacggggacctacggtcgtacggagtacgtacgaacggacgaacgttcgggtaggacgtcggcctaacccgtcgttaccgttcggttaccttctaccgttcccgttaccccg

SEQ ID NO: 158902 - DNA, 689 bp, Homo sapiens
  misc_feature: GYAE6OF01DLST5.22.9.A09.1.454.CMB.1.raw
tcagacatacgcgtcacgaccggtgctcgatttagcgagacgcgcaggggggaggaactgctcagttaggacccagagggaaccatggaagccccagctcagcttctcttcctcctgctactctggctcccagagaccaccggagaagttgtgttgacacagtttccagccacctgtctttgtctccaggagacgcgggccacccgtctcctgcagggccaatgagagtattagcgactacgttagcctggtaccaacagaggcctggccaggctcccgaggctcctcatgtactggatcgtacttaccgaaaagggccagtcggcactcccagccaggtccagtggcaggtggtcgtggaagagacttcgactctcaccataccaaacacgacctaaggacgtacccgtaggaacgtaatttcgtacggtacctttaaggtttttaactttaaccgttacgtacctaacggtaccgtaacggtaccggttaaacccgaagggttccgggtaccccgtttacccggttacggtttttaccgggacccgggtacggggggaccctaagggtaccgttagggaaggtacgtacggaaaccggtaacgaaccggttgggtacggacgttccggaacctacccgtacgttccgttacgttacccgtttacctacgttccccgtttaacccccg

SEQ ID NO: 158903 - DNA, 676 bp, Homo sapiens
  misc_feature: GYAE6OF01C8C5R.22.9.A09.1.454.CMB.1.raw
  modified_base (518)..(518): a, c, t, g, unknown or other
  misc_feature (518)..(518): n is a, c, g, or t
  modified_base (623)..(623): a, c, t, g, unknown or other
  misc_feature (623)..(623): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagacgaccaccggagaagtttgtgttgacactacgtttccagccctaccgtgttctttcgtcctcgaggagcgccggcccaccctcgtaccgtcgcgacggaccaagtcgaagtagtaacttagccgtaacttacgttacgccttacggaaccaacgaggacgtccgtcggaccacggcctccgacggcctacctactagtctagtgtactcgtaccttaacggaaacggcctagtcgacacgtccgagtccgtaggttcaggtcgacgtacggtcggtacgtaggaacgtacgtacttacgaccttcgacaacctataaccgaacctacggtaacacgtacgtaccgtacgtaacgtcttacgtgtacgtttattacttagtcgtanacgtacacggtaacctcgtaacgtccggtaccttaccggttacgtttcccgggacggtaccggaccgtagtcgtacggatacggtacgacgtacgacgttacggngacgtcgacctacgtacttccgttaacgttccttactccgttcccgttacccg

SEQ ID NO: 158904 - DNA, 775 bp, Homo sapiens
  misc_feature: GYAE6OF01DUDT3.22.9.A09.1.454.CMB.1.raw
  modified_base (446)..(446): a, c, t, g, unknown or other
  misc_feature (446)..(446): n is a, c, g, or t
tcagacatacgcgtcacgaccggtgctcgatttagcgagacgcgcagggggaggaactgctcagttaggacccagagggaaccatggaagccccagctcagcttctcttcctctgctactctggctccagacgaccgacggagtagttgtgttcgaccactacgtttcccacgccctacccgttgtttcctttgtcctccgagggagcggccggtacccacccttcgtccgtggccgacggaccaagtcggagtatagttacgacgtacttacttacgccgtaggtaacccaagaggaccggtccgtcggacccgacgggttcccaacccggtacggtcccttacctacgtagtttcgtaagtcgtaacgttccgtaaccgttaaacccggaaacgggtcccttaacggcgaccttaacccgcccgtagtacccgttagggttacngggtaccggacgttagggtcggtagtaaggacggttacctactacgtacctcacccgtaactacaaccgcgtaacctcgacgaccgtaccgtcgtaacgtacgttcgtagttactttagtttacgttacgttcgacgtacgtcgtaccgtaccgtacgtaccggttcgtcccggtttaccgttaacggtttccggaccgggtaacgggacctaggtcgtagggtaaccgtacgtacgaaccggtaacggttcgttacggaccgtcgtaccggactaacccggttcttaccggttacgttaccctttccgttaccgttccccgttacccg

SEQ ID NO: 158905 - DNA, 568 bp, Homo sapiens
  misc_feature: GYAE6OF01DO24W.22.9.A09.1.454.CMB.1.raw
tcagacatacgcgtcacgaccggtgctcgatttagcgagacgcgcagggggagggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagagcctggccaggctcccaggctcctcatgtatgatgcttacaaaagggccactggcatcccagccagttcagtggcagtggtctggaagagacttcactctcaccatcaacagacctagagcctgacgtattcgtgctaagtttattactgtacagtcagtcgtaccaaggtcgtcctaccgtacgttttcggccgtacgggggcctaagtccgtgggagtacgtacaggaccgtaaccgttggtagggcgttcgaccgtacccgaacgttccgttacggttcctttacctagtttccccgttacccccg

SEQ ID NO: 158906 - DNA, 819 bp, Homo sapiens
  misc_feature: GYAE6OF01EJIAZ.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggcctcccagacgaccgaccggagtaagttgtgttgacactagtttccacgcctacccttgttctttcgtcctccgaggagacggccggccctaccctcctccgtcgaccgacgggaccaagtggaacgtagttagtacgaccgtaacttacgttacgccgtacggtaccaacgaggacgccgtcggaccgacggtccctccgacggccttacctctagttagtatcgtattcggtaccgttaaccggaaaacgggccctacgtcggacacctacccacggccgtaggttcgtaacgggtcggacggtaggggttacgggtacggtagggtaaccggtacgttaccttacgtaaccttcctaacctaccgtactaaccgaaacgtccgtaaccgtacgaccgtacccgtacgtaacgtctttacgtacgttaacgtttaacgtttacgttacgtagtcgaacggtccgtaacggtacccgttaacgtaccggtccgggttacccgttaccggtttaccggttttaccggggaccggggttaccgggggtaaccgtaacgggtacggtacgggtaacgtaaccgtacggtaaccggtaaccggtaacggttccgggacggttccgtacccggaaccgtacccttacgttacccgttttacgttacccttacccggtttccttcccccggttaccccg

SEQ ID NO: 158907 - DNA, 735 bp, Homo sapiens
  misc_feature: GYAE6OF01DRGCF.22.9.A09.1.454.CMB.1.raw
  modified_base (261)..(261): a, c, t, g, unknown or other
  misc_feature (261)..(261): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagacgaccaccgggagaagttgtgttgacactagtttccagccaccctgtctttgctcaggagagcgggccaccctctcctgccagggtccaatgagagtatagcgactacttacgcctcggtaaccaacngacggccgtggccacggccgtccccgggtctcctcattcgtatgatcgacttaccgaaaacgggcctaacgtcggaccactcccgagaccgtaggtcgagtcggcgtaggtcgggtcgtagggaagtacgtaccttcgacttccgtacaacccataccgaaacgtacgtactaacgacgtaccgtacgacgtacttctacggtacgttaacgtttacttaacgttcgtacgtacgtacgtacgtaccgttaacccgtaacggttaccggtcccgtttaccgttacccggttttacgggacccggtaacggggggtaccctaacgggtcgttacgggaacgtacgtaccgaacggtaaccggtaacgttacgggtacggtaccgttacgggtaccccgtaacccgttacgttacccgttaccggttttaccgtttaccccttaccgttcccccgtttcccccgggttaaaccccg

SEQ ID NO: 158908 - DNA, 827 bp, Homo sapiens
  misc_feature: GYAE6OF01EK8XF.22.9.A09.1.454.CMB.1.raw
  modified_base (784)..(784): a, c, t, g, unknown or other
  misc_feature (784)..(784): n is a, c, g, or t
tcagacatacgcgtcacgaccggtgctcgatttagcgagacgcgcgagggggaggaactgctcagttaggacccaggagggaaccagtggaacgccccagctcagtcttcctcttcctctgctactctcggcctcccagacgaccgacggtagtaagttgtgttcgactacgtacgtttccacgccctacccgttgtttcctttcgtcctaccgagggtacgacggccggccctaccctcgtccgacgcggacggacaagtgagtacgtagtacgacgtacttacgttacggaccgtcggtaaaccaacggtacggacggtccgtacggaccgtcggtcccacccgtacggtacctccgtatacgttagtctacggtacgtacgttaaccggtaaccggtaaacggccctacggtacggacctaccgtacccgacggtacgtacggttaccggaggtcggacggttaggggttcggtaacgggtaaggaccgttaacgtacttacctaccgtacctaacaacccgtataaccccaaacggtacccgtacggtaaaccgtccgttaaccgtacggttacgttaccttgttaaccggttattaacgtttataccgttcgaacgtgtacccgtacggtaacgttaccggagtttacccggaccggttttaaccgggtacggtttacgggggacccgggtaaccgggttaaccgaggtccggtacggtaacgtacgggtaaccgtaacggacggttacggtcggtacgtacctacggcccttaacggngtttaacccgcgttttaacccgtccgtccgttcccgtaacccg

SEQ ID NO: 158909 - DNA, 602 bp, Homo sapiens
  misc_feature: GYAE6OF01CD9WX.22.9.A09.1.454.CMB.1.raw
  modified_base (256)..(256): a, c, t, g, unknown or other
  misc_feature (256)..(256): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggcccaccctctcctgcacgggccaatgagagtattagcgactacttagcctggtaccanagaggcctggccaggcctccgaggcctcctcatgtatgatgtacttaccgaaaagggccaacgtggactactcccgagccgaggttcaggtggctaggtggtcgtaggaacgagtacttcgactctacactactacaacacgtacctagacgtcctacgacgtacttcgtgtacgtagtttacttacgtgtacgagtactaggtaccgtacgaaggtacggtcccgttaccggttacgtttacgggccggtacggggaccaaggtcgtaggaagtacgtacgaagacgtaacgtcggtggacgtcgaccaccgtacttccgtagttcgttctcgttcccgtacccg

SEQ ID NO: 158910 - DNA, 729 bp, Homo sapiens
  misc_feature: GYAE6OF01DJ9L6.22.9.A09.1.454.CMB.1.raw
  modified_base (256)..(256): a, c, t, g, unknown or other
  misc_feature (256)..(256): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggcccaccctctcctgcagggccaatgagagtatagcgactacttagcctggtaaccaancgagcctgcaggctccaggctcctcatgtatgtatcgtacttaccgaaaaacggggccctaacgtcgggactaacgttccccaagaccccgtaaggtttccaagggttcgggaccgtaaggttcgggtaccgttagggaaaacggacggtaactttcaaccttcgtaccaaccacttaccgaaactacgacccgttagaggtaccctacgtaacggtactttaccgttacgcgttaagttttaactttacccgtttacggtaccgtacggaccgtaacggtacccgttaaacccgaacggttacgggtacccgttacccggttaccgtttttacgggcccgggtaacggggggtacccgaaacgggaccgttagggaacgtaacgtaccgaacggaacgtaaacgtcggtaggtccgttagcccgaacgtaacttccgttacggttcctttacgtaccttccgttaccccccg

SEQ ID NO: 158911 - DNA, 710 bp, Homo sapiens
  misc_feature: GYAE6OF01CLAGB.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgtaactactagcctggtaaccaacagaggcctggccaggcctcccgaggcctccgtcatgtatgattgaccgttaccgaaaagggccctaacgtcggaccaactccccgaagtcccgtaaggtttccaaggttggcctagggttcggtcgtagggaaagtaccgtacctttcaacctcgtaccacctatacccgaacctagaccttaagacgtacctacggtacgtaacttcgtacgtacgttagttttaacttacgttcgtacgtacgacgtacgtaccggttaacgtaacggttaccgggtcccttacccggttaccgttttaccgggcccggtaacgggggtaccctaacgggtacgtacgggtaagtacgttaccgaaacggtaccggtaacgtcggggtagtaccggtcggtaccctaacccgtacgttacccttcggtttccctttaccgtaccgtttcccgttacccccg

SEQ ID NO: 158912 - DNA, 628 bp, Homo sapiens
  misc_feature: GYAE6OF01AU59L.22.9.A09.1.454.CMB.1.raw
  modified_base (596)..(596): a, c, t, g, unknown or other
  misc_feature (596)..(596): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggcctcccaggcctcctcatgtatgatcgtcttaccaaaagggcctacgtggacactcccgagccgtaggttcgaggtcggctaggttcgggttcgtagggaagacggtacctttccgaccgttctaccaacctactaccaacacgtacctaagacgtccgtacgacgtactttcgtcgtactaagttttattaccgtgtacacgctaacgtccgtaaccgtaaggtccggtccgttacccgttacgtttcggacccgacgggggtacccaaggtcgtaggaagtcacgaacgtacgaacgtcggtacggtacgtcgaccgtaccgtnttacgtcgttacttctacttcccgttaccccg

SEQ ID NO: 158913 - DNA, 635 bp, Homo sapiens
  misc_feature: GYAE6OF01BLNPP.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgccagggccaatgagagtattagcgactacttagcctggtaccaacagacggcctggccaggcctccccgaggcctcctcactgtatgatgacttaccgaaaagggccacgtggccactcccagtccaggtcagtggcagtggtctaggagagactcactctccacatacaacagccctagacgcctagaccgtacttactcggtacttaggtttaacttacgttcgttacgtacggacctacggtaccggttaaccgtaacggttccggtacccgttacccggttaaccggtttttcccgggacccgggtaaccgggggtacccggtaaacggccgtagggaacgtacgtacgtaaccggacgtaaacgtcggtaggacgtcggccactaccgtctcgttaccttactcgttcccttacccccg

SEQ ID NO: 158914 - DNA, 912 bp, Homo sapiens
  misc_feature: GYAE6OF01BOY48.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacactagtttccagccacctgtctttgtcctcaggagagccggccacccgtctccgtgcgacgggccaatgaagtagttattagcgtacttacgttacgccgttacggtacccaaagacggacggccgttacgggacccgtaagggtccctcccccgtaacgggtccttaccctacctagtttcggtaattcggaacgtttcggaccccgttttaaacccggaaaaaacgggggtcccctaaccggttcgggtaaccctaaccgtttaccccccggaacggtccccggttaaacgggttttccgaaacgggttcgggtaccgtaacgggggttcgggtaccggtaaggggtaaacggtaacggtaaccttttaccggacccttaccttaaccaaccctaacttacccgaaacgtaccggtacccgttaagaacggtcccgttaacggtaacggtactttccgttaggtacctttaaagttttaccgtttaaccgttggttaacccgtaggtacccgtaacgggttacccgtttaacggtaacgggttaccggtacccggtttacccgggtttaccggttttaccgggtacccgggtaaccggggggtaaccgtaacgggtacggtacgggaacgttaacgtaccggtaaaggtaaccggttaacgttcgggtacggttacccggtacggtaccctaaacccgtgtttacccggttacggtttaccctttaccggtaacctttccccggttaaccccg

SEQ ID NO: 158915 - DNA, 535 bp, Homo sapiens
  misc_feature: GYAE6OF01D263Y.22.9.A09.1.454.CMB.1.raw
  modified_base (254)..(254): a, c, t, g, unknown or other
  misc_feature (254)..(254): n is a, c, g, or t
  modified_base (379)..(379): a, c, t, g, unknown or other
  misc_feature (379)..(379): n is a, c, g, or t
tcagacatacgcgtcacgaccggtgctcgatttagcgagacgcgcaggggggaggaactgctcagttaggacccagagggaaccatggaagccccagctcagcttctcttcctcctgctactctggctcccagagaccaccgggagaagttgtgttgacacagtttccagccaccctgtctttgctccaggagagcgggccacccgtctcctgcagggccaatgagagtatagcactacttagcctggtaccanagaggcctggccaggctccaggctcctcatgtatgatgccttccgaaaaggggccactggcacgtcccagccaggttcaggtcgcaggtggtactaggaagagacttcactctcaccatacaacngacctagacgcctgacgattctgactagtttattactgtcagcagccgtacagtcgcctccgtactttcggccgtacggggaccagtacgtcggagtactcgagacgaacgtggtaggctgaccaccagtcctagttccttctcgttccgtacccg

SEQ ID NO: 158916 - DNA, 735 bp, Homo sapiens
  misc_feature: GYAE6OF01C7C7G.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagacgaccaccggagaagttgtgttgacactagtttccacgcccaccctgttctttgtctccgaggagaggcgggcccaccctctcctgcgacgggccaatgagagtattacgcgtactacgtacgccgtacggtaccacgaggacggcctgggaccacggcctacccgacggtcctcctactacttgtacgtgtaactcggtaccttaaccggaaaacggggtccctaccgtacgggcctaacgtccccgaacggtcccgtaacgggtttccgtacgggtcgggaccgtaaggggttcggggttaccgttaaggggaaaggtacgtaccgtttaccgactccttaccacctaaacgtaccaacgacgtaccgtacgacgtccgtacggtaacgtactttccgtgtacgttaacgttttacttacgttacgtcgtacgtaccgtacgtacccgtaacgtacggtccggtacccgttcggttaccgtttacgggaccgggtacgggaccgacggtacggtaggtacgacgtacgacgtaccggtaagtcggtggtcgtcgaccacgtacgttccgttactcccgtttactccgttccgttaccccg

SEQ ID NO: 158917 - DNA, 684 bp, Homo sapiens
  misc_feature: GYAE6OF01ANOTA.22.9.A09.1.454.CMB.1.raw
  modified_base (650)..(650): a, c, t, g, unknown or other
  misc_feature (650)..(650): n is a, c, g, or t
  modified_base (663)..(663): a, c, t, g, unknown or other
  misc_feature (663)..(663): n is a, c, g, or t
tcagacatacgcgtcacgaccggtgctcgatttagcgagacgcgcagggggagggaactgctcagttaggacccagagggaaccatggaagccccagctcagcttctcttcctcctgctactctggctcccagagaccaccggagaagttggtgttggcacagtttccagcccacccttgtccttttgtcctccgaggagacgccgggccaccctctcctgcagggccaatgagagtattagcgactacttacgcctggtaaccaacaggacggcctggccagggcctcccgaggcctccgtcacttgtaatgaactcgtaccttaaccgaaaaggccacgtggaccactccccgaagcccgtaaggttccagggtcgacgtaggttcggtacgtaggaaaggacgtcttaccgactctaccgacctactaccgaacgtacgccctaagaccgtccgtacgacgtacttccgtagtacgttaagtttacttacgtacgttacgtaacgtaccgtacgtaccgttaaccgtaacggtcgggtacccttcccggtaaccggttttcgggacccgggtaccggggtaccgaacggtcggttacggacggtacgtacgacgaccggtaacgtcggttcggacgtcgaccgtacncgttcgtacgttnttcctacgttcccgtaccccg

SEQ ID NO: 158918 - DNA, 823 bp, Homo sapiens
  misc_feature: GYAE6OF01EJWH6.22.9.A09.1.454.CMB.1.raw
  modified_base (331)..(331): a, c, t, g, unknown or other
  misc_feature (331)..(331): n is a, c, g, or t
tcagacatacgcgtcacgaccggtgctcgatttagcgagacgcgcagggggaggaactgctcagttaggacccagagggaaccatggaagcccccagctcagcttctcttcctcctgctactctggcctcccagacgaccgaccggagaagttgtgttgacactagtttccagccctaccctgttcttttgcctccgagggagacggccgggccccacccttcgtccgtggaccgaacgggacctaagtggagtagtagttacgctaactacttacgccgtacggtaaccaacgaggacggcctcggccgaggtcctcccgaggcctaccnctagtcgtatcgtatcgtaaccgttaaccggaaaccgggtcctaacgtcggacctaaccgtcccgagtaccgttaacgggtcgaagggtcggtaccgtaggggtttcggtaccgtaaggggtaaacgtacggtcccttaccgaccgttccaacccgttaaacgaacttaaccgaaaccgtaccgtaacccggttaaggaccgtacccgttacggtaacggttcttacgttacggtaacctttaacgttttaagttaccgtacgtaccgtaacggaccgtaaccgtacccggttaaccgtacccgggtaccgttacccccggtttacggttacccgggtttacggggaccccgggtaacggggtacccttaacggggtacctacggggtaacaaggtaaccggtaacggaaccggttaacgtcgggttacgccttacggaacctccggttaacgtttcgttaccgtacttccgtacccgttcccggtaacccc

SEQ ID NO: 158919 - DNA, 732 bp, Homo sapiens
  misc_feature: GYAE6OF01AHSHU.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacactagtttccagccacctgtctttgtctccaggagagccgggcccacccgtctccgtgccgacgggccaagtcgagtagtagttacgcgtactacgttagccgtaggtacccaagacgacggcctggcccaggccttcccgaggtcctcctcgatcgttaatcgagtcgccgttaaccgaaaacgggtcctaacgtcggacctacgtcccaacggtccgtacgggtttcaggttacgcgtaacgggtcggttacggtaagggaacggtacgttaccgttaccgtaccgttctaccctaacctatacccgaagtacgaccgtaggacgaccgtaggacgtagttcgtagtacgttacgtttacgttaccgtcgtacgtaacgccgtacggtaccgtaccgtaacggtccgtaccccgttaccggtacggttttaccgggaccgggtaccggggtaccgtacgttcggacggtaccgtacgtacgtaccggtaaccggtaacggttcggtacggacggtccgaccgtaccgtacgttaccgttacgttacgttcccttaccgttccccgttacccgg

SEQ ID NO: 158920 - DNA, 693 bp, Homo sapiens
  misc_feature: GYAE6OF01CQ68F.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagccgggccaccctctcctgcagggccaatgagagtattagcgtaactacttagcctggtaaccaacgaggaggcctagggaccagggcctacccgaggccctccgtcagtgtatgatgtaccttaaccgaaagggccagtggcactcccaagccgtaggttcaggttcggactggttcggcgtagggaagtacgtacttccgtaactcctaaccgaccaactaccgaaacgcgacccgttaaggaccgaccgttacggtaaccgtatttaccgtacgttacgttaacgttttaacttaccgttgtactacggacgtacgtaccggtaacgtaacggtccggtcccgttaccgttaccgtttacgggacccgggtaacggggtaccaacgggtccggtagggaacgtacgtaccgaacggtaacgtaacggttcgggcggtaccgtcgtaccgaacccttagttaccgttacgttaccttacctccgttccgttacccccg

SEQ ID NO: 158921 - DNA, 697 bp, Homo sapiens
  misc_feature: GYAE6OF01COG9L.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacactagtttccagccaccctgtctttgtctccaggagagccgggccaccctctcctgcgacgggccaatgagagtattagcgtactacttagcctaggtaaccagaggacggccgtcggccgacggcctcccgaggtcctcctcatgtatgatcgtccttaaccgaaaggcccaacgtcggaccacgtccccaggtccctacgggttacagggtcggacgtagggttcgggttacgtaggggaaacgtacgttaccttcacctccgtaacctacctataccgaacgacggtaccttaacggcgtacctaggaaccgtatttccgtgtacctttagtttacgttcgtacgtacaagtccgtacggtacctaaccgtaacggtccgtacccgttaccgttacggtttccggggacccggtacgggggtaccctaacgggtcgtacggggtaactacggtaccgaaacgggtaccggtaacggttcggacggtacctcggaccctacgtcgttactccgttactacctccgttccctaccccgg

SEQ ID NO: 158922 - DNA, 605 bp, Homo sapiens
  misc_feature: GYAE6OF01ECMDV.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggcctccaggctcctcatgtatgatgccttaccgaaaagggccaacgtcggcacgtcccagccgaggttcagtggctaggtgggtctagggaagagtacttcactctcaccataccaaacacgtacctagacgaccgtacggtacgtattacgtgtacttacgtttaattaccgttgtctagtcacgtaccgtaactacggtcgtccgttcccgttacgtttcgggacccggtacgggggtaccaaggtccgtagggacgtagtaccgaggaaccgacgtcggtggacgtcgacctaccgacgttcgttacgttctttacctcgttccgttaccccg

SEQ ID NO: 158923 - DNA, 709 bp, Homo sapiens
  misc_feature: GYAE6OF01AQXDP.22.9.A09.1.454.CMB.1.raw
  modified_base (254)..(254): a, c, t, g, unknown or other
  misc_feature (254)..(254): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccanagacggcctggccaggcctcccgaggcctcctcatgtatgatgtcttaccgaaaacgggccacgtggacactcccagccgaggttcaggtggaccgtaggggttcgggtacgtagggaaagtacggtacctttaccgaccgttctaccctaaccctagttacccaaacccgacgtacccgttaagaccggtacccgtacggtaaccgtactttaccgtcgtacttaacgttttaattaccgttgttaccgacgtcgaacggtccgttaaccggaagttccgggtacccttacggttaccgttttacggggacccgggtaacgggggtccctaacggtccggtacgggaacgttaacgtaccgaacggtaaccgtacggtcgggtacggtacgtcggacccgaccgttacgtttaccgttacgttacctttacctccgtttccccgttacccccgg

SEQ ID NO: 158924 - DNA, 622 bp, Homo sapiens
  misc_feature: GYAE6OF01CIN9H.22.9.A09.1.454.CMB.1.raw
  modified_base (259)..(259): a, c, t, g, unknown or other
  misc_feature (259)..(259): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagccgggccaccctctcctgcgagggccaatgagagtattagcgtactacttagcctaggtaccaanagaggcctggccaggcctccgaggcctcctcatgtatgatgcttaccgaaacgggccacgtggacactcccagacctaggttcagtggcgaggtggtcgtagggaagacgtactcactctacgaccatacaacagcctagacgtcgtacgacgtacttctgtacgtagtttacttacgtcgtacgtagcgtagaccgtacgtacggtcgtccgtccgtacgtttcgggaccggtacggggacccgtaacggtccgtagggaacgtacgtacgaacggtaacggtaacgttcgggtggtacggtaccgtaccgtaacccgtacgttccgttacgttaccttaccgtccgttcccgttacccccg

SEQ ID NO: 158925 - DNA, 592 bp, Homo sapiens
  misc_feature: GYAE6OF01AYTZX.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagccgggccaccctctcctgcagggccaatgagagtattagcgactacttagcctggtaccaacagaggcctggccaggcctcccaggctcctcatgtactgatgcttaccgaaaagggccacgtcggctactcccagcctaggttcaggtgcaggtggtcgtaggaagacgtactttcgacctctaccaccagtacaacgacgaccctagacgccgtagacgtacttcgtcgactagtttacttactcgtcacgctacggccgtaacaagtccgtacctccgtacgtttcggccggtacggggtaccacggtcgtacgggacgacgtacgaagaccggtaacgtcggtggacgtcgacccgactacgtccgttagttaccttctaccttccggtccccg

SEQ ID NO: 158926 - DNA, 883 bp, Homo sapiens
  misc_feature: GYAE6OF01D0XRZ.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacactagtttccagccacctgtctttgctcaggagagcggccaccctctcctgcgacgggccaagtgagagttattagcgtaacttacgttacgccgtacggtaaccaacgagacggccgtggaccgacggcctcccgaggtcctcctcattcgtatcgtagtcgtaccttaacggaaaacgggcctacgtcggacctacgttacccgaggtcccgtaaggtttccaagggtcggacgtacgggttcgggtcgttaggggaaacgtcggtacctttccgtaaccgttccgtaccctaaccgtaacgttaccgaaaaccgtacggtaacccgttaacgggaaccgtacccgttacggtaaccggttaacttttcccggaagtttaccgtttaaaggtttttacgttaacccgttcggttaaccgtaaacgttacgttaaacggtttaaacttttaaccgttttaccgggaccgggtttcccggttaaaccgggttacccgggttttacccgggaaaccgggttaaaccgggggttaacccggttaaacggggtttaccgggtaaaaccgtttaaacccggtaaaaaccggttaaccgggtttcgggtaaccggggttccgttaaccggaccccgttaaaccggttacgttttaccccgttaggtttacccctttacgtaaaccccgttttcccccgttaaccccggtcttaaacccggtttaacccggg

SEQ ID NO: 158927 - DNA, 538 bp, Homo sapiens
  misc_feature: GYAE6OF01BHWU6.22.9.A09.1.454.CMB.1.raw
  modified_base (347)..(347): a, c, t, g, unknown or other
  misc_feature (347)..(347): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctccaggctcctcatgtatgatgccttacaaaagggccactggcactccccagcccaggttcaggtggcaggtggtntggaagagacttcactctcgaccatacaacacgacctagacgcctgacgtattctgacctagtttacttaccgtcagtcagtcgtaccagtcggtccctcgtcgtttcggccgtacggggccacgcgtggacgatcgacgtacgacgtgtggctggccactatccgtgttccttcgtctccgtcccgtacc

SEQ ID NO: 158928 - DNA, 726 bp, Homo sapiens
  misc_feature: GYAE6OF01B66JF.22.9.A09.1.454.CMB.1.raw
  modified_base (712)..(712): a, c, t, g, unknown or other
  misc_feature (712)..(712): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacactagtttccagccaccctgttctttgtctccgaggagacgccgggcctacccgtctccgtgccgagggaccaatgagagtagttagctactacttacgcctaggtaccaacgagacggtcctggccgaacggccctacccgaggtccctccgtactagtagtatagacgtcgtacccgttaaccggaaaacggggtccctaacggtcggacctaccgtaccccgacgtacccgttaacgggttaccacggttacgggacgtaacggggtttcgggtacgtaagggtaaacggaacggttacctttacccgaacgtttaccgtaacccgtaaccctacgtaaaccgtaaacgacgtacccgtaagccgtaccgtacggtacgtacttcgtacgtacttaaggtttacttagtcgtctaacgtcgtacgtaccgtacgtacggtcgtaccgtccgtttaccggttcggaccggtaacggggtacacggtcgtaggtactacgacgacgtaacgtacgtcgtacgacgtcgacctaccttcgtcgtcgttacttccncgttcccgtacccg

SEQ ID NO: 158929 - DNA, 695 bp, Homo sapiens
  misc_feature: GYAE6OF01CEWHF.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccacctgtctttgtctccaggagagcgggccaccctctcctgcgagggccaatgagagtattagcgactacttagcctggtaccacagaggcctggccaggcctcccaggcttcctcatgtatgatgctaccaaaagggccacgtggcatcccagcctaggttcgagtggacgtggtagggtctaggaaggtacgtacgtttacacctacgttacccaaccgacttaccaaacgtacgacccgttaaggacgtaccgttacggaccgttaacttccgttagtacctttaaggttttaaactttaccgttagttacctacggtaccgtaacgggtacccggttaaccgtaaacggttaccgggtaccccttccgggttaaccgtttttccgggacccgggtacgggggtacccgtaacggtacggtacgggtaacggaacgtacgaacggtaaccgtaacgtcggttaggtacgtcgacccgaccgtacgttacgttcggttactttccgtccgttacccgttccccg

SEQ ID NO: 158930 - DNA, 795 bp, Homo sapiens
  misc_feature: GYAE6OF01EIRSI.22.9.A09.1.454.CMB.1.raw
  modified_base (200)..(200): a, c, t, g, unknown or other
  misc_feature (200)..(200): n is a, c, g, or t
tcagacatacgcgtcacgaccggtgctcgatttagcgagacgcgcagggggaggaactgctcagttaggacccagacggaaccatggaagccccagcgcagcttctcttcctcctgctactctggctcccaggtgccagtgcagaagtagtgatgacgcagtctccaggcaccctgtctgtgtctaccggaaggggaaancgcccaccctctcctgccgacgggccagtcagtaagtattaacgactaaactaaacgttacggccgttacggtaaccaggacaggaacgacccgtacgggcccgacggtcctaccccggtacggtcccttaccccttacctacttacgtttaacgttcggtttcgacctaccgtaccgaacggtaccgggacccgggtaccctaccgggttaaccccggccaaaccccggttcggaacccgtttagggtccaaggggttcgggtaacgttacgggggtcggttacggaaggggttacctaacgggttaccttaccgtaacccttacgtaccctaacggtactaaccggaacgttccgacgtacccgtagtacgttaaggtccttaaaagggttctttaaggtttactaacgttttagttactacgttgtaactacgtagttaaacttacgttacggttcgaccgggttaccgttacgggtaccggtaaccggtaacgggtaacggaacgtaaggtaaaccggtaacgtaacggtaacggtacgttcgggaacgttccgaacggttacaaccgtttcgtttcccgtagtttacccg

SEQ ID NO: 158931 - DNA, 702 bp, Homo sapiens
  misc_feature: GYAE6OF01AMI7A.22.9.A09.1.454.CMB.1.raw
  modified_base (192)..(192): a, c, t, g, unknown or other
  misc_feature (192)..(192): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacactagtttccagccaccctgtctttgtctccaggngagcggccaccctctcctgcagggccaatgagagtattagcgactacttagcctggtaccaacagaggcctggccctaggcctcccgaggtcctccgtcagtcgtatgatcgtccttaccgaaaacgggccacgtggccaactccccagcccgtaggttcgaggtggcgacgggttgggtccgtagggtaaaggacggtacctttacgacctccgtacccaaccctaacgtacccgaaactacggtacccctaaggaccggtacccgttaggaaccgtaactttccgtagtaccgttaaggttttaacttaccgttacgttacgcgtaaccgtacggtacccgttaaccgaaggttccggacccgttcccggttaacgttttcgggacccggtacggggtacccaagggtccgtaggacgtacgtacgacggtaaccgtaccgttagggtcggtactccgaccgtacccgtattcccgttcgtacctttcgtccgttcccggttaccccg

SEQ ID NO: 158932 - DNA, 766 bp, Homo sapiens
  misc_feature: GYAE6OF01BJQ6P.22.9.A09.1.454.CMB.1.raw
tcagacatacgcgtcacgaccggtgctcgatttagcgagacgcgcagggggaggaactgctcagttaggacccagagggaaccatggaagcccccagctcagcttctcttcctcctgctactctggctcccagagaccaccggagaagttgtgttgacactagtttccagccaccctgtctttgtctccaggagagcgggccaccctctcctgcagggccaagtgagagtattagcgactacttagcctggtaccaacgagaggcctggccaggcctcccaggtcctcctcatcgtatgactcgtaccttaaccgaaaacgggccctaacgtcggacacctaccccgacgcctaacggttcgaggtggcgtagggtgggtactagggaagacgtaccttacacctcctaccgacctaagtaccaaaccgacggtacccgtaaggacggtacccttacggaaccgttacgtttaccgtacgttacgttaacgtttttaacgttaaccgttacgttacgtaaccgtacggtacgtacccgttaaccgtaacggttccgggtaccccgtttaccggttaccggttttaccgggacccggggttaacggggggaccctaacgggttaccggtagggtaaccgtacgttaaccggaaagggtaacccggtaacggttcgggttaccgggtaccggtcggtaccctacccgttaaacgttccgttacccgtttacccgtttaccgttaacccgttccccggtttaccccccg

SEQ ID NO: 158933 - DNA, 847 bp, Homo sapiens
  misc_feature: GYAE6OF01BU1C7.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccacggagaagttgtgttgacacagtttccagccaccctgtctttcgctccaggagaggccgggccaccctctcctgccgacgggccaagtcgagacgttattagacgaacttacttacgccgttggtaacccaacgaggaccggccgtggacccgaacggtccctacccgaacggtccttcccgtacctaggtacttagttacggacttaggtaccgttaacccggaaaaacggggtcctaacgttaccgggacctaacgtacccccggaacgtaccggtaacgggtttcaacgggttcggacccgttaaggggtcgggttacgtaagggaaacggtacgtaaccgtttaccgaaccgttaccgtaaccctaccgtaactaacgtaaaccgtaacggtaacccgttaacggaacgtcccgttaaccggacggttaactttaccggttacggtaaccgtttaaacgttttaacgttttaacgtacgttactaacgggtaaccgtaacgggtaccgtttaaccgtaacggttccggtacccggttaccggttaaccgttttaccgggaccgggtaacggggaccctaacgggacgttacgggtaacgtacgttacgaaacggtaaccggtaacggttacggtaggtaccgtacgtacccgtacgttaccgttaccgtacgtttacccttcgtaaccgttcccgttacccccgg

SEQ ID NO: 158934 - DNA, 776 bp, Homo sapiens
  misc_feature: GYAE6OF01AW6V5.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcaggccaatgagagtatagcgactacttagcctggtaccaacagaggcctggccgaggcctcccgaggcctcctcatgtatgatgcttaccaaaacgggtccacgtggacactcccagccaggttcaggttcggcaggttcgggtctagggaaagtacggtactttccgacttccgtaccacccaagttacccaaaccgtacggtacccgttaacggacgtaccccgtaggtaaccgttaacttaccggttacggttaccgttaaaggtttttaaccgtttaaccgtttacggttacccgttaacggaccgtaacgtacccggttaaacccgtaaacgggttccgggtaccccgttacccgggttaccgtttttaccggggaacccgggttaacggggggtacccgtaaacgggttccggtaggggtaacgtaaccgtacgaaacccggtaaacgggtaaccgtttagggtccgggttacccggtacggtacccgtaacccgttaaacgttcccgttaaccggtttaccccctttacgtacccgtttccccgtttaaccccccgg

SEQ ID NO: 158935 - DNA, 585 bp, Homo sapiens
  misc_feature: GYAE6OF01BJIYP.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaaatgagagtattagcgactacttagcctggtaaccaacagagcctggccaggcctcccaggctcctcatgatgatgcttacaaaagggccagtggcatcccagccaggttcagtggcagtggtctggaagagacttcacgtctacacatacgaacagacctagacgcctagaacgtattcgtgtactaagtttacttactgtacaagcaggtaccgtaactaaggtccggtaccgtcccgtacgttttcggaccgtacggggaccaagcgtagggacgtagtacgagaacggtaacgtggtagggacgttcgaccgtaacctacgttcttacggttaccctttctaaccgttcccgttacccccgg

SEQ ID NO: 158936 - DNA, 856 bp, Homo sapiens
  misc_feature: GYAE6OF01A2RK5.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacactagtttccagcctacccttgtctttcgtcctccaggagagccgggccacccttctcctgcgagggaccaagtgagtagtattagcgtacttacgttacgcctaggtaaccaagaggacggtcctgggcccagggtccctacccgaggtccttcccgtatacgttggttactaggtaacgttcgtacccgtttaaaccgaaaaacggggtcccctaacggttcggacctaaccgttcccccggaagtacccgttaacgggttaccgtacgggttacgggtaccggttaaggggttccggggttaaccgttaagggggaaacggtaaccgttaccgttttaacccggtaacctttcccgtaaaccctaacccggtaaactttaccgaaaaccggttacccggtacccgtttaacggaccgtaacccggttacggtaaccgttaccgtttacggtacgttacggtttaacgttttaacttacgttacgtaccgtagtaccgtaacgtaccgtaaccgtaagtcccggtaccgtttccggttaacgtttcccgggaccgggtacggggtacctaacggtcggtacggacgtaacggtacgtacggtaaccgtaacgggttcggtacggaccgttaccgtaccgtaacccgtacgtttccggttacgtttacccgttcctaacccgtttccccgtaccccgg

SEQ ID NO: 158937 - DNA, 711 bp, Homo sapiens
  misc_feature: GYAE6OF01DUX5R.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacactagtttccagccaccctgtctttgtctccaggagagccgggccaccctctcctgcagggccaatgagagtattagcgactacttagcctggtaccacagagcctggccacggcctcccgaggcctcctcatgtatgatgtcttaccgaaacgggccacgtcggacactcccagtccaggttcagtcggctaggtgggtcgtaggaagcgtacttacactctaccacctactaccaaccgacgtaccgtaagacgtcccgtacgtaaccgtactttctgtacttaacgttttaactttacgttcgttctaacggtacgtaaccgtaccggttaacccgtaaggttcccggtacccgttacccggttaccggtttttccgggaccccggggtaccgggggtaacccgaacgggtacgttacggggacggtaacgttaacggtaaccggtaaacccggtaacggttcggttaccggtaccgtcggacccgtaacccgttacgtttacccggttacgtttaccctttacccgttaccgttccccgtttacccccgg

SEQ ID NO: 158938 - DNA, 796 bp, Homo sapiens
  misc_feature: GYAE6OF01CBC1Q.22.9.A09.1.454.CMB.1.raw
tcagacatacgcgtcacgaccggtgctcgatttagcgagacgcgcagggggaggaactgctcagttaggacccagaggaaccatggaagcccagctcagcttctcttcctcctgctactcgtggcctccagacgaccaccggagtaagttgtggttcgactacgtacgtttaccacgccctaccgttgttctttcgtctaccgaggagacggccggccctaccctctccgtgccgacggtaccagtcggaagtagttagttacgcgtaactacgttacgccgttacggaacctaacgacggacggtccgtcgggaccacgggcccttacccgagggtcccttccgtacagttcgttagtacgagttccgtaccgtttaacccgaaaacgggtcccacggtacggaccacgtaccccaggtcccgttagttccgaggtacgcggtaggttcggtgtaaggtaacgtacttaccgtttacaccgttacaccctaacctaagtccaaaacgtcccgggtaacttaacggacgttacccggtagtaaccgtttcgttcggtaaccgttacgtttaaggttttacttacggtacgtacgactaacggtacgtaccgtaaacgtcggtaccgttacccgtttacgtttacgggttcccgggaccgggagggtacccacgggttacgtcggaatacccggtaggaacccgtaccggtacggttcggtaacgcccgttaacggcccttaccgtttacgttccggttactttacccgtcccgttacccgtttacccggttacccc

SEQ ID NO: 158939 - DNA, 1010 bp, Homo sapiens
  misc_feature: GYAE6OF01EVM2Y.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacactagtttccagcccaccctgttctttgtcctccgaggagagccgggcccaccctctcctgcgacgggaccaatgagtagtattagacgtacttacgttacgccgtaggtaaccaacgaggacggcccgtcggacccgaacggccctccccgacggtcccttccgtactagttacggtatgtacttcggtacccgtttaaacccggaaaaacggggtcccctaacggtaccgggaccctaacccgtacccccgtaacggtaccccggttaacgggtttaccgaacgggttacgggtaccggtaagggggtttacggggttaaccggtaaagggggtaaacggtaaccggttaacccgtttaacccgtaaccgtttacccttaacccgtaaaaccccgttaacctaacccgtaaaacccggtacccgttaacccgtaaaccgggtacccggtaaccccgtttaacggtaaccggtttaaccgttttacccgttacggttaaccggttttaaaccgttttttaaccgttaaccggtttacggttaaccgtaaaccggttaacccttaaaacgtttaaaacgtttaaaccgtttaacccgggttaccccgggttaacccccggttttaacccggtttaacccggttttaaccgggtttttacccggggtaacccggggtaaaccggggttaacccgtaaacgggttaccggttaacggggaaaccgtaaaccgggtttaaacccgaaaaccgggtttaacccggttggggtacccggtaccttaccgggtacccctaaccgttaccgttccggttactttacccgtttccgttaacccgttccccgttaacccccg

SEQ ID NO: 158940 - DNA, 804 bp, Homo sapiens
  misc_feature: GYAE6OF01B4TZ0.22.9.A09.1.454.CMB.1.raw
  modified_base (219)..(219): a, c, t, g, unknown or other
  misc_feature (219)..(219): n is a, c, g, or t
tcagacatacgcgtcacgaccggtgctcgatttagcgagacgcgcagggggaggaactgctcagttaggacccagagggaaccatggaacgccccagctcagcttcctcttcctcctgctactctgctcccagacgaccgacggagtaagttgtgttagacactagttccacgccctaccttgtctttgtctccgaggagacgcggcctaccgtctccngcgaggaccagtgaagtagtagtagactactacttagccgtaggtaaccaagaggacgccgtacggaccgaggtccctccgacggtcctcctacgtattaggtacgtagtactcggtacccgttaacgaaaacgggtcctacgtacggacctacgtacccgacggtacggtacggttacgaacggttcggacgttaggggtcggtacggaagggtaacgtaacgttacgtaccacgttcctaacacctactaacgaaccgacgtaccgtagaccgtccgtagtacgttagttaccgtaggtactttaaggtttacttaacgttagtacgtaccggacgtacgaacggttaaccacgggtccgtaccctttaccggttaaccggggtttcggaacccggggtaaccggggtaccgtaagggtaccgtaccgggtaaagtccggtaaaccggttaaccggaccgggttacgggttaacgggtaccggggttaacccgtacccggtaaaccccggttacttaccggttacccggttacgtttttaacccggtacccctttacccggggtttaccccccttaccccggg

SEQ ID NO: 158941 - DNA, 984 bp, Homo sapiens
  misc_feature: GYAE6OF01CTUW1.22.9.A09.1.454.CMB.1.raw
  modified_base (227)..(227): a, c, t, g, unknown or other
  misc_feature (227)..(227): n is a, c, g, or t
tcagacatacgcgtcacgaccggtgctcgatttagcgagacgcgcagggggaggaactgctcagttaggacccagagggaaccatggaacgccccagctcagcttctcttcctcctgctactctggcctcccagacgaccgaccggagtaagttgtgttgacacgtacgtttccacgccctacccgttgttctttcgtcctccgaggagacggccggcctaccctcncctgcgacggaccagtgagtagtagttacgacgtactacgttacgccgtacggtaaccaacgaggtacggccgtaggccgacggtcctacccgacggtccctccctacgtagttcggttacgtacggtaacgttaccggtaacccgtttaaaaccggaaaaacccggggtcccgttaacccggttacgggaaccctaaccctaccccggtaacgtaacccgggtacgggttttaaccgaaacggggttccgggtaaccggttacgggggtttaccggggtaacgggtttaaacggggaaacggtaaccggttacccggttaacctacccggttaccctaacccgtaaaccctaaccgttaaacgaaacccgtaacggttaccgaaaccgggttccggaaccttacggaacccgtttatttacccgaaggtttaacccgtttaagttttaacgttacccgttaacgttaccggtaacggaccgttaaccgggttaaccggtaaccggttaacgggttaccccgggttaccccggtttacccggtttacgggtttcccgggaaaccccgggggtaccggggtaaccacgggttaaccggagggtaaccggtacgtaaaccgggtacccggggtaaacgtttaaccggggtgggttaccccggtgttaaccccggtaaccccgggttaacccttacgttttccccgggttacttttacccgtacccccgttttaaaccggtcccccgtttaaccccccgg

SEQ ID NO: 158942 - DNA, 691 bp, Homo sapiens
  misc_feature: GYAE6OF01BDTGJ.22.9.A09.1.454.CMB.1.raw
  modified_base (250)..(250): a, c, t, g, unknown or other
  misc_feature (250)..(250): n is a, c, g, or t
  modified_base (307)..(307): a, c, t, g, unknown or other
  misc_feature (307)..(307): n is a, c, g, or t
  modified_base (391)..(391): a, c, t, g, unknown or other
  misc_feature (391)..(391): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtatagcgactactgcctgaccaangagcctgccaggctccaggctcctcatgtatgatgacttcgaaaagggccatggacnctacccgagcacggtttcaagtcggacagggtgggtcgtagggaagagtacgttcaactcgtaccaaccgacttaacccaaaanacggtacccgttaaacgacggtaccgttacgaaccgtaattccgttacgtacgtaagttttacgttaaccttagtaccaagacctaacggtacgtaaacccgtaacgttcgggtcccttaacccggttaccgttttaccgggcccgggtaaccgggggacctaacgggtccgtacgggacggtattaaccgaaacggtaaccggtaaaccggttcggtaggggtacccgtacggtacccgaaccccttaagttcccgttacgttaccgtttcgtaaaccgttccccgttaacccccccgg

SEQ ID NO: 158943 - DNA, 684 bp, Homo sapiens
  misc_feature: GYAE6OF01C6M82.22.9.A09.1.454.CMB.1.raw
  modified_base (205)..(205): a, c, t, g, unknown or other
  misc_feature (205)..(205): n is a, c, g, or t
  modified_base (209)..(209): a, c, t, g, unknown or other
  misc_feature (209)..(209): n is a, c, g, or t
  modified_base (290)..(290): a, c, t, g, unknown or other
  misc_feature (290)..(290): n is a, c, g, or t
tcagacatacgcgtcacgaccggtgctcgatttagcgagacgcgcgagggggaggaactgctcagttaggacccagagggaaccatggaagccccagctcagcttctcttcctcctgctactctggctcccagagaccaccgggagaagttgtgttgaccactagtttccagccaccctgtcttgctcaggagagcggccacctntccngcaggccaagtgacgtagtacttagcgtactacttagcccttaggaccaacgagaggcctgccaggctcccgaggctcctnatgtatgatcggcttacgaaaggccagtggactactccgagtccctaagggttccaggtcggcgaacggttcgggtacctaggggaaacaggtaccttcgacctcgttacccaccgtatacccgaacacggtccctaagacgaccgtagtaacgtacttcgtacgtccgttaacggttttaacttacgtcggttacctacggtaccgacgtacccggtaaaccgtaacggttaccgggtacccgttaccggtaaccggttttaccgggaccggtacggggtacccgaacggtacccgttagggacgtaacgtacgacggaacgtaacggttacgtcggtacgtcggacctacgtacgtacgttacgttaccttacgtaccgttcccgtaccccg

SEQ ID NO: 158944 - DNA, 740 bp, Homo sapiens
  misc_feature: GYAE6OF01A5PKX.22.9.A09.1.454.CMB.1.raw
  modified_base (199)..(199): a, c, t, g, unknown or other
  misc_feature (199)..(199): n is a, c, g, or t
tcagacatacgcgtcacgaccggtgctcgatttagcgagacgcgcagggggaggaactgctcagttaggacccagagggaaccatggaagcccccagctcagcttctcttcctcctgctactctggctcccagatattactggagtacgttgtcttgacgcagtctccaggcaccctgtcgctgtcctccaggggaaancgccaccctctcgtgtaaggccagtcagatgtaacaacagatatgtagcctaggtatcagcagacgaccgtggccagttcctcccgttcctccgttcgttctttgggtcgccggccgacgacgggccacggggcacgtcccgtgacagatttccgaggtcggctagggttcggggtcccgggtcaaggtaccttattccgtacggcccttaccgaacccgtaggttccgggtccgggttacgtaccggggtaaaccctgggtaaacgtcgtttccgtacgtacctaaatttacgttaactttaccgttgttaccgtacgtttaccgttttaagtttacgttttaattccccgttaacccgtttcccggttaccgtttaaccgttacgttttacccggtttaccggggaccggtaaccgggggtacccaaaggttccgtaagggtaacgtaacgtaacccgtaaaacggttaccggtacggttccggtaccgtacgaccctaaccgttacgtttccgttaccgtttcgttaccgttaccccg

SEQ ID NO: 158945 - DNA, 1117 bp, Homo sapiens
  misc_feature: GYAE6OF01BPLOZ.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggcctcccagacgaccaccggagaagttgtgttgaccacagtttccacgccaccctgtctttgtcctccaggagacgccgggccctacccctcctccgtgccgacggaccaagtggagtagttattacgacgtaccttacgttacgccgttacggtaaccaaacgacggacggcccgtacgggacccgaaccgggccctaccccgacgggtcccttccgtaccgtagttacgttaacttggtaacgttccggtaacccgtttaaacccggaaaaacggggtccccgtaacgttacgggaccctaacccgttacccccgaagggtacccccgttaagggtttaccgaggggtttaccgggtaccggttaacgggggtttcggggttacggttaaacggggaaacgggtaccggttaccttttacccggtaaaccctttccccgttaaccccgtaacccttaaaacctaaaccccggtaaaacccgttcccgggttaaccccgttacgggttaacccgttaaacggtttaaccggttaaacgggttttaaacggtttttaacgttttttaccggtaaaccggtttttaacgtttttaaacgtttacccggttaccgtttaaccgtaacttaaccccgtttaaaactttaaacgtttaaacccggttttaaccggaccccgttttaaccccccggttttaaacccggtttaacccgggttttttaaccgggggtttttaaccccggggaaaccccgggggtttaaaccggggggaaaaccccgttacggggtttaaacccgggtttaacggggaaaaccggtttaaacccccttaaaaacggggttaaaaccccgggtttacggtcgggggtttaaccccgttaaccggtaacccggttaacccccggttaaacccgggttaaacttttcccgggtttacccgtttttaacccgttccccggttttaaaacccccgttttccccccggttaaccccc

SEQ ID NO: 158946 - DNA, 881 bp, Homo sapiens
  misc_feature: GYAE6OF01EM7Z7.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggcctcccagacgaccaccggagtaacgttgtgttgaactactaggtttccagtccctacccgtgttcttttcggtccttccgaagggacgaggcccgggcccacccttcgttcccgtggaccgacgggaccctaaagtggaacggtaggttacttacgaccgtaacttaacgtttacgcccttagggtaaaccaaacgtaggacgggtcccgtacggacccgtaacgggtccctaccccggtacgggtcccttaccgttcgtaacgttggttaacgtacggtacgttacggtaacccgttttaacccggaaaaaaccgggggtcccctaaccggtttacggggacccttaaccgtaccccgtacggtaaccccggttagggtttaaccgaacgggtttcgggacccgtagggggtttacgggtaccgttagggggaaaccgtaacggtacctttaaccgtaccgttaccgtacccgtaaaccccttaacgaaccgtaaacgtaccgtaacccgtaacggtacccgtaccccgttaggaaccgttacgtttcgtacccggtaacgtttaacggttttacttaacgttcgtaatacggtaccgtaacggtaccgtaacgtaaccggttcggtaccctacggttaccggtttcggaccgggtacgggaccgtaggtcggtaggacgttaggtactacggacgtacgttcggtacgtctcgacctacgacgttcgtagttccctactccgttccctacccg

SEQ ID NO: 158947 - DNA, 701 bp, Homo sapiens
  misc_feature: GYAE6OF01A21IX.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagccgggccaccctctcctgcgagggccaagtggagtagtattagcgtacttacgttacgcctaggtaccaacgagacggcctgggccagggcctacccgaggtcctcctctatcgtatgatcgacttaccgaaaagggtccacgtggctactcccgagcctaggttcgaggtggacgtaggtgggtacctaggggaactacgtacttcgtactcgtaccaacactaccaaacgtacggtacctaacggacgtccgtaggtaaccgttactttccgtacgtaccgttaacgttttacgtttaacgttacgtaccgtacgaccgtaacggtaccgtaaccgtacggtaccgttccgtacccggttacggttttccgggaccgggtacggggtaccgtaaacgggtcgtaacgggacgtaacgtacgaacggtaacgtaacggtcggtacgggacgtccgaccgtaacctacgttccgttacgttaccttcttaccgttccctacccccgg

SEQ ID NO: 158948 - DNA, 718 bp, Homo sapiens
  misc_feature: GYAE6OF01BHESN.22.9.A09.1.454.CMB.1.raw
tcagacatacgcgtcacgaccggtgctcgatttagcgagacgcgcaggggggaggaactgctcagttaggacccagagggaaccatggaagccccagctcagcttctcttcctcctgcttactctggctcccagagaccaccggagaagttgtgttgacactagtttccagccaccctgttctttgtcctccgaggagacggccgggccctaccctctccgtgccgacgggaccaagtgaacgtagttaattacgacgtaacttacttacgccgtaggtaaccacgagacggcctggccaggcctacccaggtcctccgtactagtacgtagtcgatcgtaccgttaaccggaaaaacgggccctacgtggacctacgtacccgagtaccgtaggttccgaaggtcggacgtaggtcggtagtagggaaagtacgtaccttcgacctcaccgtacataaccgaacacggtcctaagacgccgtagtaacgtattcgtagtacttaagtttactactagtacgacgtacgtaacgtacgtaacgtaacggtccggtaccgttaccggtttaacgtttaccgggacccggggtaacgggtaccgtaaggtaccggtaggtaacgaaccgtacggaaacggtaacgtacggttggtacggtaccgtacgaaccgtacgtacgttcgttacgtacctttaacctaccgttcccgttaacccg

SEQ ID NO: 158949 - DNA, 556 bp, Homo sapiens
  misc_feature: GYAE6OF01EV9J8.22.9.A09.1.454.CMB.1.raw
  modified_base (377)..(377): a, c, t, g, unknown or other
  misc_feature (377)..(377): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgccttccgaaaagggccacgtggcactcccagccaggttcagtgcagtggtctaggaagagtactcactctacaccatacaacngacctagacgcctgacgtacttcgtgctagtttatactgtcagtcagtccgtaacgtagtcgtcctccggtactttcgggacccggtacgggggaccaaggtcgtagggacgtacgtacgaggaaccgtacgtggtggcctgacctaccacttcgttcgtcttctcgttccgtaccccg

SEQ ID NO: 158950 - DNA, 662 bp, Homo sapiens
  misc_feature: GYAE6OF01ENG42.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacactagtttccagccaccctgttctttgtctccaggagagccggccaccctctcctgcgagggccaatgagagtattagcgactacttacgcctggtaccaacaggacggcctggaccacggtcctccccgaggtcctccctcagttcgttatgtatcgtaccgttaaccgaaaaacgggcccacgtggacccacgtccccgagcccgtaggttacaggtcggacgtaggttcgggtcgtagggaaagacgtactttcacttcctacaacctataccaaacgacgacctagaccgtctcggaacgtacttcgtagtacttaagtttacttacgtcgtacgagtacgtacggtaaccgtacgtaacggtccgtcccgttaccggttacgtttccgggaccgggtacggggacctaacgggtcgtagggacacgtacgtagaaccgtagtcggtaggcctacggaccctactaccgttcgtcttcctcttacccgtccttaacccccg

SEQ ID NO: 158951 - DNA, 782 bp, Homo sapiens
  misc_feature: GYAE6OF01B3LI7.22.9.A09.1.454.CMB.1.raw
  modified_base (195)..(195): a, c, t, g, unknown or other
  misc_feature (195)..(195): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacactagtttccagcccacctgttctttgtctccaggagngcgggccaccctctcctgcgagggaccaagtgagagtattagcgaacttacgttacgcctaggtaaccaagagacggcctggccacggcctcccgaggcctaccctctatgtatcgtagtcgtaccgttaaccggaaaacgggtccacgtacggacctacctcccgacgtccgtaggttcgacggtcggacgtaggggttcgggtacgtagggaacgtacgtacctttcgacttccgtacaaccctataccaacgtacgtaccgtaaggtacgtaccgtagtaaccgttagttccgtagtacgtttaacgttttacgttaacgttacgtacgtacggtaccgtaacggtaccggtaacgtaacggttccgggttacccgttacccgggtttaaccgggttttaccggggacccggggttaaccgggggtacccgtaaacgggtccggtaacgggtaacgtaccggtaccgtaacgggtaaacccggtaaccgttacggggttaccgggacggtaccgtacccgtaacctttacgttacccggttacgtttacccgttaaccccgttacgtttcccccgttaccccgg

SEQ ID NO: 158952 - DNA, 779 bp, Homo sapiens
  misc_feature: GYAE6OF01BC1YN.22.9.A09.1.454.CMB.1.raw
  modified_base (726)..(726): a, c, t, g, unknown or other
  misc_feature (726)..(726): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacactagtttccagccaccctgttctttgtctccgaggagacggccgggcccaccctctccgtgcgacgggccaagtgaagtagttagttagacgtacttacttacgccgttacggtaaccaaacgaggacggcctcggccacgggcctacccgacggtcctcctctagttcgttagtgaacttcgtccgttaaccggaaaacggggtccctaacgtcggacctacgtaccccgaacggtacccgtacgggttaccgtacgggtacggtaccggaggggtttcgggtaccggttagggtaaaggaacggttaccctttaccgtaccgttacctacccaaaccctataaccaaacgacgtacccgtaaggacgtccgtacgaccgttacttcgttaccgtaacgtttaacgttttaactttaccgtagttaccgtacggcctaaccggtaccgttaaccggtaacggttcccggaccgttaccggttacggttttccgggaccgggtaccggggtaccgtaacggtccgtaggtacgacgtacgaacggaacgttaacgggttggacccggngtcccggactacccgtacttcggttcttacctttcgtacctttcccgtacccg

SEQ ID NO: 158953 - DNA, 713 bp, Homo sapiens
  misc_feature: GYAE6OF01APGJ4.22.9.A09.1.454.CMB.1.raw
  modified_base (189)..(189): a, c, t, g, unknown or other
  misc_feature (189)..(189): n is a, c, g, or t
  modified_base (651)..(651): a, c, t, g, unknown or other
  misc_feature (651)..(651): n is a, c, g, or t
tcagacatacgcgtcacgaccggtgctcgatttagcgagacgcgcagggggaggaactgctcagttaggacccagagggaccatggaagccccagctcagcttctcttcctcctgctactctggctcccagagaccaccggagagttgtgttgaccacagtttccagccacctgtctttgtctccaggngagccggccaccctctccgtgcgacgggaccaagtggaacgtagttagttagcgtactacttacgcctaggtaccaacaggacgccgtggccgacgggcctccccgaggtccttccgtcatgtatgatgtacctaaccgaaacggccctagtggaccactccgacgcgtacgggttacaggtcggctagggtcggtcgtaacgggaagtacggttactacctacgttctaccaaaccgtaataaaccgtacggacctaggtaccgtcccgtagtaaccggtacgtttcgtacgtaccgtttaatttaccgttacgtacgtactccggtacaccgttaccgtaacgtaccggttcggtacccgttcccggttttacggttacccgggaccggggtacgggtaccctaacgggcgtacgggtactaccgtaccggaacggtaccgttaacggcggtcggttacncggtactacccgtagtttacggttcttaccccgtaccgttacctttccccggtacccctacg

SEQ ID NO: 158954 - DNA, 718 bp, Homo sapiens
  misc_feature: GYAE6OF01AQLQ2.22.9.A09.1.454.CMB.1.raw
  modified_base (285)..(285): a, c, t, g, unknown or other
  misc_feature (285)..(285): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagccgggccaccctcctcctgcagggccaatgagagtattagcgactacttagcctggtaccaagagaggcctggccagctcccaggcctccncatgtatgatcgtcttaccgaaaacggccacgtggacactcccgacgcctaggtcagtggcaggtgggtcgtagggaacgagtacttcacgtccactaacctaactaccgaaacgtcgtacccgtaaggacgtacccgtacggaccgttacgttacgtcgtacgttacggttttaaacttttaccgttacggttaccgtaacgtaccgtacgtaacccggttaacccgtaacggtttacgggttaccccgtttaccccgggttaacgttttacccgggtaccccggggtaaccgggggccgtaaacgggtcccgtaggggaacgtacgtaccggaaacgggtaccgtaacggttacggtcggtaccgtacggtacccgtaaccctagttacccgttacgtttacccgtttcgtaacccgtttccgtacccccg

SEQ ID NO: 158955 - DNA, 890 bp, Homo sapiens
  misc_feature: GYAE6OF01COQ5D.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgttctttgtctccgaggagacgccgggccaccctctcctgcgagggccaagtgagtagttattagcgtaactacttacgccttacggtaaccaacgaacgtaaaccgtgggacccaggtcccttacccgaaggtcctaccctacacttccttaatgatcgactacttacttacgacgggtcccacgtcggactactacccgacgtaccgtaggttacacggtcggacgtagggttcggggtacgtcgggggaacctacggtaccctttaccgacccgtttacccaccgtaaaccccgtacgttacccgaaaccggtaccgaaccggttaaccccgttaacgggaacccgttacccgtttaaagggtaaacggttttaacgttttttacggaaccgttttaaaggttttttaaccgtttaaccgttcggtttaaaccgaaccggttaccggtaacgggttaccgttaaccggtaacccccgttaaccccgttttcccccggtaaacggttaccccggggtttacccgggggtaacccgggggaaacccgggggttaaacccggtaagggggttacgggtaaaaccggtaaccgtaaacccggtaaaaacgggtaaccggttacgggtaccggttacccggtaacggtaccccgtaacgttaccgttccgttacgttacccgtttacctacccgttccccgttacccccggtaaccg

SEQ ID NO: 158956 - DNA, 808 bp, Homo sapiens
  misc_feature: GYAE6OF01EOINU.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagacgaccaccggagaagttgtgttgacactagtttccagccctaccctgttctttgtcctccgaggagacggccgggcccacccttctccgtcgcgagggccaagtgagtagtattacgcgtacttacttacgccgtacggtaaccaacgaggacggcccgtaggaccgtacggccctacccgacggtcccttcccgtacgtacgttgtactggtacgttacggtaccctttaaacccggaaaaaccgggggtccctaacggttaccggaccgtaacccgttacccccggaggtaccccgttaagggtttaccgaacggggtttcggaccggtaaggggttcgggttaccgtaaggggtaaacgtaaccgtaccgtttacctacgttcccgtaccctaactaacctacgaaaccgacggtacctacggaccgtaccgtacgtaacgttacttccggttagtctttaacgttttactaacgttctacgtacgtacgtaccggtaccgtaaccgtacggtccgtccgtttaacccggtaccgttttccgggacccgggtaacggggtaccaagggtaccgtcggtacgtacgacgtaacgggtaccgtaacgggttcgtggtactcgtacccgtacgtacgttccttacgttaccttccgtaccgttccccgtacccgg

SEQ ID NO: 158957 - DNA, 779 bp, Homo sapiens
  misc_feature: GYAE6OF01A4ABE.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacactagtttccagccaccctgttctttgtctccagagagcggcctacccgtctcctgcgacggcctaagtcgagtagtattacgacgtacttacgttacgccgttggtaaccaactaggacggccgtcggaccgacggtcctccgacggtccttccctactactgtatgattcgtaccgttaacgtaaaacgggcctaccgtcggacctaccgtccctaacggtccgtacgggtttccgaacgggttcggacgttacggggttcgggttaccgtaaggggtaaaacgtaccggtaaccgtttacccgtacgtcccttaacccaaaccgtaaaccgttacccaaaaccgtacgtacccgttaaagggacccgttacccgtaacggttaaccgttagtttaccccggttggtaacctttaaacgttttaacgttacccgtttgtaaccgtacgtaccgtagtaacccgtaacgtaaccggttaccggttacccgtcggttaccggtttaccgggaccgggtagggaccgagtacgtggacgtagtaccgaacggtaacttacggtggtacgcggtacgcgtacccttacgtcgttaccttaccgttcttaccctccgttaccccg

SEQ ID NO: 158958 - DNA, 807 bp, Homo sapiens
  misc_feature: GYAE6OF01C4QGE.22.9.A09.1.454.CMB.1.raw
  modified_base (281)..(281): a, c, t, g, unknown or other
  misc_feature (281)..(281): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctccagacgaccaccggagaagttgtgttgacactagtttccacgccaccctgttctttgtctcgaggacgacggtccggcccacccgttctccgtgcgacgggaccaagtgagtagttatacgaccgtactacgttcgccgtaggtaaccaacgnggacggcctggccgaggcctcccgaggtcctcctcgagtcgtatgtactcgtaccgttaaccggaaaacgggtccacggtcggaccaccgttcccgacggtcccttaacgggttcgtaacgggtcggaccgtaggggttcggtacggtagggaacgtacgttaccgtttcctaccgtcctaccgtacctacgtaaccaacgtcgtaacccgtaagggtacctccggttaacggaacgttctttacgggtacttccgttttaaggtttaaccttacgttcgtaccggtaacgttaccgtaccggtacccgttaacggtaacggttcccgtacccgtttccggtttaccggttacccggggccgggtacggggacccttagggtacggtcgggtaaacgtcgtaacggaacccggtagttaaccggttcggtacgggtacccgttacgaccccgtttaccggttaaacccgtttcccggttttactaaccccccgtttgtttcccccgttttacccggttaccccccg

SEQ ID NO: 158959 - DNA, 661 bp, Homo sapiens
  misc_feature: GYAE6OF01A4C5R.22.9.A09.1.454.CMB.1.raw
  modified_base (160)..(160): a, c, t, g, unknown or other
  misc_feature (160)..(160): n is a, c, g, or t
  modified_base (298)..(298): a, c, t, g, unknown or other
  misc_feature (298)..(298): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggcctcccagagaccaccggagaagttgtgttgacanagtttccagccaccctgtctttgtctccaggagagccgggccacccttctcctgccgagggccaaagtcgagagtattaagcgaactacttagcctaggtaaccaacaggaggcctggccaggctccgaggctccgtnatgtatagatgaccttacgaaaagggccaacgtggacactcccgagtccgtaaggttcaggtcggctaggtggtacaggagacgtacttcatccgactaccatacaacagacctagacgtccgtagtacgtacttcgtacgacttacggtttaataccgttgtaccgtagccgtaacgacccgttaaacgtacggtaccgtacccgttaccggttacgtttcggaacccgggtaacgggggtacccaaggttccgtaagggacggtaacgtaccgaaggtaaccggtaaacgttcgggtacggagtaccggccgaaccgttacgttcgttacggttaccttacgttacgttcccggtaccccg

SEQ ID NO: 158960 - DNA, 879 bp, Homo sapiens
  misc_feature: GYAE6OF01ELR9E.22.9.A09.1.454.CMB.1.raw
tcagacatacgcgtcacgaccggtgctcgatttagcgagacgcgcagggggaggaactgctcagttaggacccagagggaaccatggaagcccccagctcagcttctcttcctcctgctactctggctcccagacgaccaccggagtaagttgtgttgacactagtttccagccctaccctgttctttgtcctccgaggagacggccggcccaccctctccgtgcgagggccaagtgagtagttattacgcgtacttacgttcgccgtaggtaaccaacgaggacggccgtacggcccgaggtccctaccccgaggtccctcctacgtattacggtatagtagttcgtaccgttaaacccggaaaacgggtcccctaacggttccggacctaaccgtaccccgacgtacccggttaacgggtttacctacgggttaccggtacgtacgggggtttacgggtaccggtaaggggaaacggttaccgttaccgtttaccgtaacccttaccgtacccgtaaaccctaccgttaacccgaaaccgttacccgtaacccgttaacggtaaccgtacccgttaaccggtaaccgttacgttttaccgttacggttaccgtttaacggttttaactttaaccgttacggtaccgtacgtaccgtacggttacccggtaaaccgtaacggttccgtaccccgtttaccggtttaccgggtttacccggggaacccgggtaccgggggaacccgttaacggtacgggttacgggtaaccgtacggtaaccggtaaccggtaacgttaaaccgggttcggtacggtacgttccgaacctaccgtacgtttccgttactttacgttacccttccgttccccgtaacccg

SEQ ID NO: 158961 - DNA, 929 bp, Homo sapiens
  misc_feature: GYAE6OF01BRTRQ.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggcctcccagacgaccaccggagtaagtttcgtgttgacactacgtttccagccctaccttgttcttttgtcctccgaggacgacggcccgggccctaccctcgtcctggccgacgggaccaaagtggaagtagttaagttacgaccgtaacttaaccgttacgaccgttacggtaaccaaacgacggaccggtcctagggacccgacgggtccctcccgaacgggtcccttccttaccgtaggttacgttacgtacggtacgttaccggttaaccgtttaaacccgggaaaaccggggtccctaacggttaccggaccgttaacccgttccccggaacggtacccggtttacggttaccggtaacgggttccgggtacggttacggggttccggggtaacttaacgggggaaacgttaccggttaaccctttccgtacccgtttaccgaacccgtaaacctaccgtaaccgtaaacgaaacccggttcctaaacgggtccgttaacccggttaggtaaaccgtttctttacggacgtttaaccgtttaacgttttacgttacgtcgtaccggtacgtaccgttaacgtacccggttaaacccggtacggtttcccggtacccgtttaaccggtttaccgggttaccgggaacccggggttaagggacccgtaacgggttggaaccgggtataccggtaacgggtaaccggtaccggttacggttccggggtaacggttcctaacggtaccccgtaactttacggtctttacccggtttctaaccgttcccttacccggtaacccg

SEQ ID NO: 158962 - DNA, 711 bp, Homo sapiens
  misc_feature: GYAE6OF01BCE07.22.9.A09.1.454.CMB.1.raw
  modified_base (397)..(397): a, c, t, g, unknown or other
  misc_feature (397)..(397): n is a, c, g, or t
  modified_base (424)..(424): a, c, t, g, unknown or other
  misc_feature (424)..(424): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcggccaccctctcctgcgagggccaatgagagtattacgcgtaactacgttagcctaggtaccaacgaggacggcctggaccaggcctcccgaggcctcctcatgtatggatgaccttacgaaaagggccactggcactcccagccgaggttcaggtggcagtcggtctaggaagacgtacttcacgtctcaccatcgaaacncggactacgacgtccgtagtaaccgtnttacgtacgtaccgttaaggttttaactttaccggtacgtttacgaacgtacgtaacggtacccggttaaccgtaacgggttccgggtccccgttaacccggttaccggttttttaccgggaccccggggaaccggggggttaaccccaacgggttaccggtacgggtaacgggttaacgttaccggaaccggtaaaccgtaaaccgttcggggttacggacggttccgaccgtaccgtaaccgttcgttacggttaacctttctaacgtttccccgttacccccgg

SEQ ID NO: 158963 - DNA, 764 bp, Homo sapiens
  misc_feature: GYAE6OF01BIHWV.22.9.A09.1.454.CMB.1.raw
  modified_base (327)..(327): a, c, t, g, unknown or other
  misc_feature (327)..(327): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagtaagttgtgttgacactagtttccagccctacctgttctttgtctccgaggagaggccggccaccctctcctcgcgacgggccaagtgaagagttaattacgacgtacttacttacgccttacggtaacccaaacgaggaccgccgttcggaccgacggtcccgtccccgaggtccctccctntacttctaggtggtcgactactaccgtacgggacggtaccctacgttcggtacctccccggacgtcccgtagggttctaacgggtcggaccgttaggggttcgggttccgtaaggggtacgtaacggttacgtttccaaccgttccacccgaacctacgtacgacgtaaccgtcgtccgtgtaccgtaacgtttaccgtaagttaaagtttacgttttcggtaccgttttaaagttttaactttacgttcgtaacgtaccgttaacttaacttaaactttaacgtaaccgttccgggtacccgtttacggttaaccgtttaggggtttaccggaccgggtaaacgggaccgtagtcggttaaggaacttagaaaccgtaacgtgttacgtaggcctaagtcccaacttgttccttagtccttaccgtcgttaccccg

SEQ ID NO: 158964 - DNA, 725 bp, Homo sapiens
  misc_feature: GYAE6OF01EA0SB.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagtaagttgtgttgacactagtttccacgccaccctgttctttgctcaggagaggccggccaccctctccgtgccgacgggccaagtgagtagttagttacgcgtaccttacgttacgcctcggtaaccaacgagacggcccgtagggccaacgggtccctaccccgaggtcctcctactacttgtatgtacgtcgtacgttaaccggaaacgggcctacgtcggacctacctcccgagccgtaggtcacgtggccgagggttcggacgtagggaagacgtacttacacctacgtaccacctaacgtaccaaaccgacgtacctaaggaccgaccctagaacgttcttacgtacgtactttaagtttaccgttagtcgtacaggacctacggtacctaacgtacgttaccggtccctaccggtttacggttaccgggaccggggtaccgggaccgtaacggtcggtacggacgtaccgtacgaaacgggtacccgtaaggttacggtcgtaacccgccgttaaacccgcgtttacccgttacgttacccgttactttacccgttaccgtttccccgtaccccg

SEQ ID NO: 158965 - DNA, 881 bp, Homo sapiens
  misc_feature: GYAE6OF01EXW7Q.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacactagtttccagcccacccttgttctttgtcctccgagggagacggccgggccctaccctctcctgcgacgggccaagtgaagagttaattagaccgtacttacgttacgccgttagggtaaccaaacgtaggacggtccgtacgggacccgagggtccctccccgagggtcccttacccgtactaagttcggttattaggtacgttcggtacccgtttaaacccggaaaaacggggccctacggttaccgggacctacccgtacccgacggtaccccgttagggttaccgtacgggttcgggtaccggtacggggttcggggttaccgtaaggggaaagtaaccggttaaccgtttccctaaccgttccctaacccgtaaccctaacgttaacccgaaacgtaccggtacccgttaacggtaccggtacccgttaccggaacgttacctttacggtacgttaacgtttaacgtttttaacttacgtttcgtaaccgtagaccgtacggtaccgtaaccggttacggtccgtcccgtttaccgggttaccgtttaccgggacccggggtaaccggggtaccgtaaggtaccgggtaggaaccggtacggtaaccgtaaccgggaaggttaccggtacggggttaccggtacgtcccggaacctacccgttaacggttccgtttaccgtttaccgtttacccgttcccttcccggtttaccccgg

SEQ ID NO: 158966 - DNA, 880 bp, Homo sapiens
  misc_feature: GYAE6OF01EUFOW.22.9.A09.1.454.CMB.1.raw
tcagacatacgcgtcacgaccggtgctcgattttagcgagacgcgcgagggggaggaactgctcagttacggacccagagggaaccatggaacgccccagctcagtcttctcttcctcctgcctactctggcctcccagacgaccaccggagtaacgttggtgttgacactacgttccacgtccctaccctgttctttcgtcctccgaggaggacgccgggcccaccctctccgtgcgacgggccaagtggaagtagtagttacgacgtacttacgttacgccgtacggtaaccaacgaggtacggtaccgtcggaccgtacggtcccgtacccggaggtccctaccctacgtaacgttacgttacgttaggtacgttacggttaccccgttaaaccgggaaaaccggggtcccgtaacggttccgggtacctacccgtaaccccggtacggaccccggttagggttaaccggaaggggttccgggtacgggtacgggggtttacgggtacggttaaagggggtaaacggtaccggttacctttacccgttacccgtaccgttaacccaaccgtaacgtaacccaaacggtaccgtacccgtaacggtaccgtacccgttaacgggtaccttacgttcgttacgttaaccgtttaacgttttacttacccgttacgtacggtaacgtacggtaaccggttacccgttaacggtaaccggttccgggttacccgttacccggtttacgggtttaccgggaccggggtaaccgggtacctacgggtcggtaacggactacggaacgtacgggaaacttcgggcggtacgacgtcacccgtacttcgttcccggttacttaccgtccttccgtcccgttcccg

SEQ ID NO: 158967 - DNA, 725 bp, Homo sapiens
  misc_feature: GYAE6OF01AQIK2.22.9.A09.1.454.CMB.1.raw
  modified_base (272)..(272): a, c, t, g, unknown or other
  misc_feature (272)..(272): n is a, c, g, or t
  modified_base (551)..(551): a, c, t, g, unknown or other
  misc_feature (551)..(551): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatggagagtattagcgtactacttagcctggtaccaacgagaggcctggaccnggcctccaggctccgtcagtgtatgatcgtacgttaccgaaaacggggccacgttcggacctaacttcccccgaggtacccctaggggttttacccgaagggttcggaccgtaaggggtttccgggggtaccgttaaggggaaaggtaacggttacccgtttaccctacgttaccgtacctaaccacttaccgaaaccgacggtacccgtaaggaccgtaccgttacgaacgtacgtttcgtaccgtactttaacggttttaacttaacgttcggtacncggtacaccggttaccgtaaccgtaacggtcggtcccgttaccggttaccgtttaccgggacgggtacggggttaccaacggtccggtaggacgtagtcgaacggacggttaacgtgggtcgcgtcgtccgtactacgtccgttagttcccttcgtacctttccgttaccccgg

SEQ ID NO: 158968 - DNA, 743 bp, Homo sapiens
  misc_feature: GYAE6OF01B6SZP.22.9.A09.1.454.CMB.1.raw
tcagacatacgcgtcacgaccggtgctcgatttagcgagacgcgcaggggggaggaactgctcagttaggacccagagggaaccatggaagccccagctcagcttctcttcctcctgctactctggctcccagagaccaccggagaagttgtgttgacacagtttccagccaccctgtctttgtctccaggagagccgggccaccctctcctgcacgggccaatgagagtattagcgactacttagcctaggtaacccaacagtacggcctacggccacggctcccgaggcctcctcatcgtatgatcgactaccgaaaagggccacgtcggacactaccccgacgtccgacggttaccgaaggttacgggacgtaacgggtcgggtacgtaggggaaacggtacggtactttacccaacgttaccctactaaacccaattaccaaacgtaacgtacccgtaagtaacgcccgttacggaaccgtactttaccgtagtaaccttagtttttaacgttactcggttacaacggtccaacggtacctaacccggaaggttaccgtacccgttacccggttaacgtttacccggggacccgggtaaccgggggtacccaaacgggtcggtaacgggacgtaacgtacgaacggtaaaccgtaaccgttcggggtacgaccgttcgacccgtaaacccgtagttacccggttacgttaccgtttaccctacgttaccccgttccccg

SEQ ID NO: 158969 - DNA, 836 bp, Homo sapiens
  misc_feature: GYAE6OF01AVXL3.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggcctcccagagaccaccggagtaagttgtgttgacactacgtttccagcccaccctgtcttttgtctccaggagacggtcggccaccctctcctgcgaggccaatggagagtatacgacgtacttacttacgccgtacgtaaccaacacggacggcccgtacggccgaacggcctacccgacggtccttaccctactattacgtataggtaactacggtaccttaaacccggaaaaacggggtaccccgtaacggttacgggacctaacccgttaaccccgaacggtacccggtaacgggtttaccgaaggggttaccggacgttaggggttacgggttacggttacgggaaaagtaccggtaacctttaaccgtaccttacccgtaacctaacccgtaactaacccgttaaaaccgaccggttacccgaagggtaacctacccggtaacggtaaccgtttacttcgtaacgttaccgttaacttttaacgttaccttacggtacgtaacgtcggaacttaccggaacgttaacgggtccgttaccccgttacggttaaccggtttacggacccggggtaacggggtacctaagggtccggtaggaacgtacccgtaagacgggaaaccgttaacggttcgggacggtacccgacgttacccgacctttacgtccgttacttacccggttactcccgttcccgttacccccg

SEQ ID NO: 158970 - DNA, 735 bp, Homo sapiens
  misc_feature: GYAE6OF01BPNLS.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacactacgtttccagcccaccctgttctttgtcctccaggacgaggccgggccaccctctccgtcgcgtacggcctaatcgagagtattagcgtactacttacgcctacggtaccaacgaggacggtcctcggaccgtaacgggccctacccgacggccttccgtacgtatcggtatgaactcgtaccgttaccgaaaacgggtccaacgtcggacctacctcccgacgtcccgtaaggttacgtagggtacggtacgtaggggttccgggttacgtaggggaaacgttaagtaccttaccgtaaccgtccttaccaaacccgtactaacccgaaacgtaccgtacgtacgtaccgtccggtaagtaccgtacgttcgtagtaccgtttagtttaacttacgttgtacgtacggtacgtacgtaccgtaaccgtaggtcccgtcccgttacggttacgttccggacccgggacgggtaccgaggtacgtaggtaccgagtaccgtacgaaacggttcgaggtacggtacgtcgaccgtaacctagttccttacgttactccgtaccttcccggtaccccg

SEQ ID NO: 158971 - DNA, 730 bp, Homo sapiens
  misc_feature: GYAE6OF01B83C1.22.9.A09.1.454.CMB.1.raw
  modified_base (690)..(690): a, c, t, g, unknown or other
  misc_feature (690)..(690): n is a, c, g, or t
  modified_base (715)..(715): a, c, t, g, unknown or other
  misc_feature (715)..(715): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggcctcccagagaccaccggagtaagttgtgttagacactagtttccacgcccacccttgttcttttgtctccgaggagacggccgggcccaccccttcctcctgccagggccaatgagagtactagcgtactactacgccgtacgaccaacgagcggcctcggacctacggccctcccgacggtcctacctctagttgtagtgtactcggtaccgttaaaccggaaacgggtccctaacggttccgggaacctaccggtaccccacggtcccgtagggtttaccgacgggttcgggtccgagggttccgggttacggtaaggggtaacggtacttaccgtttacccgtaacctaccgtacctaaaccctactaaccgaaccggtaacgttaccgttacgaccgtcccgttacggtaacgttactttcgtacgtactttaacgtttaccttagtacgtcgaagtccgtaacgtccgtaaccggtacgttcgtccctcggtttacgttcgggaccggtacgggactagtcgaggcgtacgactacggtactacggtggtccgacgtcnccgtactcgtcttacgttacccttntaccgttccctaccg

SEQ ID NO: 158972 - DNA, 795 bp, Homo sapiens
  misc_feature: GYAE6OF01DYNP9.22.9.A09.1.454.CMB.1.raw
  modified_base (196)..(196): a, c, t, g, unknown or other
  misc_feature (196)..(196): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacactagtttccagccaccctgttcttttgtctccaggagnggccggcccaccctctccgtgcgacgggccaagtgagagtatagaccgacttacttacgcctagtaccaacagacggccgtcggaccgacggcctcccgacggtcctcctacgagttcggtagttcgagttcgtaccgttaaaccgaaaaaccggggtcctacgttcggacctaccgtacccgacgacccggtaacggttccgaagggttcgggacgtaggttcgggtacgtagggtaaacggacggttacctttcgaacccttccttaaccaaccctaactaaccgaaaaccgtacggttaacccgtaacggaaccgtaccccgttaaggttaaccgttctttaccggttacgttaaccgttttaaaggtttttaccttacggtttcgtacgtacggtaccacggttaaccgtaaccgtacggttaccggtacccgtttaccggtttaccgttttacgggtaacccggtaagggggtacctaacgggttcgaacggggtaacgtacgtacccggaagttaacccggtaacgttcgggtacggcgtaccgacctacgtacgttcttacgttaccgttccgttacccttcccgttacccg

SEQ ID NO: 158973 - DNA, 733 bp, Homo sapiens
  misc_feature: GYAE6OF01CG3V1.22.9.A09.1.454.CMB.1.raw
  modified_base (314)..(314): a, c, t, g, unknown or other
  misc_feature (314)..(314): n is a, c, g, or t
  modified_base (367)..(367): a, c, t, g, unknown or other
  misc_feature (367)..(367): n is a, c, g, or t
  modified_base (458)..(458): a, c, t, g, unknown or other
  misc_feature (458)..(458): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccacggagaagttgtgtgacactagtttccagcccacccttgttcttttcgtcctccgtaaggaggacggccggggccctaacccctccttccgtcgcgacgggccaactgagagttatacgcgtactacttcgccgtacgtaaccacaggacggtcgtcgggccacggcctaccccgnggtccctaccgtcatcgttagtagatcggtaccttaaaccggaaaacgggccncgttcggaccctactaccccgacggtccgtaacgggtttcgaaggtccgggtagtaccggggttggtcgaacggggaaaggtacgttaccncttacccggttactcccaaactactaaaccgtaccgcgtaacgtacgtacgaccgttcggaccgtacgttcctagtaacgtttagtttaactttactagtccgtagtccgtaacgacgttaacgtacgttccggtacccgttcgttacggttcgggaccggacggggtaccgtacggacggttacggaagtaccggtacgaacggtacgggtaacgtcggtacggtactcggtaaccacgttcttacgtcttacgtcttacggttccttaccccg

SEQ ID NO: 158974 - DNA, 906 bp, Homo sapiens
  misc_feature: GYAE6OF01CGQ97.22.9.A09.1.454.CMB.1.raw
tcagacatacgcgtcacgaccggtgctcgatttagcgagacgcgcagggggaggaactgctcagttaggacccagagggaaccatggaacgcccagctacagcttctcttcctcctgctactctggctccagagaccaccggagtaagttgtgttgacacgtacgtttccacgcctaccttcgttcttttcgtcctccgtaggacggacggccgggccctacccgttcgtccgtggaccgtacgggacctaagtcggaacgtagttaagttacggacgtaacttacgttacggtccttaacggtaacctaagaacggcggtccgtacggacctacggccctaccgtaacggtcctaccgtacgtagttcgtagttcgtacgtccggtaccgttaaaccgggaaaccggtaccgtaacggtcggtacccaccgttaccgacgggtaccgttaacggttccgagggtacgggtacgtacgggggtttacgggttacggtaacgggaacgtaaccgttaaccgtttccggtaacccgttaccttaaccggtaacctaaaccgttaccggaaaccgttccggtaaccggttaacggtacccgtaacggttaaccggtaacggtttacgtttaccgtaccggttaaacgttttcgttttaaacgttacgtttacggttaacgacggttaaccgtacggttaccgggttaaacgtacgggttcccggtttaaacccggttcgggtttacccggtaccgggggtaaccgggtacggggaacccgttaaggacggtggaaccgtaacggttccgaaacgggtaacgtacggttcgggttctaccgtaccggacccgttaacgttaccgttccgtttacgttaccctttaccttcccggttcccgttaaccccgg

SEQ ID NO: 158975 - DNA, 801 bp, Homo sapiens
  misc_feature: GYAE6OF01EQALM.22.9.A09.1.454.CMB.1.raw
tcagacatacgcgtcacgaccggtgctcgattttagcgagacgcgcagggggaggaactgctcagttaggacccagagggaaccatggaagccccagctcagcttctcttcctcctgctactctggctcccagagaccaccggagaagttgtgttgacactagttttccagcccaccctgttctttgtctccaggagaggccgggccaccctctcctgcgacggccaatgagagtatagacgtactactacgctcggtaaccaacagacggtccgtcggccacggacctccgacggcctcctactagtgtacgtagtatcggtaccttaccggaaacgggtcctaacgtggacctaactccgacgtaccgtaggttacgagggtcgacgtggtcggtacgaggaacgtacgtaccttacaacgttcctacgacctagtcgaagtaccgacgtaccgtagaccggttcgtaagtaagtttacgttttacgtaactttaacgttttacgttaaccgttagttaccgaaccggtacggttaccgtaaccggttaacgtaaccccgttaaccccgtttacccgtacccgggttaaacccgggggttacccggggaacggggttaacccggggtaaacccgtaagggggtttaaccgggaaacgttaacggtaaaaccccgggtaaaacgttccgggttaacgggttacgggacccgtttaagaccccggtttaactacggtttacccgtaccgttttaaccgttcccgttaaccggttttaccccgtccccgtacgttaaacccg

SEQ ID NO: 158976 - DNA, 702 bp, Homo sapiens
  misc_feature: GYAE6OF01BDN8Y.22.9.A09.1.454.CMB.1.raw
  modified_base (578)..(578): a, c, t, g, unknown or other
  misc_feature (578)..(578): n is a, c, g, or t
  modified_base (638)..(638): a, c, t, g, unknown or other
  misc_feature (638)..(638): n is a, c, g, or t
tcagacatacgcgtcacgaccggtgctcgatttagcgagacgcgcagggggaggaactgctcagttaggacccagagggaaccatggaagccccagctcagcttctcttcctcctgcttactcgtggcctccagacgaccaccggagaagttgtgttgacactagtttccagccacccttgttctttgtctccgaaggagcggccggccacccgtctcctgcgagggccaatgagtagtatagcgtaacttacgtagcctaggaaccacgtaggtacgcctaggcccgaggcctaccccgaggtcctcctactagttgtaatgtacgttgaccgtttaccgaaaacgggcccaacgttccgggaccacgtccccgaagtaccccggtagtttacccggtaagtcggggtacccagggttcggggttacctcgggaaacggtagtaaccgtttcctaaaccgttcacctaaccacgttacgaaaaccgtacggcccgtaagtaccgaccgtacgacgtttaacttccgtcgtaacgtacggtttaactcgtacgttacacggttacaggtacccgtaanaacggttcgtaccgtccgttacgtttcgggaccgtagggccctaaggtgaccggatacgntaacggacgttagcggtgcgtgaccctaactcgtccttagttccttataccgttccttaccccg

SEQ ID NO: 158977 - DNA, 856 bp, Homo sapiens
  misc_feature: GYAE6OF01CJP0Q.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgcctactctggcctcccagacgaccaccggagtaagttgtgttgacactagtttccagcccacctgttctttgtctccgaggagacggccgggcccaccctctcctgcgacgggaccaagtcggaagtagttattaggacgtaccttacgttacgccgttacggtaacccaacgaggacggcccgtcggaccgacggccctaccccggacggtccttccgtactattacggttatcggtacgttacgtacccgttaaccggaaaaacgggtcccgtacgtcggtaccctaaccgtccccgtaacggtacccggtaacgggtttaccgacgggtacgggtacgtaacgggggttccggtacggtaacgggtaaaggtaaccgttaccgtttacctaccgtaccttaacccgacctaacgtaacctaaaccgaccgtaacccgtaagggtaaccgtacccgtaacggtaccgttacgtttccgtacgttacgtttaacgttttaacttacgttacgtcgtacgtaccgtaccggttaaccgtaaccgtacgggttcccggtacccgtttaccggtaaccggttttccggggaacccgggtacggggtaccgtaacggtaccgggtacggacggtacgtacggaacggtaaaccgttacggtacgggtaggtccggtaccgtaccgtaacccttacgttccgttaccgtttccgtttaacccctcccgtttacccgttaccccg

SEQ ID NO: 158978 - DNA, 782 bp, Homo sapiens
  misc_feature: GYAE6OF01BTDOJ.22.9.A09.1.454.CMB.1.raw
  modified_base (266)..(266): a, c, t, g, unknown or other
  misc_feature (266)..(266): n is a, c, g, or t
  modified_base (733)..(733): a, c, t, g, unknown or other
  misc_feature (733)..(733): n is a, c, g, or t
tcagacatacgcgtcacgaccggtgctcgatttagcgagacgcgcaggggaggaactgctcgagttaggacccagagggaaccagtggaagccccagctcagcttctcttcctacctgctaccttcgtcggactcccagagacccgaaccgggagtaagttcggtgttacgaactaccgtagttttaccccgaagtcccctacccgttgtttcgttttcgtacccgtaccgaggtacggacggccggaccctacccgtcttaccgngaccgacggtacaagttaggaactaagtgtaacgtccgtaacttaccgttaacgccgtacggtaacccaaagtacggaccgccgttacggaccgtacggtaccctcccgacggtccctccgtacgtaacttcggtactacgtacgtaccggtaaccgttaaacccggaacggttaccgaccgtcgggacctaaccgtcccgaccgtaccggttaccgtacgtggtacggtacggtggtaccggtagtaaggacgacgttacgttaccgtctacgtacccaactcctaaacgacgtacctaggtacgaaccgtacgttacgtactacgttacgtagttacgttaacgttaccttacggtctaccgtacgtaaccgtacgtaccgtacgtacggtccgttacccgttacgttccgggtacggccgtacggtacgtgacgtagcgtaagtaccgagtaacgtcgtacgtnccgtacgaccgagttcgtaccttacgtacttaccgtccgttaccgaccg

SEQ ID NO: 158979 - DNA, 780 bp, Homo sapiens
  misc_feature: GYAE6OF01B10D1.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccacctgtctttgtctccaggagagccgggccaccctctcctgcgacgggccaatgacgtagtattagcgactacttagccttggaaccaacaggacggcctggccgacggacctcccgacggtcctcctacgacttgtactgattgtacctttacccggaaaacgggtcccacgttcgggacctacgtccccgagtcccgtacggttcgaggttcggaccgtaagggttcgggtacgtaggggaaacgacgtaacctttacgacctttacgacccaaacctacgttaaccgaaacctaccgggtacccgtaacggtaacggtcccgttaacggaaccggttacgtttaccgttacggtaccgtttaacgtttttaacgtttaccgtttacgtaccgtaggtacccgtaacgggtacccgtaaccggttaacggtccggttaccccgttaccggtttaccggttttacgggaccgggtacgggggtacccgtaacgggcggttacgggaacgttaacgtacgaaccggtaacggtaacgtcgggtacggtccgtacggtccgaaccgttacgtcgttacggttaccctttctacccgtttcccgtacccccg

SEQ ID NO: 158980 - DNA, 704 bp, Homo sapiens
  misc_feature: GYAE6OF01D8244.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccacctgtctttgtctccaggagagccgggccaccctctcctgcgagggaccaatgagagtattagcgactacttacgcctaggtaaccaacgagaggccgtcggccgaggcctcccgaggcctcctcatgtatgtatcgtaccttaccgaaaacgggccacgtcggctactacccacgtccgtaggttcgaggtcggacgtaggttcgggtcgtaagggaaagtacggtaacctttccgaaccttcctaaccgtaacccctaacttaaccgaaaaccgtaccggtacccgttaacgggaacccgttacccgtaacggtaaaccgttacgtttaccgtacgtacgtttaacgttttaagttacccgtagtcgtaacgtacgtacgtaccgtaaccgtacggttccggtacccgttccgtacgtttcgggaaccggtggggaccaaggcgtaggacgtacgtaccgaagtaacgtacgtcggttcgacgttcgacctacttacgtccttcgttaccttcctccgttcccgtaccccg

SEQ ID NO: 158981 - DNA, 811 bp, Homo sapiens
  misc_feature: GYAE6OF01BRAY1.22.9.A09.1.454.CMB.1.raw
  modified_base (771)..(771): a, c, t, g, unknown or other
  misc_feature (771)..(771): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagacgaccaccggagaagttggtgttgaccactacgtttccagcccaccctgtctttgtctccaggagagccgggcccacccctctccctagccgagggccctaagcgaggagttaattacggccgtacttaacgttacggcccgttggtaacccaaacgaggaccggccctaggcccgacgggcccttccccgagggcccttaccgcctaagtcgttacgtggtattcggtaccgtttacccggaaaaacggggcccctaacggttcgggacctacgtaccccgacggtacccgttaagggttcagggttacggggccggtaggggtttaccggggtacgttacggggaaaacggtaaccggtaccgtttaacccgtaccgttacctccccgtaaaccctaccttaaacccgtaaaccgaaccggtaacccgtttaccggaacccgtacccgttaacgggtaacccggtttaacttcgtttacggtaccgtttaacggttttacttacggtcgtttaccgaacgtcgtaccgtacgtaccgtacgggttcccgtccgttaccggttacggttccgggaccggtcggggacctaaggccgtaggtacgtacgacgtacgacgaacggtcggtagccggttncccgacttaccgtctacgttcttcctcgttcccctacccg

SEQ ID NO: 158982 - DNA, 613 bp, Homo sapiens
  misc_feature: GYAE6OF01EFHC0.22.9.A09.1.454.CMB.1.raw
  modified_base (375)..(375): a, c, t, g, unknown or other
  misc_feature (375)..(375): n is a, c, g, or t
tcagacatacgcgtcacgaccggtgctcgatttagcgagacgcgcagggggaggaactgctcagttaggacccagagggaaccatggaagcccccagctcagcttctcttcctcctgctactctggctcccagagaccaccggagaagttgtgttgacacagtttccagcccaccctgttcttttgtctccaggagaggccgggcccaccctctccgtgcagggccaatgagtagtattagcgacttacttagcctaggtaccaacgaggacggcctggccgacggcctccccgaggcctcctcatgtatgatgtccttaccgaaaacggccacgtgacactcccagccaggtcagtgcgaggtggtcgaggganagtactcactctaccacactacaacagtcctagacgccgtagactattctgtacttagtttagttctagtacgtagcgtacgaccgtaacgacggtccgccgttaccgttacggtttacgggaccgggtaacggggactaaggtcggttaggaacgtagtacgacggtaacgtacggtggtcggatcgaccctaacgtcgttaccgttagttccctttgtcccgttccttacccccgg

SEQ ID NO: 158983 - DNA, 705 bp, Homo sapiens
  misc_feature: GYAE6OF01CP2NO.22.9.A09.1.454.CMB.1.raw
  modified_base (196)..(196): a, c, t, g, unknown or other
  misc_feature (196)..(196): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggcctcccagagaccaccggagaagttgtgttgacacagtttccagccaccctgtctttgtcctccgaggagngcgggcccaccctctcctgcacgggccaagtgagtagtattagcgtaactacgttacgtcctacggtaaccaacgacggacggccgtcgggaccacgggcctacccgaggtcctcctcagttgtagtgagttcggtaccgttaaccgaaacgggtccagtccggacctactccccgagtccgtagggttcaagggtcggtcgtacgggttcggtacggtagggaacgtacgtaacgttccgtacctacctacccaactacgtaacaacctacgtaccgtacgaccgtccgtacgtacgtacttccgtagttcgttaagtttacttccgttacgtaccgtacgtacgtacgtaccggtaaccgtacggtccgtaccgttcccggttaccggtttccgggaccgggtacggggacctaacggtcggtacggagtacgtaccgaacggtacgtacggtcgtcgtccgtcgacccgtacttgtcgttaccttctaccgtccttcccgtacccg

SEQ ID NO: 158984 - DNA, 654 bp, Homo sapiens
  misc_feature: GYAE6OF01D4SNB.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccgtatccgtgcagggccaatgagagtattagcgactacttagcctaggtaccaacagaggacctggccaggcctcccgaggtcctcctacatggtatgatgtcttaccgaaaacgggccacgtcggactactcccagcctaggttcaagtcggacgtaggtggtactagggaacgagtactttacacctcgtaccaccgtactacaaaccgagtaccctaggacgtcccgtagaacgtacttcgtacgtactaagtttacttacgtcgtcgagctaacgtccgtaacgtaggtccgacctcggttacgtttcggaccggtacggggactaacggccgtgggtaacgaccgttaacgacgggtaacccgtaaacgttgggtacggtacgttccggaacccgtaccttaacgtccgttacggttacctttacctaccgttccccgttaccccgg

SEQ ID NO: 158985 - DNA, 767 bp, Homo sapiens
  misc_feature: GYAE6OF01AM6K5.22.9.A09.1.454.CMB.1.raw
  modified_base (192)..(192): a, c, t, g, unknown or other
  misc_feature (192)..(192): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagcccaccctgtctttgtctcgaggngagcgggccaccctctcctgcagggccaatgacgagtatagcgactattacgcctggtaaccacgagacggcctggccgaggcctccgacggcctcctcatgttactgtatggtccttaccgaaaacggtcctacgtcggctacgtcccgacgaccgtaggttcgaggttggacgtacggttgggtacgtagggaaggtacggtactttacccgacgttacctacccgtacctaactaccgaaccgtacggtaccgtaacgggtaccgtaccgggtacggtaaccggtattttcccgttaggtaaccgtttacggtttttactttacggttacgttacaacggccgtaacgggtaccccgtaaccgggttacggtacccgggttacccgtttacccggttaccgggttttccgggacccgggttaggggggaacccgttagggtaccgtacggggtagtaacccgttaggaaacccgggtaccggttaaacggttcgggttacggaccggtcgtaaccctacccggaattttcccggttccgttcctttacccgtccgtttcccgttacccccgg

SEQ ID NO: 158986 - DNA, 733 bp, Homo sapiens
  misc_feature: GYAE6OF01AVWNT.22.9.A09.1.454.CMB.1.raw
  modified_base (222)..(222): a, c, t, g, unknown or other
  misc_feature (222)..(222): n is a, c, g, or t
  modified_base (684)..(684): a, c, t, g, unknown or other
  misc_feature (684)..(684): n is a, c, g, or t
tcagacatacgcgtcacgaccggtgctcgatttagcgagacgcgcagggggaggaactgctcagttaggacccagagggaaccatggaacgccccagctcagcttctcttcctctgctactctggcctcccagacgaccacggagtaacgttgtgttgacactacgtttccacgccctaccttgttctttgtcctccgaagtgcgccggccaccctctccgngcgacgacaagtgaacgtagtagttacgacgtaactccgtacgtccgtaggaaccctaaaggaggcgtccggtacggaccgtacggtccctaccgacgtcctccgtactagtcgtacgagtacgttcgtaacccgttaaccggaaaccggtctacgtacggtaccaacccgtccctaagtacccggttaaggttgaacggggttcggaacgtaggggtttccgggtagtaaacggtaggaaacgttccctttaccgtacgtccctaaacaccgtaaactaaaccaacggtaccgtaacgtacgtaccgacgtactacgtaacttcggttacgtaccgtttaacgtctaacgttgtaccgaataccggtaccgtacgtacgagtccgtacccgtacgttacggttaccgcggggtaacgtcgtacggcgtacggacgtacgtacgtacggacgttaacggtgntacggcaccgtaacctcgtcggtacttaccgttacgtctacccccgtac

SEQ ID NO: 158987 - DNA, 832 bp, Homo sapiens
  misc_feature: GYAE6OF01ELM2L.22.9.A09.1.454.CMB.1.raw
tcagacatacgcgtcacgaccggtgctcgatttagcgagacgcgcagggggaggaactgctcagttaggacccagagggaaccatggaagccccagcctcagcttctcttcctcctgctactctggctccagacgaccaccggagaagttgtgttgacactacgtttccacgccctaccctgttctttgtctccgaggagacggccggcccaccctctcctgcgacggccaagtggatagttatacgacgtacttacttacgcctaggtaccaacgacggtacggcctcggccgacggtcctacccgaggtcctacctactatagtactgtactcgtaccgttaaccgaaacgggtcccacgtacgacctaccgtacccgacggtaccgttacgggttcgtaacggtcggtacggtagggtacgggtcggtacgggtaacaggttacgtcgtaccttaccgtacctaccgagtccgaacgtccgacgtccgtacgcgtttacgtacgttaacgttaaggtttactttacggtaacttttaagttttaacgttacggttacgttacgaacgttacttaaagtttaacggtttaaccgttaccgggtaccgggtttaccccggttacccggggttaacccgggtttacccggggaaaccggttaaaccggggttaaaccgggtaacggggttaaaccggtaaaccggtaacggtaaaaccgttacgggtacggttacccgggtacgtttaaccgacccgtttacccgttaacttcccggttacggttttacccttaccgttacccgtttaccccgttaccgtacccgttaacgg

SEQ ID NO: 158988 - DNA, 827 bp, Homo sapiens
  misc_feature: GYAE6OF01DDVPH.22.9.A09.1.454.CMB.1.raw
  modified_base (617)..(617): a, c, t, g, unknown or other
  misc_feature (617)..(617): n is a, c, g, or t
tcagacatacgcgtcacgaccggtgctcgatttagcgagacgcgcagggggaggaactgctcagttaggaccagagggaacatggaagcccagcgtcagtcttctcttcctctgctactctggctccaggacttaattacgtggagtacgttcgtcttggacgcacgtcctccgacggtcctacccgttggtcctcgttacgtccgtaccggaaacgggggaaacgccgtaccctaacccgttcgtaccggttaggtaaccgggaccttaacggtacgaagttaaagttaacggttaaaccaaaactaagggtaaacttacgttaggtaaacgtccggttaggtactacacggaccgaaggaaccgtacgtacgtaccgtacgttccgttacccgttccgtaccttccggtttacggtttcggacgtacccgggtacgaccggaccgggtaccgacgggacctaccgttccgtacgaacacgttatcgtaaggtcggacggtacggtcggggttacgcgaacgtacgtctcgtacggtactaccgtacgtcggtacggcggttacgtaacggtaacaggtaacgtagtcgtacggtactacgttacttaacgtcgtntaactacgttacgttacgttacgtttaacgtacccgtacgttcccgtaagtcgttaccgttaccgggtacgggacgggtaaccgggtacctaacgggtacgtaaccggggtataaccggtaaccgtaaaaccgggttatacggggtacccgcgttaccggtaacccggtaattccgttacccggtttagtttccgttaacccgttcccgg

SEQ ID NO: 158989 - DNA, 783 bp, Homo sapiens
  misc_feature: GYAE6OF01EW80I.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggcctcccagagaccaccggagaagttgtgttgacactacgtttccagccctacccttgttctttgtcctccgaggagacggccgggcccacccgtctccgtcgcgacgggaccaatggaagtagtagtacgccgtaaccttacgttacgcccgttacggtaacccaaagacggacggtcccgtaggcccacgggtccctaccccgacggtccctcctactagttacggtataggtactcgtaaccgttaaccgaaaacgggtccctacggtcgacctaccgtacccgacgtacccgtaggttaccgtggtcggacgtaggggttacgggtacgtaagggacgtaccggtaccttacgtacccttactacctaaccctataacccgaacgtaccggtacccgttaacggacgtaccgtacggtaacgtcgtttaccgttagtaaccgtttaagttttaaccgttacgttacgtacgtaccgtacgtaccggtaaccgtaacgtacgggtccgtacccgtttaccggttaccgttaccggggaccggtaaccgggacctaacggtcggaggtacgtacgtaacgtcggtaacgtacggttcggtcggaccgtcgaccgtacctacgttcctacgtttacttccctccgttcccggtacccg

SEQ ID NO: 158990 - DNA, 798 bp, Homo sapiens
  misc_feature: GYAE6OF01D5BSJ.22.9.A09.1.454.CMB.1.raw
  modified_base (357)..(357): a, c, t, g, unknown or other
  misc_feature (357)..(357): n is a, c, g, or t
tcagacatacgcgtcacgaccggtgctcgatttagcgagacgcgcagggggaggaactgctcagttaggacccagagggaaccatggaagccccagctcagcttcctctttcctcctgcttactctcggcctcccgagacgacccgaaccggtagtaagtttggttgttagaccgtacgtacgtttaccacgtcccaccgttgtttactttcgtcctcgaggagtcggccggccctacccgttcgtccgtggcgacgggtacctaagtgaagttagtatacggacgtacttacgttcgcgtacggtaacaacgacggtcgcgcggtaccgacggtcccgtccgacggtccttacctntacgtagttatcgttacgtacggtacctaaaccgggaaccggtaccgtacggtacgtacctacccgtacccgacgtacgtaggttcgtacgggtacggtacgtacgggttcgggttaggtaaccggtagtaccgtacccgttactaaccgttcctaccgaaccgtaacgttaaccggaaacctaaacccggtacggttaaccgtaccgtaccgtaaccggtacgttacgtttaccgttacgtaactttaacggttttacgttacgttcgtacgtacggtccgttaacgtacggttaaccgtaccggtaccgttcgttaccgtttccgggttaccggtaccggggacgtacgtacgtacggtacggaacgtacggacgtacgagtacggttagcgtacgtacgcgtaactcgttcgttcgtaccttctcccgttctacccgg

SEQ ID NO: 158991 - DNA, 617 bp, Homo sapiens
  misc_feature: GYAE6OF01CR1SK.22.9.A09.1.454.CMB.1.raw
  modified_base (194)..(194): a, c, t, g, unknown or other
  misc_feature (194)..(194): n is a, c, g, or t
  modified_base (209)..(209): a, c, t, g, unknown or other
  misc_feature (209)..(209): n is a, c, g, or t
  modified_base (251)..(251): a, c, t, g, unknown or other
  misc_feature (251)..(251): n is a, c, g, or t
  modified_base (275)..(276): a, c, t, g, unknown or other
  misc_feature (275)..(276): n is a, c, g, or t
  modified_base (314)..(314): a, c, t, g, unknown or other
  misc_feature (314)..(314): n is a, c, g, or t
  modified_base (391)..(391): a, c, t, g, unknown or other
  misc_feature (391)..(391): n is a, c, g, or t
tcagacatacgcgtcacgaccggtgctcgatttagcgagacgcgcagggggaggaactgctcagttaggacccagagggaaccatggaagccccagctcagcttctctcctcctgctactctggactcccagagaccaccggagaagttgtgttgacactagtttccagcccaccctgtctttgtctcgagagngcggccacctctccngcagggccaatgagtgtatagcactacttagcttcggacacngagcctggccaggctccagcctcnnctgatcgatcgtacttaccgaaaggccacgcggctacncccaggcctagttcgaacggtcggacgtacgggttggtacgtaggtaccgaaggtagtttccgactcgtacacctanccgacgctacgcctgaccgtagttctaaggtaagttacgtttgtacgttaactttacgttctagttacacgtacctaattaacttaagtccgtacgttacccgtacgtttacgttaggttccggtacggaacgggtactaggcgtaggtactaaacgtacgtaacgtacgttggtagtaccgacgtacgaacttacgtacgttgttacccttcgttacgtccccgg

SEQ ID NO: 158992 - DNA, 1022 bp, Homo sapiens
  misc_feature: GYAE6OF01CYRH3.22.9.A09.1.454.CMB.1.raw
  modified_base (163)..(163): a, c, t, g, unknown or other
  misc_feature (163)..(163): n is a, c, g, or t
tcagacatacgcgtcacgaccggtgctcgatttagcgagacgcgcagggggaggaactgctcagttaggacccagagggaaccatggaagccccagctcagcttctcttcctcctgctacctctggctcccagacgaccaccggagaagttgtgttgactacncgtttaccacgcccaccgttgttctttgtcctccaggagacgccggcccaccctctcctcggacgacgggacctagtaccaggtagtacggttacgaccaaacgtaacgtttacgtccgtacggtaaccgtagaccgtacggacgtaccggtcggacccgacggcccctacccggaccggtccttacccgtaccgacgttaccgttaacggttaccgggtttccggtaccgttttacccgtaaaccccgggtaccgggtaccccggttaaaccggttacccggtttaccccgttaccccccccggtaccgtttaaccggggttaccccgtacggttaccccgggtacccggttaacgggttacccgggggttccggttaaccgggggaacggttaaccggttaacgggtttacccctaacccttaaccccgttacccgtaaacccgtacgtttacccgaaccggtacccgttacccggacccgttaccgaaccggtttaaccgttaaccggtaacggtttaaacggtttaacgttttccccgtttaaccggtttacgttttttaaaccgtttaccgttaccgttaacgtaacccgtaaaccgtaatttaaaccggttaaacgtttaccgggttaaccggtttacggtttccggttaaacccgttcccggttaaccccgttaacccgggtaccggttaaaacccgggaaccggtaaccgtaaccgggttacccgggtaagttaaaacccggtaaacgttaaaccgggtaaccggttggttaaccggtccgttaccggtaaccccttaaacgtcccgtttaaccgttacccggtttccttccggttacccgtttacccccg

SEQ ID NO: 158993 - DNA, 884 bp, Homo sapiens
  misc_feature: GYAE6OF01ENHWG.22.9.A09.1.454.CMB.1.raw
  modified_base (178)..(178): a, c, t, g, unknown or other
  misc_feature (178)..(178): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggcctcccagacgaccaccggagaagttgtgttgacatagtttccagcccacctnttctttgtctccgaggagacgccgggcccaccctcgtcctcgcgacgggaccaagtacggagtaagtagttagaccgtaaccttacgttaacgccgtacgggtaaacccaaacgaacgggtacggtaccccgtgggacccgtaacggtccccgtaaccccgcgggtacccttcccgtactagtacggttaagtacgtactccgtaaccgtttaaaccgggaaaaaccgggccctaacggtcggacctaaccgtacccctacgggacccttagggtttacgaacggtcggtaccggtaggggttcggttacgtaacgggtaaaggaccgttaaccttacgtaccgttcctaacaaaccgtactaaccgaacgaaccgtaccgtaacgcggtaccctacggtacgttaacgttcgtacgttaacgtttaaggttttaactaccgttagttacgaacgtccgtaaccggtaaccgttaccgtaacgggttacccgtaccggttacccgtttaaccgggtttacgggaaccccggggtaacggggtaccgtaaaccggtcgggtttacgggaaaggttccgaaaccggtaaacgggtaaacccggttaacgttacggggttcggaccggtttaccggaaccgttaaccccgttaacgtttccttaacccgttacccggtttcttaaaccccggtttccccgtaacccccg

SEQ ID NO: 158994 - DNA, 768 bp, Homo sapiens
  misc_feature: GYAE6OF01DG7ZE.22.9.A09.1.454.CMB.1.raw
  modified_base (713)..(713): a, c, t, g, unknown or other
  misc_feature (713)..(713): n is a, c, g, or t
tcagacatacgcgtcacgaccggtgctcgatttagcgagacgcgcaggggggaggaactgctcagttacggaccagagggaaccagtggaacgccccagctcagtcttctcttcctctgtctactctcggcctccagacgaccgacggagtagttgtgttacgactacgtagttccacgtccctaccgttgttactttcgcctccgaaggacgacggtccggtaccctacccgttctccgtcggacggacggactagtggaacgtagtacgtacgcgttaacttcgttacggccgtacggaaccagacggacgccggtacgaccgtacggcctaccggtagtcccttaccgtatacggtttgtacgtacgacttacggtaccgttaaacggacggtacctagtcggtacaccgtccgactcgtaggtcgagtcggtagtacggggttggacgttaaggacgtacgtttaccgtacttcccgtaactacccgtaactaccgtaacgacgtaccgtaaccggtataccgtacgtacgttcgtacttacgttacgttagtttaacgttacgttacgtacgtcgtaacgtacgtacgtaaccgtaccggttacgccgggtttaccgttaccggttacggttaccgggacggtaccgggtaccgacggttaacggacggtaacgtcgaaccggtacgggtaacgtaacggccggttanacgtccgttaccgtacgtaccttacgtccgtttactaccttccgtccgttaaccg

SEQ ID NO: 158995 - DNA, 673 bp, Homo sapiens
  misc_feature: GYAE6OF01AG97Y.22.9.A09.1.454.CMB.1.raw
  modified_base (224)..(224): a, c, t, g, unknown or other
  misc_feature (224)..(224): n is a, c, g, or t
  modified_base (254)..(254): a, c, t, g, unknown or other
  misc_feature (254)..(254): n is a, c, g, or t
  modified_base (288)..(288): a, c, t, g, unknown or other
  misc_feature (288)..(288): n is a, c, g, or t
  modified_base (296)..(296): a, c, t, g, unknown or other
  misc_feature (296)..(296): n is a, c, g, or t
  modified_base (328)..(328): a, c, t, g, unknown or other
  misc_feature (328)..(328): n is a, c, g, or t
  modified_base (362)..(362): a, c, t, g, unknown or other
  misc_feature (362)..(362): n is a, c, g, or t
tcagacatacgcgtcacgaccggtgctcgatttagcgagacgcgcagggggaggaactgctcagttaggacccagagggaaccatggaagcccccagctcagcttctcttcctcctgctactctggctcccagagaccaccggagaagttgtgttgacacagtttccagcccaccctgtctttgtctccaggagagccgggccaccctctcctgcagggccaangagagtatagcactactagcctggtaccanagacggcctggccaggtcctcccgaggcctcctnactgtatnatcgtacgtaaccgaaggccagtgacactccngctaggttacagtggctggtcggtcgtagggaangtaccttcacctctacaccatacaccgtacgaccgtagcgtccgtagtaccgtacttcgtacgtacgtttatttacgtttacgtcgttaccgaggccgtacggtacccggtacgtacggttcccggtacccgtttccggttaccgggtttccgggaccggggtaaccgggggaccttaacgggtaccgttacggggaacgtaccgtaccggtaaacgggtaacccgtaacgggttcggtacggcgttaccggaccctaccgtcttaccggttccgttacccgtttcctacccgtttccccgttacccccgg

SEQ ID NO: 158996 - DNA, 859 bp, Homo sapiens
  misc_feature: GYAE6OF01BIUM9.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggcctcccaagacgaccgaccggagtaagttgtgttgacactacgtttccagtccctacccgttgtttcttttcgtacctccgaaggaggacggcccgggtaccctacccgttccttaccgtcggaccgacgggtacctaaagttggaagttaagttaagtttacgaccggttaacctttaaccgtttacggaccccgtttaacggtaaaacccaaacggtaacgggaccggtaccgtacgggaccgtaacgggtccccgttacccgaacgggtccctaccgtactaacgttagttacgtagagttacggtaccgttaacgaaaacggtccaacgtcggactacgtaccagtaccgtaacggttacgaacggttacggacgttacggttcggtacggttaacggaaacggtaacgttaaccgttaccgttaacctaccctaacaaccccgtaactaactaaaccggaccttaacgtacgtaacgtaccgttaacgacgttacgttcgtacgttacgtaacgttttaattccgtagtacgtacgtacgtaacggtacgtacggttaacgtaccgtaccggttaaccgttacgtttaccgggtacggtacgggtaaacctacgggacttacgggaacgtacgtaccgtaaggaaccggttaagtcgggtacgtaccggtcgaccgtacccgtacgtttacccgtacttaccgttaccttaccgttccgttaacccccg

SEQ ID NO: 158997 - DNA, 546 bp, Homo sapiens
  misc_feature: GYAE6OF02F97XK.22.9.A09.1.454.CMB.1.raw
  modified_base (377)..(377): a, c, t, g, unknown or other
  misc_feature (377)..(377): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcggggccacccgtctaccgtgcagggccaatgagagtattagcgactacttagcctggtaccaacagaggcctggccaggctcccaggctcctcatgtatgatgcttaccaaaagggccactggcatcccagccaggttcagtgcagtggtctggaagagacttcactctcaccatccaaacncgcctagacgcctgacgattctgctagtttattactgtcagcagtccgtaacaaggtcggccttccgtacgttttcggaccgtacgggggtaccaagtccgtgggagtacgtcacgacgaacgtggtacggtcgtcggcctaccgatcgtgttcgttctacttcttccg

SEQ ID NO: 158998 - DNA, 519 bp, Homo sapiens
  misc_feature: GYAE6OF02JEKAW.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttccaaaagggccactggcatcccagccaggttcagtgcagtggtctggaagagacttcactctcaccatccaacagcctagacgcctagacgtattctgactagtttacttactgtcagcagcgtacagtcgccttccgtactttcggccgacggggccagcgtaggagagtacgagacgacgtggtaggctcgacacgatctgttccttctacttcctcccg

SEQ ID NO: 158999 - DNA, 503 bp, Homo sapiens
  misc_feature: GYAE6OF02HA6QH.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaaggttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttccaaaagggccactggcatcccagccaggttcagtggcagtggtctggaagagacttcactctcaccatcaacagcctagacgcctgacgattctgcagtttattactgtcagcagcgtacaagtcgcctccgtactttggccgaggggccaagcgtaggagatcagacgaacgtggtggctgcaccatctgtctcatcctcccg

SEQ ID NO: 159000 - DNA, 498 bp, Homo sapiens
  misc_feature: GYAE6OF02IK0VB.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgctccaggagagcgggccaccctctcctgcagggccaatgagagtattagcgactacttagcctggtaccaacagaggcctggccaggctcccaggctcctcatgtatgatgcttccaaaagggccactggcatcccagccaggttcagtggcagtggtctggaagagacttcactctcaccatcaacagcctagagcctgacgattctgctagttattactgtcagcagcgtaccaagtggcctccgacttttggccaggggccaagctggagatcagacgaacgtgtggctgcaccatctgtctctactctcccg

SEQ ID NO: 159001 - DNA, 510 bp, Homo sapiens
  misc_feature: GYAE6OF02G2U8X.22.9.A09.1.454.CMB.1.raw
tcagacatacgcgtcacgaccggtgctcgatttagcgagacgcgcgagggggaggaacgtcgctcagttaggacccagagggaaccatggaaggccccagctcacgcttctcttcctcctgctactctggctcccgagagaccaccgggacgaaggttgtgttgacacagtttccagccaccctgtctttgtctccaggagagcgggccacccgtctcctgcagggccaatgagagtattagcgactacttagcctggtaccaacagaggcctggccaggctcccaggctcctcatgtatgatgcttccaaaagggccactggcatcccagccaggttcagtggcagtgggtctggaagagacttcactctcaccatcaacagcctagagcctgacgattctgctagtttatactgtcagcactataataactggcctccgtactagttttggccaggggaccaagctggagatcaagactgtggctgcaccatctgtcttcatctcccg

SEQ ID NO: 159002 - DNA, 519 bp, Homo sapiens
  misc_feature: GYAE6OF02GVITH.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttccaaaagggccactggcatcccagccaggttcagtggcagtggtctggaagagacttcactctcaccatcaacagcctagacgcctgacgtattctgctagtttatactgtcagcagcgtaccaagtcggcctccgtacgttttcggccgtaggggaccaagcgtaggagacgtcgagacgaacgtggcggtctgcacgactcgtgtcttcactccttcccg

SEQ ID NO: 159003 - DNA, 569 bp, Homo sapiens
  misc_feature: GYAE6OF02GKSRE.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactactagcctggtaccaacagaggcctggccaggctcccaggctcctcatgtatgatgcttaccgaaaagggccactggcatcccagccaggttcagtggcaggtggtctggaagagtacttcactctcacctatacaacagcctagacgcctagacgattctgctagtttattactgtcagcacgaccgtaacaggtcggccttccgtacgttttcgggaccgtacggggccctaaggcgtagggagtacgtcgagacgtaacgtgggtacggtccgtcgtaccaccgtacgttccgttacggttaccttaccgtacttcccgttacccccgg

SEQ ID NO: 159004 - DNA, 532 bp, Homo sapiens
  misc_feature: GYAE6OF02H6RTF.22.9.A09.1.454.CMB.1.raw
  modified_base (373)..(373): a, c, t, g, unknown or other
  misc_feature (373)..(373): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttccaaaagggccactggcatcccagccaggttcagtggcaggtggtctggaagagacttcactctcaccatccaacngcctagagcctgacgatctgctagtttattactgtcagcagcgttacgaagtcggcctccgtacttttcgggcccgtagggggcccaaggcgtagggagagtacaggaccgaacgtggtcggctggaccaccatcctcgttcttctacgtcttaccccg

SEQ ID NO: 159005 - DNA, 501 bp, Homo sapiens
  misc_feature: GYAE6OF02F4W0M.22.9.A09.1.454.CMB.1.raw
  modified_base (484)..(484): a, c, t, g, unknown or other
  misc_feature (484)..(484): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttccaaaagggccactggcatcccagccaggttcagtggcaggtggtctggaagagacttcactctcaccatcaacagcctagagcctgacgattctgctagtttatactgtcagcagcgtaccaagtcgcctccgactttcggaccgaggggccaagctaggagagtcagacgaactggtgctgcacntctgtctcatcctcccg

SEQ ID NO: 159006 - DNA, 501 bp, Homo sapiens
  misc_feature: GYAE6OF02G3G9S.22.9.A09.1.454.CMB.1.raw
  modified_base (371)..(371): a, c, t, g, unknown or other
  misc_feature (371)..(371): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttccaaaagggccactggcatcccagccaggttcagtggcagtggtctggaagagacttcactctcaccatcaacngcctagacgcctgacgattctgctagtttattactgtcagcagcgtacagtcggcctccgtactttcggccgaggggccaagctggagatcgagacgacgtggtggctgcacatctgtctcactctcccg

SEQ ID NO: 159007 - DNA, 628 bp, Homo sapiens
  misc_feature: GYAE6OF02H7YMS.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctccgaggctcctcatgtatgatgcttaccgaaaaggccatggcactccagccagttcagtgcagtggtctgggacagagttcactctcaccatcagcacgcctgcagtctagaagtacgttttgacttaagtttatttacctgttacgtacgactaacctaaataaactaaaccgttcggtacccttacccggtaactacgggtttttccggacccgtaaggggtaaccccgtaaagtccgtagggaacgtactaccgaaaaccggtaacgtttaacgggtcggtaccgtttacgggacccaacccgttaactttccggttaccgtttaccggtttaacctaccgtttaccccccgg

SEQ ID NO: 159008 - DNA, 507 bp, Homo sapiens
  misc_feature: GYAE6OF02FPLKK.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttccaaaagggccatggcatcccagccaggttcagtggcagtggtctggaagagacttcactctcaccatcaacagcctagacgcctgacgattctgctagtttattactgtcagcagcgtacagtcggcctccgtactttcggccgaggggccaagcgtggagatcgagacgacgtgtggctgcacctactctcgtcttcacttctacccg

SEQ ID NO: 159009 - DNA, 546 bp, Homo sapiens
  misc_feature: GYAE6OF02J0XYL.22.9.A09.1.454.CMB.1.raw
  modified_base (352)..(352): a, c, t, g, unknown or other
  misc_feature (352)..(352): n is a, c, g, or t
  modified_base (374)..(374): a, c, t, g, unknown or other
  misc_feature (374)..(374): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttccaaaagggccacgtggcatcccagcccaggttcagtggcaggtggtctggaagngacttcactctcaccatcaacncgctagacgcctagacgtatctgacctagtttatactgtcagcagccgtaacgagtcggcctccgtacttttcggccgaggggccaagcgtaggacgtatccgagacgtaacgtggtcggtactcgactacccgagttccgttagttaccttccgtactcccgtttaccccg

SEQ ID NO: 159010 - DNA, 506 bp, Homo sapiens
  misc_feature: GYAE6OF02G0OA2.22.9.A09.1.454.CMB.1.raw
  modified_base (499)..(499): a, c, t, g, unknown or other
  misc_feature (499)..(499): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttccaaaagggccactggcatcccagccaggttcagtggcagtgggtctggaagagacttcactctcaccatcaaacagcctagagcctgacgattctgctagtttattactgtcagcagcgtaccaagtcggccttccgacttttggccgacgggggccaagctggagatcgagacgacgtggtggctgcacatctgtctctntctcccg

SEQ ID NO: 159011 - DNA, 504 bp, Homo sapiens
  misc_feature: GYAE6OF02GMXUL.22.9.A09.1.454.CMB.1.raw
  modified_base (350)..(350): a, c, t, g, unknown or other
  misc_feature (350)..(350): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttccaaaagggccactggcatcccagccaggttcagtggcaggtggtctggaagngacttcactctcaccatcaacagcctagagcctgacgattctgctagtttattactgtcagcagcgtacagtggcctccgactttggccgtaggggccagcgtaggagatcagacgacgtggtggctgcaccgatctgtctctactcttccccg

SEQ ID NO: 159012 - DNA, 496 bp, Homo sapiens
  misc_feature: GYAE6OF02H94HK.22.9.A09.1.454.CMB.1.raw
  modified_base (493)..(493): a, c, t, g, unknown or other
  misc_feature (493)..(493): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttccaaaagggccactggcatcccagccaggttcagtggcagtggtctgggacagagttcactctcaccatcagcagcctgcagtctgaagattttgctatttattactgttcagcaatataatgactggttctcgatcaccttcgccaagggacacgactggagagtaaacgaactgtgctgacacatctgtccttntac

SEQ ID NO: 159013 - DNA, 498 bp, Homo sapiens
  misc_feature: GYAE6OF02G57D8.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttccaaaagggccactggcatcccagccaggttcagtggcagtgggtctggaagagacttcactctcaccatcaacagcctagagcctgacgattctgcagtttattactgtcagcagcgtaccaagtggcctccgacttttggccgaggggccaagctggagatcagacgacgtgtggctgcacatctgtctcatcttcccg

SEQ ID NO: 159014 - DNA, 511 bp, Homo sapiens
  misc_feature: GYAE6OF02IW27Q.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttccaaaagggccactggcatcccagccaggttcagtggcagtggtctggaagagacttcactctcaccatcaacacgcctagacgcctgacgtattctgctagtttattactgtcagcagccgtacagtcggcctccgtacgtttcggccgaggggccaagcgtggagatcgagacgacgtggtggctgcaccatctgtcttctactccttcccg

SEQ ID NO: 159015 - DNA, 509 bp, Homo sapiens
  misc_feature: GYAE6OF02GOMV4.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttccaaaagggccactggcatcccagccaggttcagtggcagtggtctggagagacttcactctcaccatcaacagcctagagcctgacgattctgcagtttattactgtcagcagcgtaccaagtggcctccgacttttggcctagggggccaaggctaggagactcgagacgaacgtggtaggctgcacctatctgtcttctatcttccccg

SEQ ID NO: 159016 - DNA, 613 bp, Homo sapiens
  misc_feature: GYAE6OF02JHVNR.22.9.A09.1.454.CMB.1.raw
  modified_base (373)..(373): a, c, t, g, unknown or other
  misc_feature (373)..(373): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttaccaaaagggccactggcatcccagccaggttcaggtgcaggtggtctggaagagacttcactctcacatcaaacngacctagacgccctgaccgtattcgtgtactaagtttattacgtgttacgagtcgacgtccgtaacctaaggtccggacccttaccggttaaccgttttcgggacccggaacgggggtaccctaaaggtccgtagggtaacgacgttaccgacgtaaccggtaaccgttcgggtacgccgttacggaccctaaccgtacgttacgttccggttctttaccgtacttcccgttacccccgg

SEQ ID NO: 159017 - DNA, 575 bp, Homo sapiens
  misc_feature: GYAE6OF02IEG5G.22.9.A09.1.454.CMB.1.raw
  modified_base (365)..(365): a, c, t, g, unknown or other
  misc_feature (365)..(365): n is a, c, g, or t
  modified_base (399)..(399): a, c, t, g, unknown or other
  misc_feature (399)..(399): n is a, c, g, or t
  modified_base (418)..(418): a, c, t, g, unknown or other
  misc_feature (418)..(418): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggcaccctctcctgcagggccaatgagagtattagcgactacttagcctggtaccaacagaggcctggccaggctcccaggctcctcatgtatgatgcttaccgaaaaggggccacgtgcatcccagccaggttcagtggcaggtggtctggaagagacttcgacttcncacatacaacagcctagacgcctagacgtattcngtactagtttatctgtacngtcagtcctaacagtcgcgtccgtagtttcggaccggtaggggacccaaggtccgtaggaacgtacgtacgaacggaccggtaacgtcgggtaggtacctacggaccaaccgtcgttaccgtgtttacccgttaaccttccttacccgtttcccccg

SEQ ID NO: 159018 - DNA, 523 bp, Homo sapiens
  misc_feature: GYAE6OF02GPNHN.22.9.A09.1.454.CMB.1.raw
  modified_base (355)..(355): a, c, t, g, unknown or other
  misc_feature (355)..(355): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctccaggctcctcatgtatgatgcttaccaaaagggccactggcactcccagccaggttccaggtggcaggtgggtctgggaagngtacttcactctacaccatacaacagcctagacgcctgacgattctgctagtttattactgtcagcagcgtacgaagtcggcctccgtactttcggccgacggggtccaagcgtggagagtcgagacgacgtggtggctcgcacacttctgttctctactccttcccg

SEQ ID NO: 159019 - DNA, 579 bp, Homo sapiens
  misc_feature: GYAE6OF02IOW4D.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcacgggccaatgagagtattagcgactacttagcctggtaccaacagaggcctggccaggctcccaggctcctcatgtatgatgcttaccgaaaagggccactggcatcccagccaggttcagtggcagtggtctggaacgagtacttcacgtctcaaccgatacaacagccctagacgcctgacgtattctgtacgtagtttaattactgtacagtacacgtccgtaacgtaacgtcggtacctacccgtacgttttcggccgtaacgggggccgtaacgacgtacggaacgtattaccgacgtaacgtaacgtacggtcggtacgtcgaccgaccacgtcttcgttcgtactcgttaccttccccg

SEQ ID NO: 159020 - DNA, 524 bp, Homo sapiens
  misc_feature: GYAE6OF02JZ8CG.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctccaggctcctcatgtatgatgcttccaaaagggccactggcatcccagccaggttcagtggcagtgggtctggaagagacttcgactctcaccataccaacagcctagacgctagacgtatctgctagtttatactgtcagacagaccgtactagtcgtctccgtactttcggcgagggtccaagcgtaggagatcgagacgaacgtggtcggcgtcgacgacctgtacgtcgttcttcacgttcctacccg

SEQ ID NO: 159021 - DNA, 499 bp, Homo sapiens
  misc_feature: GYAE6OF02FHWFU.22.9.A09.1.454.CMB.1.raw
  modified_base (411)..(411): a, c, t, g, unknown or other
  misc_feature (411)..(411): n is a, c, g, or t
  modified_base (481)..(481): a, c, t, g, unknown or other
  misc_feature (481)..(481): n is a, c, g, or t
tcagacatacgcgtcacgaccggtgctcgatttagcgagacgcgcgagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggcctcccaggctcctcatgtatgatgcttccaaaagggccactggcatcccagcagttcagtggcagtggtctggaagagacttcactctcaccatcaacagacctagacgcctgacgattctgctagtttatactgtcancagcgtacagtgcctcgacgtttgccgaggggccaaggctaggagatcgagacgacgtggtgctgcaccntctgtctcatccttcccg

SEQ ID NO: 159022 - DNA, 530 bp, Homo sapiens
  misc_feature: GYAE6OF02I8HJQ.22.9.A09.1.454.CMB.1.raw
  modified_base (508)..(508): a, c, t, g, unknown or other
  misc_feature (508)..(508): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggcctcctcatgtatgatgcttaccaaaagggccactggcactcccagccgtaggttcagtggcgaggtcgggtctggaagtagacttcactctacacctatacaacagctagagcctagacgtatctgactagtttatactgtcagcagcgtacagtcggcctaccgtacgtttcggccgtacggggccaagcgtaggagatcgacgacgtacgtggtacgcgtcgcgacnctcgtcgtcttcactcctcccg

SEQ ID NO: 159023 - DNA, 583 bp, Homo sapiens
  misc_feature: GYAE6OF02GQ9WR.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggcctcctcatgtatgatgccttaccgaaaaacgggccaacgtggacactccccgagcccgaggttcaggttcggctaggtgggtctagggaaagagtacttcactctcaccatcaacacgcctagacgcctgacgtattctgtctagtttattactgtcagcacgtccgtaacgaagtcgtcccgttccgtacgttttcggaccgtacgggggtaccaacggcgtacggagtacgtacgacgaccgtaacgtcggtacggtctcgccgtacctacgtcgtcgttaccttctacttccgttaccccg

SEQ ID NO: 159024 - DNA, 580 bp, Homo sapiens
  misc_feature: GYAE6OF02GR1XZ.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccagctccaggctcctcatgtatgatgcttaccgaaaaggccactggcactcccagccaggttcagtggcgaggtggtacgtaggaagagtacttcactctacaacctataccaaacacgacctagactcctagacgtattcgtagtactagtttatacgtgtcagcgacgtacgtaccgtaaggtccggccgttaccggtacgtttcgggaccggtacggggacctaagtcggtagacgagtacgagtacgaagtggtacgtcctacgcctaaccgtacttcgttccgtccttacgtaccgttcccgttacccg

SEQ ID NO: 159025 - DNA, 509 bp, Homo sapiens
  misc_feature: GYAE6OF02GMHDV.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctccaggctcctcatgtatgatgcttccaaaagggccactggcatcccagccaggttcagtggcaggtggtctggaagagacttcactctcaccatccaacagacctagacgcctagacgattctgctagtttattactgtcagcagcgtacagtggcctcgtacgtttggccgtaggggccaagcgtggagatcgagacgaacgtggtcggctgccacactctgtctctatcctcccg

SEQ ID NO: 159026 - DNA, 522 bp, Homo sapiens
  misc_feature: GYAE6OF02H3FS7.22.9.A09.1.454.CMB.1.raw
  modified_base (512)..(512): a, c, t, g, unknown or other
  misc_feature (512)..(512): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggcctcccaggcctcctcatgtatgatgcttaccgaaaagggccacgtggcatcccagccaggttcagtggcagtggtctaggagagactttcactctcacatcaacacgcctagagcctgacgtatctgctagttattactgtacagcagacgtacagtcggcctccgtacgtttcggccgtacggggccaagcgtaggagatacgagacgacgtgtcggctcgacacgactctgttcttacnctccttcccg

SEQ ID NO: 159027 - DNA, 587 bp, Homo sapiens
  misc_feature: GYAE6OF02GGGRI.22.9.A09.1.454.CMB.1.raw
  modified_base (395)..(395): a, c, t, g, unknown or other
  misc_feature (395)..(395): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttccaaaagggccactggcactcccagccaggttcagtggcaggtggtcgtgggacagacttcactctcaccatcagcacgcctagacgcctagaaagtntttgacttagtttattactgtacagtcgagtcgtagcctaacctccctacgtacggttccgggacgggtaacgggaccgaaagggtggaagtagtaaccgtaaaacggtacgttaggtacgggcttacggaccgtaaccctacgttccgtacgttcctttaccgtactttcccgttacccggtaccctaacg

SEQ ID NO: 159028 - DNA, 519 bp, Homo sapiens
  misc_feature: GYAE6OF02GBH0L.22.9.A09.1.454.CMB.1.raw
  modified_base (255)..(255): a, c, t, g, unknown or other
  misc_feature (255)..(255): n is a, c, g, or t
  modified_base (371)..(371): a, c, t, g, unknown or other
  misc_feature (371)..(371): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaanagaggcctggccaggctcccaggctcctcatgtatgatgcttccaaaagggccactggcatcccagccaggttcagtggcagtggtctggaagagacttcactctcaccatcaacngcctagacgcctgacgattctgctagtttatactgtcagcagcgtacaagtcggcctccgtactttcggaccgtaggggcctaaggtctagggacgtagtcgagtactacggtaacgtgtggctgcgacactcgtgtcttcattcccg

SEQ ID NO: 159029 - DNA, 532 bp, Homo sapiens
  misc_feature: GYAE6OF02JRPMM.22.9.A09.1.454.CMB.1.raw
  modified_base (255)..(255): a, c, t, g, unknown or other
  misc_feature (255)..(255): n is a, c, g, or t
  modified_base (284)..(284): a, c, t, g, unknown or other
  misc_feature (284)..(284): n is a, c, g, or t
  modified_base (341)..(341): a, c, t, g, unknown or other
  misc_feature (341)..(341): n is a, c, g, or t
  modified_base (352)..(352): a, c, t, g, unknown or other
  misc_feature (352)..(352): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaanagaggcctggccaggctcccaggctcctnatcgtatgatgcttaccgaaaaggccactggcatcccagccaggttcagtggctagnggtctggaagngtacttcactctcaccatacaacagcctagacgcctagacgattctgctagtttattactgtctagcagtcgactagtgcctcgtacgtttcggccgaggggccaagtcgtcggagtacgtacagaccgaacgtggtgacgtcgaccgtaccgatcgtacgtcttcgtactccttacccg

SEQ ID NO: 159030 - DNA, 1094 bp, Homo sapiens
  misc_feature: GYAE6OF02IWNR9.22.9.A09.1.454.CMB.1.raw
tcagacatacgcgtcacgaccggtgctcgatttagcgagacgcgcaggggaggaacgtgcctcacgttaggaccctacgaagggaaccattcggaagtccccgagctcagcttctctacctctgcgtactctcggctcccgagtaggaccaccggagaagtttggtttcgtttggtacctacgtacgttttacccgaaggtccctaaccccctgtttcctttttggttccttcccgaggtaaggacggtccggggtcccgtaaccccgttccggggtcccgttcggtccggtaaccgggggcccccgggtaaattcggaaacggaacgtttacgtttaaccggtcggtaaccgttaaccgtttaacggcccccgtttacggggttaaacccctaaaccgaagggtaacggttaccccgttaccgggacccgtaaccgggttcccggttccccccgttaacgggtacccgtttcccccggtttccccgaaccgttacggttaccgtttccggtaaggttacggggtacccttttacccgggaaaaaacgggggtccccgaaccgttcggggtaccctaacgtttacccccgtacggtaccccgtttaacgggttttaccggtaacggggttacgggtaccgttacggggtttccggggttaccggtttacggggttaaaccggtaacgggttaacccgttttacccgtaccgtttccgttaccgaacccggtaccgttaaccgttaaaccgaaccggtacccgttaacgtacccgtaccgtaacggtaaccgttaacgtttacccgtaacgtaaccgtttaaccgttttaacgttaccgttaccgttaccgtaaccggtacgtaacggttacccggttaaacccgtaaaccgggttaccgggtaccccgttaacccggttaaccggttttacccggggaacccggtaaccgggggtacccgttaaacggtaccggtttaacggtaacgtacgttacgacgtaaccggtaacgttacggttacggtacgtccgtaaccgtaaccgttacggttccggttacggttccgtttacgtaccgtttcccgttacccccgg

SEQ ID NO: 159031 - DNA, 575 bp, Homo sapiens
  misc_feature: GYAE6OF02HCTNZ.22.9.A09.1.454.CMB.1.raw
  modified_base (378)..(378): a, c, t, g, unknown or other
  misc_feature (378)..(378): n is a, c, g, or t
  modified_base (400)..(400): a, c, t, g, unknown or other
  misc_feature (400)..(400): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggcctcctcatgtatgatggcttaccgaaaagggccatcggcatcccagccaggttcagtgcaggtggtctggaagagactttcacgtctcaccatcaaacngacctagacgcctgacgattcngctagtttattactgtcagcagtccgtaacctaaggtcggtcctccggttacttttcgggaccgtagggggaccctaaggccgtaggaagacgttaccgagacggtaacgtggtacggtcgttacggacctaccgactttaccgtggttacctttactacgttccgttacccccg

SEQ ID NO: 159032 - DNA, 507 bp, Homo sapiens
  misc_feature: GYAE6OF02IDG69.22.9.A09.1.454.CMB.1.raw
  modified_base (433)..(433): a, c, t, g, unknown or other
  misc_feature (433)..(433): n is a, c, g, or t
  modified_base (477)..(477): a, c, t, g, unknown or other
  misc_feature (477)..(477): n is a, c, g, or t
  modified_base (487)..(487): a, c, t, g, unknown or other
  misc_feature (487)..(487): n is a, c, g, or t
tcagacatacgcgtcacgaccggtgctcgatttagcgagacgcgcaggggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagagcctggccaggctcccaggctcctcatgtatgatgcttccaaaagggccactggcatcccagccaggttcagtgcagtgggtctggaagagacttcactctcaccatcaacagcctagagcctagacgattctgctagtttattactgtcagcagcgtacagtcgcctaccgtntttggaccgacggggccaaggcgtggagatacgagacgacgtgnggctcgcacnctcgtgtcttcactctcccg

SEQ ID NO: 159033 - DNA, 505 bp, Homo sapiens
  misc_feature: GYAE6OF02GGO1K.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttccaaaagggccactggcatcccagccaggttcagtggcagtggtctggaagagacttcactctcaccatcaacagcctagacgcctgacgattctgctagtttattactgtcagcagcgtacaagtggcctccgtacttttcggccgtacggggccaagcgtggagatcgagacgacgtggtgcgtgcacatctgtctcactctcccg

SEQ ID NO: 159034 - DNA, 600 bp, Homo sapiens
  misc_feature: GYAE6OF02JTQDM.22.9.A09.1.454.CMB.1.raw
  modified_base (255)..(255): a, c, t, g, unknown or other
  misc_feature (255)..(255): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaanagaggcctggccaggctcccaggctcctcatgtatgatgacttccaaaagggccacgtggcatcccagccaggttcaggtgcaggtggtctggaagagacttcgactcgtcaccagtacaacacgtacctagacgccctagacgtattcagtctagtttaactctcgtctagcgtacgtacgtaaccgaagtcgggccttaccggtacttttcgggaccgtacgggggtcctaaacggtcgtacgggaagtacgtacgacggtaacgtaacgtcgggtacggaccgtacggacctaaccgtacgttcccgttaggttaccctttactacgttccccgttaccccg

SEQ ID NO: 159035 - DNA, 509 bp, Homo sapiens
  misc_feature: GYAE6OF02JE04J.22.9.A09.1.454.CMB.1.raw
  modified_base (351)..(351): a, c, t, g, unknown or other
  misc_feature (351)..(351): n is a, c, g, or t
  modified_base (357)..(357): a, c, t, g, unknown or other
  misc_feature (357)..(357): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttccaaaagggccaactggcatcccagccaggttcagtggcagtgggtctggaagngacttnactctcaccatcaacagcctagacgcctagacgattctgcagtttattactgtcagcagcgtacaagtcggcctccgtactttcggccgaggggccaagctggagagtcgagacgacgtggtacgctgcacactctgtctctactcttcccg

SEQ ID NO: 159036 - DNA, 496 bp, Homo sapiens
  misc_feature: GYAE6OF02I3V92.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttccaaaagggccactggcatcccagccaggttcagtggcagtggtctaggaagagtactcactctcaccatcaaacacgcctagacgcctgacgattctgctagtttatactgtcagcagcgtaccagtgcctcgtactttgccgaggggcagcgtggagatcgagacgagtgtgctgcacatctcgtctcactctcccg

SEQ ID NO: 159037 - DNA, 531 bp, Homo sapiens
  misc_feature: GYAE6OF02FUX54.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttaccaaaagggccactggcatcccagccaggttcagtggcagtggtctggaagagacttcactctcaccatcaacagcctagacgcctgacgattctgctagtttattactgtcagcagcgtaccagtcggccttccgtacgttttcggccgtaggggccaagcgtggagatacgagacgaacgtggtcggtactcgacaccgacttcgttcgttctttctacttccttaccccg

SEQ ID NO: 159038 - DNA, 497 bp, Homo sapiens
  misc_feature: GYAE6OF02GM7A4.22.9.A09.1.454.CMB.1.raw
  modified_base (393)..(393): a, c, t, g, unknown or other
  misc_feature (393)..(393): n is a, c, g, or t
  modified_base (479)..(479): a, c, t, g, unknown or other
  misc_feature (479)..(479): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttccaaaagggccactggcatcccagccaggttcagtggcagtgggtctggaagagactttcactctcaccatcaacagcctagagcctgacgattcngctagtttatactgtcagcagcgtacagtggcctcgactttggccgaggggcagctggagatcgagacgaactggtggctgcacgntctgtctctactctcccg

SEQ ID NO: 159039 - DNA, 529 bp, Homo sapiens
  misc_feature: GYAE6OF02G25EK.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggcctcctcatgtatgatgcttaccaaaagggccactggcactccccgcaggttcagtgccagtgggtctggggacagagttcactctcacatcagcagcctgcagtctgaatattttgctactttattactgtcagcagtataattactgcctcggacgttcggaccaagggacctaaggtggaagtaaccgaaacgaacgtgtaggacgtgaccacatccttagtcttaccattccttcccgcctataccg

SEQ ID NO: 159040 - DNA, 580 bp, Homo sapiens
  misc_feature: GYAE6OF02I4ZWZ.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttaccgaaaagggccactggcatcccagccaggttcagtggcaggtggtctggaagagacttcactctacaccatacaacacgcctagacgcctgacgtattctgtctagtttattactgtcagcacgcgtaccagtcggcctaccgtacgtttcggaccgtacggggccaaggtcgtaggaagacgtaccgagaccggtaacgtcgggtcggtaccgtcggacccgtaacccgtacgttaccgttcggttaccctttaccgtaccgtttcccgttaccccccgg

SEQ ID NO: 159041 - DNA, 574 bp, Homo sapiens
  misc_feature: GYAE6OF02IEBCD.22.9.A09.1.454.CMB.1.raw
  modified_base (375)..(375): a, c, t, g, unknown or other
  misc_feature (375)..(375): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttaccgaaaagggccaactggcactcccagccaggttcagtggcagtggtctggagagactcactctacaccatccaacncgcctagacgcctagacgtacttctgtactagtttacttacgtgttacacgcacgccgtaaccaacggtcggtacccttccggtacgttttcgggaccgtacgggggacctaacggcgtacggagtagtacaggaccgtaacgtggtacgcgtcgaccgaccgtattccgtcgttccttccgtacttcccgttaccccg

SEQ ID NO: 159042 - DNA, 501 bp, Homo sapiens
  misc_feature: GYAE6OF02GOXX0.22.9.A09.1.454.CMB.1.raw
  modified_base (350)..(350): a, c, t, g, unknown or other
  misc_feature (350)..(350): n is a, c, g, or t
  modified_base (361)..(361): a, c, t, g, unknown or other
  misc_feature (361)..(361): n is a, c, g, or t
tcagacatacgcgtcacgaccggtgctcgatttagcgagacgcgcagggggaggaactgctcagttaggacccatagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttaccaaaagggccactggcatcccagccaggttcagtggcagtggtctggaagngacttcactcncacatcaacagacctagagcctgacgattctgctagtttattactgtcagcagcgtacagtcgctcgtactttcgcgagggcagctggagatgacgacgacgtggtacgcgtgcactactctgtcttctacttcctcccg

SEQ ID NO: 159043 - DNA, 561 bp, Homo sapiens
  misc_feature: GYAE6OF02I94UC.22.9.A09.1.454.CMB.1.raw
  modified_base (355)..(355): a, c, t, g, unknown or other
  misc_feature (355)..(355): n is a, c, g, or t
  modified_base (368)..(368): a, c, t, g, unknown or other
  misc_feature (368)..(368): n is a, c, g, or t
  modified_base (391)..(391): a, c, t, g, unknown or other
  misc_feature (391)..(391): n is a, c, g, or t
  modified_base (549)..(549): a, c, t, g, unknown or other
  misc_feature (549)..(549): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctgtgtctccaggggaaagagccaccctctcctgcagggccagtcagagtgttagcaacaacttagtctggtaccagcagagacctggccaggctcccaggctcctcatctatggtgccttctaccagggccactggtactccccgctaggttcagtcgccaggtggtctgggacagngttcactctcacntcagcagcctgcagtctgaagtntttgctactttatactgtcagtcaattataatgtacgttggttctacgtatccgtaccgtttacggccgtaaagggaccaacgtaccgttaggagtaacgttaaaccggaacttggtacggtacttcggacctacctacgttccgttggttccctttnaccgtttccccg

SEQ ID NO: 159044 - DNA, 510 bp, Homo sapiens
  misc_feature: GYAE6OF02HRUTV.22.9.A09.1.454.CMB.1.raw
  modified_base (351)..(351): a, c, t, g, unknown or other
  misc_feature (351)..(351): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttaccaaaaagggccactggcatcccagccaggttcagtggcagtggtctggaagngacttcactctcaccatcaacagcctagagcctgacgattctgctagtttattactgtcagcagtcgtacgaagtcggcctccgtactttggccgaggggccaagcgtggagagtcgagacgacgtgtggcgtgctacactctgttctctatcctcccg

SEQ ID NO: 159045 - DNA, 660 bp, Homo sapiens
  misc_feature: GYAE6OF02JM9AX.22.9.A09.1.454.CMB.1.raw
  modified_base (260)..(260): a, c, t, g, unknown or other
  misc_feature (260)..(260): n is a, c, g, or t
  modified_base (424)..(424): a, c, t, g, unknown or other
  misc_feature (424)..(424): n is a, c, g, or t
tcagacatacgcgtcacgaccggtgctcgatttagcgagacgcgcagggggaggaacgtgctcagttaggacccagagggaaccatggaagccccagctcagcttctcttcctcctgctactctggctcccagagaccaccggagaagttgtgttgacacagtttccagccaccctgtctttgtctccaggagagcggccaccctctcctgccagggccaatgaagagttattagcgaactacttagcctggtaaccaanagaggcctggccaggcctcccgaggcctcctcatgtatgtatgccttccaaaacgggtcccaacgtcggacacgtcccagccaggttcaggtaggctaggtggtacgtggaagagtacttcgacctctacacctacgtccaaacgtgaccctaagacgccgtanaacggtaactttcgtgaccttagtttaacgttacttcgtaccgtagtcccgtaacgtaccgttaccaaacggtcggtacccgttaccggttaaccgttttcggacccggtaacggggggtaccctaacgggtcgttacgggacgttaagtccgaacggtacggtaacgttcgggtaggtcttcggaccgtaccgtaacttcgtaccgtttccgtacgttacccttccgttaccccg

SEQ ID NO: 159046 - DNA, 551 bp, Homo sapiens
  misc_feature: GYAE6OF02F1RF2.22.9.A09.1.454.CMB.1.raw
  modified_base (255)..(255): a, c, t, g, unknown or other
  misc_feature (255)..(255): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaanagaggcctggccaggctcccgaggctcctcatgtatgatgcttaccgaaaacgggccacgtcggcactcccagcctaggttcagtggcaggtggtctggaagagacttcactctcaccatacaacacgctagacgcctgacgattctcgtactagtttattactgtctagcagcgtaacagtcggtcctccgtacgtttcgggaccgacggggtaccaacgcgtaggacgatacgagacgtaacgtggtggcgtcgacaccgtactcgttacgtccgttctacgttccttaccccg

SEQ ID NO: 159047 - DNA, 549 bp, Homo sapiens
  misc_feature: GYAE6OF02HW3Q7.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttaccgaaaagggccacgtggcatcccagccaggttcagtggcaggtggtctaggaagagacttcactctacaccatacaacacgcctagagcctagacgtattctgctagtttattactgtcagcagacgtacaagtcgcctccgtacgtttcggaccgtacggggccaagtccgtaggagagtaccgagaccgtaacgtggtcggcgtcgaccacgtacttcgtcgttccttacgtacttcccgttaccccg

SEQ ID NO: 159048 - DNA, 515 bp, Homo sapiens
  misc_feature: GYAE6OF02F1UY3.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttccgaaaagggccactggcatcccagccaggttcagtggcagtggtctggaagagacttcactctcaccatacaacacgcctagacgcctgacgattctgctagtttattactgtcagcagtcgtacagtcggcctcgtactttcggccgacggggccaagcgtggacgatacgagacgacgtggtgacgtgacaccatctgtcttctactccttcccg

SEQ ID NO: 159049 - DNA, 558 bp, Homo sapiens
  misc_feature: GYAE6OF02IDAB6.22.9.A09.1.454.CMB.1.raw
  modified_base (350)..(350): a, c, t, g, unknown or other
  misc_feature (350)..(350): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaaatgagagtattagcgactacttagcctggtaccaacagaggcctggccaggctcccgaggcctcctcatgtatgatgcttcaaaagggccactggcatcccagccaggttcagtgcagtggtctggaagngactttcactctcaccatccaacagcctagacgcctgacgtattctgctagtttattactgtcagcagccgtacagtcggccttaccgtacttttcggccgtacggggccaaggcgtggaacgtagtcacggaccggaacgttggtacggtccgtgtacccgaccgtacgtaccgttgttacccttttcaccgttcccgttaccccgg

SEQ ID NO: 159050 - DNA, 499 bp, Homo sapiens
  misc_feature: GYAE6OF02F6517.22.9.A09.1.454.CMB.1.raw
  modified_base (371)..(371): a, c, t, g, unknown or other
  misc_feature (371)..(371): n is a, c, g, or t
  modified_base (472)..(472): a, c, t, g, unknown or other
  misc_feature (472)..(472): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctccaggctcctcatgtatgatgcttccaaaagggccactggcatcccagccaggttcagtggcagtggtctggaagagacttcactctcaccatcaaacngcctagagcctgacgattctgctagtttattactgttcagcagcgtacagtcggtcctcgtactttggccgaggggccaagctggagatcagacgacgtgnggctgcacatctgtctctatcctcccg

SEQ ID NO: 159051 - DNA, 549 bp, Homo sapiens
  misc_feature: GYAE6OF02IHTMU.22.9.A09.1.454.CMB.1.raw
  modified_base (403)..(403): a, c, t, g, unknown or other
  misc_feature (403)..(403): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggctggcaggctcccaggctcctcatgtatgatgcttaccgaaaagggccacgtggcactcccagccaggttcagtggctaggtggtctaggaagagacttcactctcaccactacaaccagcctagacgcctagactattcgtnacgtagtttattactgtcagtcagtccgtaacagtcgaccttcgtacgtttcggccgtacggggcctaacgcgtaggcgtagtacgacggaacgtacgtggtcgcgtcgccaacgtactcgttgttccttctactcccgttacccg

SEQ ID NO: 159052 - DNA, 529 bp, Homo sapiens
  misc_feature: GYAE6OF02GK0X5.22.9.A09.1.454.CMB.1.raw
  modified_base (347)..(347): a, c, t, g, unknown or other
  misc_feature (347)..(347): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttccaaaagggccactggcatcccagccaggttcagtgcagtggtctggaangacttcactctcaccatccaacacgcctagacgcctgacgtattctgtctagtttattactgtcagcagcgtacagtcggcctccgtactttcggccgtacggggccgaacgcgtaggagacgtacgagacgaacgtggtaggtctcgacacctacgtctcgttccttctactccttacccg

SEQ ID NO: 159053 - DNA, 534 bp, Homo sapiens
  misc_feature: GYAE6OF02GTTI8.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttccaaaagggccacgtggcatcccagccaggttcagtggcaggtggtctggaagagacttcactctcaccatccaacacgcctagacgcctgacgattctgctagtttattactgtcagcagtcgtacagtcggcctccgtacgtttcggccgtaggggccaagcgtaggacgtatcgagaccgacgtggtacggcgtcgacctaccgacttcgtcgttcttcctacttccttccccg

SEQ ID NO: 159054 - DNA, 518 bp, Homo sapiens
  misc_feature: GYAE6OF02GQZYF.22.9.A09.1.454.CMB.1.raw
  modified_base (350)..(350): a, c, t, g, unknown or other
  misc_feature (350)..(350): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttccaaaagggccactggcatcccagccaggttcagtggcaggtggtctggaagngactttcactctcaccatcaacagcctagagcctgacgtattctgctagtttattactgtcagcagcgtacagtcggcctcgtacgtttcggccgtaggggcctaagcgtggacgatcgagacgacgtggtacggcgtgccaccatcgtgttctctacttcctccccg

SEQ ID NO: 159055 - DNA, 549 bp, Homo sapiens
  misc_feature: GYAE6OF02H85J3.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaaatgagagtattagcgactacttagcctggtaccaacagaggcctggccaggctcccaggctcctcatgtatgatgcttccgaaaagggccactggcatcccagccaggttcagtggcaggtggtctggaagagacttcactctcacatcaacacgctagagcctagacgattctgtctagtttatactgtcagcagcgtaaccaagtcggcctccgtacgttttcggccgacgggggtaccaagtcgtaggaacgtataccgaggaccggtaagtggtacggtcgtcgacgaccgtatcgttcgttaccttactacttccgttaccccg

SEQ ID NO: 159056 - DNA, 722 bp, Homo sapiens
  misc_feature: GYAE6OF02ILK7O.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagacggcctggccaggcctcccaggcctcctcatgtatgatgaccttaccgaaaaacggggtccaacgtcggacacgtccccaggtccaggttcaggtcggcgtaggtgggtctagggaagacggtacttacgacttccgtacaacctaactaccaaaccgacgtacccgtaaggacgtcccgtaacggaacgtacgtttaccgtaggtaccttaaagttttacttacgtggttacaacggtaccgtaacggtacgttaacccgtaaagggtccggtaccccgttaccggttaccggtttttacggggaccccggtaagggggggtaccctaacgggtccggttaaggggacgtaacgttaccggaacggtaacccggtaacgttgggtaccgggtctacgggtacccctaaccggtacgttcccgttacggtttcctttaccgtcccgtttccccgttacccccgg

SEQ ID NO: 159057 - DNA, 500 bp, Homo sapiens
  misc_feature: GYAE6OF02FHBAE.22.9.A09.1.454.CMB.1.raw
  modified_base (369)..(369): a, c, t, g, unknown or other
  misc_feature (369)..(369): n is a, c, g, or t
  modified_base (481)..(481): a, c, t, g, unknown or other
  misc_feature (481)..(481): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttccaaaagggccactggcatcccagccaggttcagtggcagtggtctggagagactcactctcaccatcaacngcctagacgctgacgattctgctagtttatactgtcagcagctacagtcgcctcgtactttcggccgtaggggccaaggctggagtatcagacgacgtgtggcgtgcaccgntctgtcttctattctcccg

SEQ ID NO: 159058 - DNA, 573 bp, Homo sapiens
  misc_feature: GYAE6OF02III9E.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagagcctggccaggctcccaggctcctcatgtatgatgacttaccgaaaaaggggcccaacgtggaccactaccccagcccaggttcagtggcaggtcgggtctggaagagacttcactctcaccatacaacacgcctagacgcctagacgtattctgactagttattactgtacagcagaccgtaacaagtcgtcctaccgtacgttttcggaccgtagggggaccaagtcgtaggacgactacgagacgtaacgtggtacggcgttacggactaccgtattcgttacggttacctttactacgttcccttaccccg

SEQ ID NO: 159059 - DNA, 592 bp, Homo sapiens
  misc_feature: GYAE6OF02HKBRQ.22.9.A09.1.454.CMB.1.raw
  modified_base (198)..(198): a, c, t, g, unknown or other
  misc_feature (198)..(198): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctgtgtctccgaggggaaagngccaccctctcctgcagggccagtcagagtgttagcaaactaacttagtctggtaccagcagagacctggccaggcctcccaggcctcctcatctatggtgcttctaccgagggccacgtcggtactcccccgctaggttccaggtcgccgaggttcgggtctggggaacaggtacgttcactctcaaccatccagcacgcctagcagtcagtaagtattttgactttactttattctgtacagtactaaataataatgtacttgggtttctacggtaattccctaccgttacggaccgaaagggtaccaacgtacgtaggacgtaaacgttaaacggacttggtacggtcctacgacctaccgtatccgtttacgtacctttacacttccccg

SEQ ID NO: 159060 - DNA, 514 bp, Homo sapiens
  misc_feature: GYAE6OF02HCIXI.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttccaaaagggccactggcatcccagccagttcagtggcagtggtctggaagagacttcactctcaccatcaacagcctagagcctgacgattctgctagtttattactgtacagcagcgtaccaagtggcctccgacttttcggccacgggggccaagccgtggagatcgagacgaacgtcggtggctgccaccgatcgtgttcttcacttcttcccg

SEQ ID NO: 159061 - DNA, 571 bp, Homo sapiens
  misc_feature: GYAE6OF02IBVJD.22.9.A09.1.454.CMB.1.raw
  modified_base (377)..(377): a, c, t, g, unknown or other
  misc_feature (377)..(377): n is a, c, g, or t
tcagacatacgcgtcacgaccggtgctcgatttagcgagacgcgcagggggaggaactgctcagttaggacccagacggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttaccgaaaagggccactggcatcccagccaggttcagtggcaggtgggtctggaagagacttcactctacaccatccaacngacctagacgtcctagacgtattctgtctagtttaacttacttgtacagacacgacgtacagtcgcctaccgttacgttttcggaccgtacggggccgaagtcgtaggaacgtacgtacgacggtacgtaacgtggtaggtacgtacggtaccaaccgtcttacgttcgttaccttctaccttccgttaccccg

SEQ ID NO: 159062 - DNA, 590 bp, Homo sapiens
  misc_feature: GYAE6OF02JOQKP.22.9.A09.1.454.CMB.1.raw
  modified_base (256)..(256): a, c, t, g, unknown or other
  misc_feature (256)..(256): n is a, c, g, or t
  modified_base (432)..(432): a, c, t, g, unknown or other
  misc_feature (432)..(432): n is a, c, g, or t
tcagacatacgcgtcacgaccggtgctcgatttagcgagacgcgcagggggagggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaanagaggcctggccaggcctcccgaggcctcctcatgtatgatgcttaccgaaaagggccacgtggacactcccagccaggttcaggtcggcaggtcggtctaggaagagactttcgactctcaccatcaacagtcctagacgacctagacgtattcgtagtctagtttacttacgtnttcagtctagaccgtacagtcgccgtaccgtacgtttcgggaccggtacggggaccaaggtcgtacggaagtacgtacgacggtacggtaacgtcggtacggtcgtacgaccgtaccgtacgttcgtacgttccttacgtaccgttcccttaccccgg

SEQ ID NO: 159063 - DNA, 551 bp, Homo sapiens
  misc_feature: GYAE6OF02H73WB.22.9.A09.1.454.CMB.1.raw
  modified_base (347)..(347): a, c, t, g, unknown or other
  misc_feature (347)..(347): n is a, c, g, or t
  modified_base (376)..(376): a, c, t, g, unknown or other
  misc_feature (376)..(376): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatcgcttaccgaaaagggccactggcactcccagccaggttcagtgcaggtggtcnggaagagacttcactctcaccatcaaacngacctagacgcctgacgtattcgtgctagtttattactgtacagacagtacgtaccagtcgcctccgtaccgttttcgccgtacggggcctaaggcgtaggagagtacgacggacgaacgtcggtcggtcgtcgacctaccgacgttcgtcgttccttactacttcccgttcccg

SEQ ID NO: 159064 - DNA, 537 bp, Homo sapiens
  misc_feature: GYAE6OF02FV30Y.22.9.A09.1.454.CMB.1.raw
  modified_base (348)..(348): a, c, t, g, unknown or other
  misc_feature (348)..(348): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctccaggctcctcatgtatgatgcttccaaaagggccactggcatcccagccaggttcagtggcagtggtctggaagngacttcactctcaccatacaacagcctagacgcctgacgattctgtctagtttacttactcgtacagcagacgtaccgaagtcggaccttccgtacgttttcgggccgagggggtccaagcgtaggagtagtcgagacgaacgtggtcggactggaccaaccgtagtctagtcttctacttccttcccg

SEQ ID NO: 159065 - DNA, 560 bp, Homo sapiens
  misc_feature: GYAE6OF02ICQGZ.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgccagggccaatgagagtattagcgactacttagcctggtaccaacagacggcctggccaggctcccaggctcctcatgtatgatgcttaccaaaagggccacgtggcatcccagccaggttcagtggcagtggtctgggaagagacttcactctcaccatacaacagtcctagacgccgtacgacgtatctgtactagtttacttactgtcagcagcgtacaagtcgcttccgtactttcggaccgtacggggacctaagcgtaggagacgtacgacggaacggtacgtggtacggacgtacgaccaccgtacttccgtacgttacctttacgtactcccgttaccccg

SEQ ID NO: 159066 - DNA, 613 bp, Homo sapiens
  misc_feature: GYAE6OF02GJUT7.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccgaggctcctcatgtatgatgcttaccgaaaagggccacgtggcactcccagccaggttcagtggcgaggtggtcgtaggaagagtacttacactctacaccataccaacacgtacctacgacgccgtagacgtattccgtagtcgttagtttacttactcgtactacgcacgtaccgtaaccgacggtccggtcccgtaccgttaccggttttccgggaccgggtaccgggggtacctaacggtcgtagggacgtacgtacgtacggaaccgtaacgtggtcggtacgtcgtaccaccgtacttcgttcgttaccttaccgtacttcccgttaccccg

SEQ ID NO: 159067 - DNA, 499 bp, Homo sapiens
  misc_feature: GYAE6OF02F8HGM.22.9.A09.1.454.CMB.1.raw
  modified_base (479)..(479): a, c, t, g, unknown or other
  misc_feature (479)..(479): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttccaaaagggccactggcatcccagccaggttcagtggcagtgggtctggaagagacttcactctcaccatcaacagcctagagcctgacgattctgctagtttatactgtcagcagctacagtcgcctcgtactttggccgaggggccaagctggagatcgagacgacgtgtggctgccacntctgtcttcacttcctcccg

SEQ ID NO: 159068 - DNA, 576 bp, Homo sapiens
  misc_feature: GYAE6OF02J196X.22.9.A09.1.454.CMB.1.raw
  modified_base (191)..(191): a, c, t, g, unknown or other
  misc_feature (191)..(191): n is a, c, g, or t
  modified_base (386)..(386): a, c, t, g, unknown or other
  misc_feature (386)..(386): n is a, c, g, or t
  modified_base (546)..(546): a, c, t, g, unknown or other
  misc_feature (546)..(546): n is a, c, g, or t
  modified_base (552)..(552): a, c, t, g, unknown or other
  misc_feature (552)..(552): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggnagccgggccaccctctcctgcagggccaatgagagtattagcgacttacttagccctggtaccaacagaggcctggccaggcctccaggcctccgtcatgtatgatgcttacaaacggccacgtggacactcccagccagttccagtcgcagtggtctagggagacgtactcgaactcgtacaaccgatccaacncgacctagacgtacctgacgtattctcgactaacgtttatacgtgtacatcagtcccgtactaacgtcggtcctaccggtactttcggaccggtaggggccctaaagtcgtacgggagtattccggagtacgtaaccgtggtcgacgtcgaccaaccgtnttccgngttacctctacttcccttacccgg

SEQ ID NO: 159069 - DNA, 523 bp, Homo sapiens
  misc_feature: GYAE6OF02GB7MB.22.9.A09.1.454.CMB.1.raw
  modified_base (196)..(196): a, c, t, g, unknown or other
  misc_feature (196)..(196): n is a, c, g, or t
  modified_base (484)..(484): a, c, t, g, unknown or other
  misc_feature (484)..(484): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagaaaccaccggagaagttgtgttgacacagtctccagccaccctgtctttgtctccaggggaaangccaccctctcctgcagggccagtcagagtgttaactactacttagcctggtaccaacagaaacctggccaggctcccaggctcctcatctatgatgcatcttacagggccactggcatccccagccaggttcagtggcaggtgggtctgggacagacttcactctcaccatcagcagcctagagcctgaagtatttgactagtttattactgtcagcagcgtagctaacctccctcgacgttcggcgggacgggaccgaagggtcggaagactacgaaacgacgtgnggcgtggaccacgatctcgtcttcactcctcccgctatc

SEQ ID NO: 159070 - DNA, 520 bp, Homo sapiens
  misc_feature: GYAE6OF02FMRCC.22.9.A09.1.454.CMB.1.raw
  modified_base (362)..(362): a, c, t, g, unknown or other
  misc_feature (362)..(362): n is a, c, g, or t
  modified_base (373)..(373): a, c, t, g, unknown or other
  misc_feature (373)..(373): n is a, c, g, or t
  modified_base (382)..(382): a, c, t, g, unknown or other
  misc_feature (382)..(382): n is a, c, g, or t
  modified_base (501)..(501): a, c, t, g, unknown or other
  misc_feature (501)..(501): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggcctcccaggcctcctcatgtatgatgcttccaaaagggccactggcatcccagccaggttcagtggcagtggtctggaagagacttcactcncaccatcaacngacctagancctgacgattctgctagtttatactgtcagcagcgtaaccaagtcggaccttccgtacgttttggccgtagggggcctaaagcgtaggagactcgagacgaagtggtcgcgtgcacctntctgtcttcattcctcccg

SEQ ID NO: 159071 - DNA, 510 bp, Homo sapiens
  misc_feature: GYAE6OF02FLZMI.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttccaaaagggccactggcatcccagccaggttcagtgcagtggtctggaagagacttcactctcaccatacaacagcctagagcctgacgtattctgctagtttattactgtcagcagcgtacagtcggcctccgtacgtttcggccgtaggggcctaagcgtggagatcgagacgacgtggtagcgtgcaccatctcgtctctactcctcccg

SEQ ID NO: 159072 - DNA, 667 bp, Homo sapiens
  misc_feature: GYAE6OF02IB7B9.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcgagggccaatgagagtattagcgactacttagcctggtaccaacagaggcctggccaggctcccgaggcctcctcatgtatgatcgtacttaccgaaaacgggtccaacgtggcacgtcccagccgtaggttcgagtcggactaggtggtacgtaggaagacgtacttcgaactcgtaccaaccgtataccgaaacgacgtaccgtaacgacgtaccgtacggtaaccgtaacttccgttacgttacgttaacgtttaacttaacgttgttacgacgtacgtacgtaccgtaacgtaacgtcggtaccttaccggttacgttttcgggaccggtacggggtaccgtaacgtcgtacggaagtacgtacgacggtaacgtacgtacggtacggacgtaccggaccgtaccgtacgttcggtaccgttacgttaccgtaccgttacccgttaccccg

SEQ ID NO: 159073 - DNA, 648 bp, Homo sapiens
  misc_feature: GYAE6OF02IQDT8.22.9.A09.1.454.CMB.1.raw
tcagacatacgcgtcacgaccggtgctcgatttagcgagacgcgcaggggggaggaactgctcagttaggacccagagggaaccatggaagccccagctcagcttctcttcctcctgctactctggctcccagagaccaccggagaagttgtgttgacacagtttccagccaccctgtctttgtctccaggagaggcgggccaccctctcctgcagggccaatgagagtattagcgactacttagcctggtaccaacagaggcctggccaggctcccaggctcctcatgtatgatgccttaccgaaaagggccacgtggcactcccagccaggttcaggtggcaggtgggtctagggaaagacgacttcacgttctaccacctactaccaaacgtacgaccctagacgcctagacgtatttctggtactagtttaacttaacgtcgttacacggcgtacgtaccgtaaccgtaacggtcgggtcccttaccggttaaccgttttcgggaccgggtacgggggaccctaaagggtccggtacgggaagtacgtaccgaacggtaaccggtaacgtcgggtaggtaccgttaggacccaaccgtacgttaccgttcggttaccttaccgttaccttcccgttacccccgg

SEQ ID NO: 159074 - DNA, 797 bp, Homo sapiens
  misc_feature: GYAE6OF02IXRE1.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctagcagggccaatgagagtattagcgactacttagcctggtaaccaacagacggcctggccaggcctcccgaggctccgtcatgtactgattcgccgttaccgaaaagggtcccaacgttgggacctacgtacccccaaggtcccctaagggtttccaaggttcgggacctagggttcggggttcccggtaggggaaaggtaccggtaaccttttacgaacccgtttaccgtacccgtaaaccctacttaaccgtaaacctaccggtaccgttaacggaaccgtacccgtacggtaacgtaacgtttccgtacgtaccgttaagtttaacgtttacgttacgttaccgtacgtacgacggtaccgttaaccggtaacggttaccgggtaccccgtttaccggttaccgtttttaccgggacccgggtaaccgggggtacccgtaaacggtcggtacgggtaacggtaacgttaccgggtacggtaacccggtaaccggttacggttaccggtaccgtaccggtaccgtaacccgtacgttcccgtttcggttacccgtttacttaccccgtttcccgttaacccccgg

SEQ ID NO: 159075 - DNA, 555 bp, Homo sapiens
  misc_feature: GYAE6OF02I9BRC.22.9.A09.1.454.CMB.1.raw
  modified_base (383)..(383): a, c, t, g, unknown or other
  misc_feature (383)..(383): n is a, c, g, or t
  modified_base (407)..(407): a, c, t, g, unknown or other
  misc_feature (407)..(407): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagagcctggccaggctcccaggctcctcatgtatgatgtcttaccgaaaacgggccacgtggcactcccagcctaggttcaggtggcaggtgggtctaggaagagtacttcactctacacatacaacncgctagacgcctagacgtattcgngtactagtttatactgtcagcacgtaccgtaccgagtcggccttaccgtacgtttcggccgtacgggaccacgtcgtaggatacgtacgacgacgtacgtggtacggctcgccaccgtctcttcgttccttctaccgttccttccccg

SEQ ID NO: 159076 - DNA, 566 bp, Homo sapiens
  misc_feature: GYAE6OF02HHQ75.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatctatgttgcatccagcagggccactcggtaccccagccaggttcagtggacagtgggtctggggacagtacgttcacgtctcaccatcagcacgcctgcagtctagaagtatttgctagtttattactgttcagtcgtataataattacgtcggtccgtacggtacggttccggaccgaacgggtaacctaagggtacggaaagtacctaaacgacgtggtacggctcggaccaacccgtagttccttaggtccttactacttcccttcccgaccttacg

SEQ ID NO: 159077 - DNA, 693 bp, Homo sapiens
  misc_feature: GYAE6OF02JBU3S.22.9.A09.1.454.CMB.1.raw
  modified_base (283)..(283): a, c, t, g, unknown or other
  misc_feature (283)..(283): n is a, c, g, or t
  modified_base (304)..(304): a, c, t, g, unknown or other
  misc_feature (304)..(304): n is a, c, g, or t
  modified_base (319)..(319): a, c, t, g, unknown or other
  misc_feature (319)..(319): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcaggccaatgagagtattagcgactacttagcctggtaccaacagaggcctggccaggcctccaggctcctnatgtatgatgtcttcgaccgnggccacgtggtaccnccccgaccgtaggttccaggtcgccgtaggtcgggtcgtaggggaactaggtacgtttccacttccgtaccaaccctatccgacgctacggtccctggcgtaacgttcctaaggtaaacgtttagtttttacgacctttaaacttttaattaccgttagtttaccgaagtaacctaaatttaacttaaagttacggttaaccgtttcggtttaccgttacgtaacttacccgttaacccgtttccgggaaccgtaaacgggaccgtaaccggtaacgtagggaacgttaaacgttaaaccggtaacgttcggtacggtaccgtagaccctaaccgtagttcccgttacgttacctttaccgtaccgtttccccg

SEQ ID NO: 159078 - DNA, 611 bp, Homo sapiens
  misc_feature: GYAE6OF02H49VM.22.9.A09.1.454.CMB.1.raw
  modified_base (567)..(567): a, c, t, g, unknown or other
  misc_feature (567)..(567): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctccccagagaccaccggagaagttgtgttgacacagtttccagccaccctgtctttgtctccaggagagcgggccaccctctcctgcacgggcaatgagagtattagcgactactagctaggtaccaacagaggcctcggccaggcctcccgacggcctcctcactgtatgatcgaccttaccgaaaacgggccaacgtcggcactcccagaccaggttccagtgggctaggtggtacgtaggaagtacgtacgttactaactcgacctaaccgataccaacacgacctagacgccgtgaaccgtaatttcagtctaagtttattactgttacagactagaccgttaacgaacgtcggtaccgtaccgttacgtttacgaccgtaggggtaccaaggccgtaggtacgacgtacgaacggtaccgacggttcggtcggacnccgacacctactcgttcgttaccttctaccgttccgttaccccg

SEQ ID NO: 159079 - DNA, 602 bp, Homo sapiens
  misc_feature: GYAE6OF02GOA8J.22.9.A09.1.454.CMB.1.raw
  modified_base (347)..(347): a, c, t, g, unknown or other
  misc_feature (347)..(347): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagagcctggccaggctcccaggctcctcatgtatgatgcttaccaaaagggccactggcatcccagccagtcagtgcaggtggtctggaagngtacttcactctacacatacaacacgacctagacgcctagacacttctgtactagtttacttactgttcagtcgagtcgtaaccagtacggtcccttaccggtacttttcggcccggtaacgggggtacccaaggtccgtaggtaccgtaagtccgtaaggtaaccggaaacgttcggtacgggtccgtacgtaccgtaacccgtaacgttccgttacggttacccttccgttaccgttcccgtttaacccccgg

SEQ ID NO: 159080 - DNA, 575 bp, Homo sapiens
  misc_feature: GYAE6OF02HTGTC.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaaatgagagtattagcgacttacttagcctggtaccaacagaggcctaggccaaggcctcccgaggcctcctcatgtatgatgccttaaccgaaaagggccaactggcatccccagcctaggttcaggtgcgtaggtggtcgtgggacagacttcgactccgtcaaccatcagcacgcctaaggacgtctagaaagtgttttgacttagtttattactgtacaagcagtacgtagaccaccttcctacgtacgttccgggacggtaggaccgaagggtgaagactaacgaacgacgtggtaggctacggacaccgtattccgtagttccttagacctttccgttcccgaccttaacg

SEQ ID NO: 159081 - DNA, 757 bp, Homo sapiens
  misc_feature: GYAE6OF02HPVUV.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcgagggccaatgagagtattagcgactacttagcctggtaccaacagaggcctggccaggcctccgaggcctcctcatgtatgatcgacttaccgaaaacgggccaacgtcggacacgtcccagacccgtaggttccaggtacggcgtagggtcggtacgtaggggaagtacgtacgtttccaacgttcctacctaaccgtacttaaccgaaccgtacgtacccgttaacggacgtcccgtagtaaccggttacttccgtaggtaaccttaagttttacttaccgtacgttacgaacgtcgtaacgtaccgtaaccgtaacggttccggtaccccgttaccggttaaccggtttttacccggggacccggggtaacggggggtaacccctaacgggtccgggtaagggtaaccgtacggtaacggtaccgggtaaacggtaccggtcggttaccggggtaccgtaccggtaacccggtaacccgttaccggtttaccggttccgtttaacccggtttccgtacccgtttaccccggtttacccccg

SEQ ID NO: 159082 - DNA, 672 bp, Homo sapiens
  misc_feature: GYAE6OF02JG6YL.22.9.A09.1.454.CMB.1.raw
  modified_base (265)..(265): a, c, t, g, unknown or other
  misc_feature (265)..(265): n is a, c, g, or t
  modified_base (429)..(429): a, c, t, g, unknown or other
  misc_feature (429)..(429): n is a, c, g, or t
  modified_base (623)..(623): a, c, t, g, unknown or other
  misc_feature (623)..(623): n is a, c, g, or t
tcagacatacgcgtcacgaccggtgctcgatttagcgagacgcgcagggggagggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctccctgcgagggccaagtcgagagttattagcgacttaccttagcctggtaacccaanagacggcctggccaggcctcccaggcctcctcatgtatgatgtccttaccgaaaagggtccctaacgtcgaccgaacttccccgaagcctacggtttccaacggttggcgtacggtaggtcgttaggacgtacgtactttcgactcgtacaccattaccgaacngacctagacgacctggaccttaagtcgtagtaccgttaagtttactaccgttacgtactaacgtcgtacgtaccggtaaccttaacgggtcgtacccgttacccgttacggtttaccggcccgtaacgggggtaccctaacgggcccggttaggacgtaaacgtccgtaacggtaccgaacgttcgggtaccgngtacccgcgtaaccgtcgaccgttacgtccttccgtatccgttcccccg

SEQ ID NO: 159083 - DNA, 634 bp, Homo sapiens
  misc_feature: GYAE6OF02GKFM7.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagacggcctggccaggcctcccaggcctcctcatgtatgatgcttaccgaaaacggccactggcactcccagccaggttcagtcggcgagtggtctggaaggcgtactcactctaccaccatcaacacgccagacgcctagacgacttcgtagtctacgtttacttactcgtactaagcacgtaccgtaaccgtaacggttccggtacccgttaccggttacgttttccgggacccgggtaacgggggtaccctaacgggtcgttacgggacgtaaccgtaccgacggtaaccggtaacgtcgggtacggccgttacggacccaaccgttacgttaccgttccgtttaccgtttcccttaccgttttccccgtaacccg

SEQ ID NO: 159084 - DNA, 820 bp, Homo sapiens
  misc_feature: GYAE6OF02JYTZY.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcgagggccaagtgagagtattagcgactacttagcctggtaccaacgagaggcctggaccaggcctcccgaggtcctcctacatcgtatgatcgtcttaccgaaagggcctacgtcggacctactcccgacggtaccgtagggttcaagggttcggccgtaagggttcgggttacctaggggtaaaggacggtaccgtttcgtaacgtccgttacaacctacgttaaccgaacgtaaccggtaccgtaacggaacgtcccgttaacggaaccggttactttaccgtacggttaccgtttaacgttttaacttaccgttaggttaccgtaacggtaccgtaaccggtaccgttaacccgtaaacgggttcccgggtaccccgttccggtttaacccggttttccggggaaccccgggtaaccggggggtacccgtaaagggttccccgggttaaggggtaaccgttaaccggttacccgacgggttaacccggtaacggttcggggttaacccgcgggttaacccggacccgttaaccggttacccgtttacggtttacccggtttacccgttttaacccgtacccggttttacccccgttaccccccgg

SEQ ID NO: 159085 - DNA, 579 bp, Homo sapiens
  misc_feature: GYAE6OF02JKIIZ.22.9.A09.1.454.CMB.1.raw
  modified_base (191)..(191): a, c, t, g, unknown or other
  misc_feature (191)..(191): n is a, c, g, or t
  modified_base (250)..(250): a, c, t, g, unknown or other
  misc_feature (250)..(250): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgctccagganagcggccacctctcctgcaggccaatgagagtatagcgactacttagcctggtaccaanagagcctggccaggctccaggctcctcatgtatgatgcttaccgaaaagggccacgtggaccactcccacgcctagttcaggtgctaggtggtcaggagacgtacttcacgttcacaccataccaacacgacctagacgccgtagacgtacgttcagtactagtttactcgtagtacagacgtacgtacgtacgtaagtccgtaccgttaccgtacgtttcggaccgtaaggggtacctaacgtcgtacggagacgtcgacgtacgtacggtcggtagtacgtcgaccgtacgtacgttcgtacgttcgttactacgttcccgtacccg

SEQ ID NO: 159086 - DNA, 561 bp, Homo sapiens
  misc_feature: GYAE6OF02G2PPA.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactactagcctggtaccaacagaggcctggccaggctcccgaggctcctcatgtatgatgcttaccgaaaagggccacgtggcactcccagcctaggttcagtcggctaggtggtcgtagggaagagtaccttcacttctacacctataccaaacgtacgacctagacgccgtacgacgtaacttctagtctacgtttattactgtacacgtcgacgtcgtaacgagtcggtacctcgtacgtttcggccgtacggggaccagtcgtaggacgtatacgagacgtacgtcggtgcgtgcaccgtatctagttctactcttcctcccg

SEQ ID NO: 159087 - DNA, 632 bp, Homo sapiens
  misc_feature: GYAE6OF02IWDGO.22.9.A09.1.454.CMB.1.raw
  modified_base (192)..(192): a, c, t, g, unknown or other
  misc_feature (192)..(192): n is a, c, g, or t
  modified_base (225)..(225): a, c, t, g, unknown or other
  misc_feature (225)..(225): n is a, c, g, or t
  modified_base (352)..(352): a, c, t, g, unknown or other
  misc_feature (352)..(352): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccagganagcggccaccctctcctgcagggccaatgaagngtatagcgactactagcctggtaccaacagaggcctggccaggctccaggctcctcatggtatggatcgcttaccgaaaaggccacgtggaccagtcccagaccaggttcagtcgggcaggtcggtntacgggaacaggtaactttcgaaccttcgttacaaccgtattaccgaaaacacgtccaacgtacggcctacggaccgtagtttctaggtacgtacgtttacttaacgttcggttacctaaacgcgtaacggtaccgtacccgtaaagtcggtcccttaccgtacggtttcgacccggtacggggtacccaagtccgtaggacgtagtcacggtaacgaacggtcggtacggcacgtccgtaactacgtccttggttacccgtactagttcccttaccccg

SEQ ID NO: 159088 - DNA, 585 bp, Homo sapiens
  misc_feature: GYAE6OF02I974P.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaaccaacagaggcctggccaggctcccaggctcctcatgtatgatgcttccaaaagggccactggcactcccagcccgtaggttcaggtgcaggtggtctggaagagtacttcactctcacactcaacctgacctagagccctgacgtattctcgtctagtttacttactgtctacgacacgtaccgtaccaagtcggtacctccgtaccgttttcgggaccggacgggggtacctaaacggtcgtggtaacggactacgagtaccggtaaccgtggtacggtacgtcgaccgtaccgtacgttcgttacgttccttactacgttcccgttacccg

SEQ ID NO: 159089 - DNA, 605 bp, Homo sapiens
  misc_feature: GYAE6OF02FY1OV.22.9.A09.1.454.CMB.1.raw
  modified_base (255)..(255): a, c, t, g, unknown or other
  misc_feature (255)..(255): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaanagacggcctggccaggctcccaggcctcctcatgtatgatgccttaccgaaaacggggccacgtcggacactcccagccctaggttcaggtgcgaggtggtcgtagggaagagtactttcacttctacacctactacaacacgtcctagacgtcctacgacgtattcgtgcgttagtttaacttacgtacgttcacgactacgtacgtaacctaggtcggtcccgtacggtaccgtttcggaccggtacgggggcctaacggtcgtacggagtactcgacgtacgtaacgtcggtacggtcgtcgaccgtaccacgttccgttacgttccttcctacttcccgtaccccg

SEQ ID NO: 159090 - DNA, 533 bp, Homo sapiens
  misc_feature: GYAE6OF02GUXYU.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttccgaaaagggccactggcatcccagccaggttcagtggcaggtggtctaggaagagactttcactctcaccatcaacacgcctagacgcctgacgtattctgctagtttattactgtcagcagcgtacagtcggcctccgtacgtttcggccgtaggggccagtcgtggagtagtcgagaccgtacgtggtcggcgtgaccgacctacttcgtagttccttactactccttccccg

SEQ ID NO: 159091 - DNA, 524 bp, Homo sapiens
  misc_feature: GYAE6OF02HDT3L.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttccaaaagggccactggcatcccagccaggttcagtggcaggtggtctgggaagagactttcactctcaccataccaaacacgcctagacgcctgacgtattctgctagtttattactgtcagcagacgtacagtcgctccgtacgtttggccgaggggaccaaggcgtggagagtcgagacgaacgtggtcggctcgacactactctcgtcttctacttccttcccg

SEQ ID NO: 159092 - DNA, 620 bp, Homo sapiens
  misc_feature: GYAE6OF02FJ1T0.22.9.A09.1.454.CMB.1.raw
tcagacatacgcgtcacgaccggtgctcgatttagcgagacgcgcaggggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaaatgagagtattagcgactacttagcctggtaccaacagagcctggccaggctcccaggcctcctcatgtactgatgacttaccaaaagggccacgtcggctactaccccagaccagggtttccaggtggcgtaggtgggtcgtggaagtgacttcacgtctcaccataccaacagcctagacgtcctgaccgtattctagtctagtttaacttactgtactagactacgccgtaaccacggtcgggtacccttacccggttacttttaccgggaccggtacggggggtacccaaccggtcgtacggagtaacgtacgtacgtacgaaccggttaggtaccgggtctcggacccgtaccaacgttcctacgttacgtttcctacgttcccgttacccccg

SEQ ID NO: 159093 - DNA, 518 bp, Homo sapiens
  misc_feature: GYAE6OF02HSMVB.22.9.A09.1.454.CMB.1.raw
  modified_base (352)..(352): a, c, t, g, unknown or other
  misc_feature (352)..(352): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttccaaaagggccacgtggcatcccagccaggttcagtggcagtgggtctgggaagngacttcactctcaccatcaacagccctagagccctgacgattctgctagtttattactgtcagcagcgtacagtcgcctccgtactttcggccgacgggggccaaggcgtggagacgtcgagtacgaacgtggtgcgtgcacgatctcgtctactactccttcccg

SEQ ID NO: 159094 - DNA, 586 bp, Homo sapiens
  misc_feature: GYAE6OF02HB3L4.22.9.A09.1.454.CMB.1.raw
  modified_base (354)..(354): a, c, t, g, unknown or other
  misc_feature (354)..(354): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctaggtaccaacagacggcctggccaggctccgaggctcctcatgtatgatgcttaccgaaaagggccaacgtggcacgtcccagcctaggttcagtggacaggtggtcnggaagagacttcactctacaccatcaacagcctagacgctagacgtacttcgtgtactagtttacttactgtctacgtactacgtaccgtaaccgtagtcggtccgttccgtacgtttcggccggacggggtacctaaggtcgtggaacgtacgtacgacgtaaccggtacgtcggtacggtacgtcgtaccaccgtacgtccgttgtacctttactacgttccgtaccccg

SEQ ID NO: 159095 - DNA, 668 bp, Homo sapiens
  misc_feature: GYAE6OF02JKVK8.22.9.A09.1.454.CMB.1.raw
  modified_base (183)..(183): a, c, t, g, unknown or other
  misc_feature (183)..(183): n is a, c, g, or t
  modified_base (274)..(274): a, c, t, g, unknown or other
  misc_feature (274)..(274): n is a, c, g, or t
  modified_base (303)..(303): a, c, t, g, unknown or other
  misc_feature (303)..(303): n is a, c, g, or t
  modified_base (309)..(309): a, c, t, g, unknown or other
  misc_feature (309)..(309): n is a, c, g, or t
  modified_base (315)..(315): a, c, t, g, unknown or other
  misc_feature (315)..(315): n is a, c, g, or t
  modified_base (470)..(470): a, c, t, g, unknown or other
  misc_feature (470)..(470): n is a, c, g, or t
  modified_base (506)..(506): a, c, t, g, unknown or other
  misc_feature (506)..(506): n is a, c, g, or t
  modified_base (620)..(620): a, c, t, g, unknown or other
  misc_feature (620)..(620): n is a, c, g, or t
tcagacatacgcgtcacgaccggtgctcgatttagcgagacgcgcagggggagaactgctcagttaggacccagagggaaccatggaagccccagctcagcttctcttcctcctgctactctggctcccagagaccaccggagaagttgtgttgacactacgtttccagtcctacctgtcttntctcgaggagacgcgggcctaccgtctaccgtgaccgaggtaccaagtcgaggacttacgtagcgaccttacgtacgcctacggtaccacncgacgcctgaccagcctcgaggtcctccncgtatntgtagntcgtccgtaaccgaaggtccgacgtgacctaccgtccgacggtccgttgtactacggtcgacggtgtcgggtacgtaacgggacgtaacgtctacacgtacccgtaacgactaacgtctaaacgcctacgacggtaccgttaccgagtaaccgtnttacggacttacggtttacttacgttaaccttcggnttaacgacttaccggtagttaaccgtaggttacccgacgtttacgtttacgttcgggaacccggagggtacctaacgcggttagaaccggttacccgagaactcggtaacggtnttacgacgtaccgattcggtacttcgtactcgttacgtttcccgaacc

SEQ ID NO: 159096 - DNA, 531 bp, Homo sapiens
  misc_feature: GYAE6OF02FKXBJ.22.9.A09.1.454.CMB.1.raw
  modified_base (255)..(255): a, c, t, g, unknown or other
  misc_feature (255)..(255): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaanagaggcctggccaggcctccaggctcctcatgtatgatgcttccaaaagggccactggcatcccagccaggttcagtgcagtggtctggagagacttcactctcaccatcaacagcctagacgcctgacgtattctgtctagtttacttactgtcagcagcgtacctagtcggcccttccgtacgttttcggccgagggggtccaagtcgtaggagatcgagacgaacgtggtggctggccaccgattcgttcgttccttcgtacttccttccccg

SEQ ID NO: 159097 - DNA, 598 bp, Homo sapiens
  misc_feature: GYAE6OF02GKDJG.22.9.A09.1.454.CMB.1.raw
  modified_base (255)..(255): a, c, t, g, unknown or other
  misc_feature (255)..(255): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaanagagcctggccaggctcccgagctcctcatgtatgatgcttaccgaaaagggccacgtggcactcccagccaggttccaggtgacgagtgggtctgggaagagactttacacttctacaacctataccaaacacgacctagtacgcctagacgtattctagactagtttatactgtacgagctagccgtaactaaggtcgacccttccggtacgttttccgggcccgacgggggtacccaaggtccgtaaggtacgtaacgtcggaacggaccgtaacgtgggtaccgtccgtacgaccgtaaccgattccgttagtcctttacaccgttcccttacccccgg

SEQ ID NO: 159098 - DNA, 664 bp, Homo sapiens
  misc_feature: GYAE6OF02HDLRY.22.9.A09.1.454.CMB.1.raw
  modified_base (346)..(346): a, c, t, g, unknown or other
  misc_feature (346)..(346): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaaccaacagaggcctggccaggcctcccaggcctcctcagtcgtatgatggtcttaccgaaaaggccacgtggcatcccagcgaggttcaggtgacnggtggtctaggaagagtactacacgtctacaaccgtactaccgaaacacggtaccctaggacgtcccgtagtaacgtacttacgttaggtaccgttaaagttttaactttaacccgtagtttacccgtaaggtaccgaaacggtaccggttaaacccgtaaacgggtcccggtacccgttaccgggttaccgtttttacggggacccgtaacggggggtacccaaagggtccgtagggacgtactaccgacgacgtacgtcggtacggtctacggtacctacgtacttcgtagtccctttactaccttcccgtacccg

SEQ ID NO: 159099 - DNA, 810 bp, Homo sapiens
  misc_feature: GYAE6OF02IA58P.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgccagggccaatgagagtattagcgactactagcctggtaccacagaggcctggcaggctacccaggctccgtcatgtactgatcggtaccttaccgaaaacgggtccaacgtggaccacttaccccgaacgtcccgaagggttttaccaggttcgggacctaaggggttcggggttaccgttagggggtaaaacggacggttaaccttttaccggaacttacccgttaccaacccgaattaccgaaacccgaacggtacccgttaacggacggtaccccgtacggaccgtaatttaccgtagtaccgttaacggttttaacttaacgtttacggtaccgtacgtacgtaacggtaccgttaacccgtaaacgggttccgggtacccgtttacccggttaccgggtttttaccgggaccccgggttaacggggggtacccgtaaacgggtaccggtagggtaaacggttacgttaccgtaacgggtaaccggtaaaccggttcgggttaaccgggtacccgttcggttaacccgaaccgttaccggttaccctttacggttttacccgtttaccgttacccgtttcccgttaccccccgg

SEQ ID NO: 159100 - DNA, 595 bp, Homo sapiens
  misc_feature: GYAE6OF02HAPM4.22.9.A09.1.454.CMB.1.raw
  modified_base (378)..(378): a, c, t, g, unknown or other
  misc_feature (378)..(378): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagacggctggccaggctcccgaggctcctcatgtatgatgctaccaaaaggccactggcactcccagcctaggtccagtcggcaggtggtctggaagagtactcactctccaccatacaaacngtacctagacgcctacgacgtattctgtacgtagtttacttacgttcgtcgacgtacacggtccgtaaccgtaacgtcggtcccttaccggtacgttttcggaccggtacggggaccgtaacggcgtacggtacgtacgtacgacgaccggtaacgtcggtacggtactcgtactacccgtacttccgttcgttccttctaccgttcccttaccccg

SEQ ID NO: 159101 - DNA, 561 bp, Homo sapiens
  misc_feature: GYAE6OF02HWLKO.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttcgagccaccctgtctttgtctccaggagagcgggccaccctctccctgcagggccaatgagagtattagcgactactagcctggtaccaacagagcctggccaggcctcccaggctcctcatgtatgatgcttaccgaaaaggggccacgtggacactcccagcctaggttcaggtggcgaggtggtctaggaagagacttcactctcaccatacaacagcctagacgcctagacgtatctgctagttattactgtacgagcgacgtacgtaacaggtcgccgtccgtacgtttcggccgtacggggccacgcgtaggagacgtacgacgacgtaacgtcggtacggcgtcgactaccgtactcgttacgttccgtttactacgttcccttaccccg

SEQ ID NO: 159102 - DNA, 567 bp, Homo sapiens
  misc_feature: GYAE6OF02GL1AN.22.9.A09.1.454.CMB.1.raw
  modified_base (357)..(357): a, c, t, g, unknown or other
  misc_feature (357)..(357): n is a, c, g, or t
  modified_base (373)..(373): a, c, t, g, unknown or other
  misc_feature (373)..(373): n is a, c, g, or t
  modified_base (379)..(379): a, c, t, g, unknown or other
  misc_feature (379)..(379): n is a, c, g, or t
  modified_base (398)..(398): a, c, t, g, unknown or other
  misc_feature (398)..(398): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagacggcctggccaggctcccgaggcctcctcatgtatgatgcttaccgaaaagggccacgtggcatcccagccaggttcaggtgcaggtggtctaggaagngactcactctcaccancaaacncgactagacgcctagacgnttctgtcgtagtttattacgtgtacgagtcacgtaccgtaaccaaggtcggcccttaccggttaccgtttcggaccggtacgggggaccaagcggtggaacgactacgagacggtaactggtacggctacgcaccgtatccgttgttccttacgtcgtcccttaccccg

SEQ ID NO: 159103 - DNA, 809 bp, Homo sapiens
  misc_feature: GYAE6OF02JLNJ4.22.9.A09.1.454.CMB.1.raw
  modified_base (277)..(278): a, c, t, g, unknown or other
  misc_feature (277)..(278): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccacgccaccctgtctttgtctcctaggagagcggccaccctctcctgcacgggccaagtgagtagtattagcgactactagcctggtacacagagctgcagctccagctctnntcgatgatcacgtaccaaacggtccacgtcgaccacgtaccccgagcccgtaaggttccgtagggtacggacgtacgggtcggtaaccgtaggggtaaagtcgttaaccgttcgaccgttactacctacctaacgttaccaaacggactttacccggtaagacccggttacccgtaaggtaaacccgtacggtttaccgtagggttaaccggttaaacttttaccgttaccgttacgtttaaccgtacgtacggtaccgttaccccggttaaagacccggtttaaccgggttacccgttacccgggtttaaccgttttacccggggtaacccggttaacccgggggtaaccctaacggggttacccgggttaacgggtaaaccgggtaccgtaaccgggttaaccgggtaaacccgggttaacgttaacccgggttcggttaaaccgggttcccgaaacccggttccgggtactttaacccgggttacggttacccgttaccggttacccgtttcccgggtttaacccccg

SEQ ID NO: 159104 - DNA, 538 bp, Homo sapiens
  misc_feature: GYAE6OF02F7VMS.22.9.A09.1.454.CMB.1.raw
  modified_base (497)..(497): a, c, t, g, unknown or other
  misc_feature (497)..(497): n is a, c, g, or t
  modified_base (535)..(535): a, c, t, g, unknown or other
  misc_feature (535)..(535): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggcctccgaggcctcctcatgtatgatgtcttacgaaaacgggccacgtggacactcccagcctaggttcagtggacgtggtggtcgtaggaagagtacttacactctacacatacaacacgcctagacgcctagacgtactctgtctagtttactactgtcagcagtcgtacagtcgcctcgtactttcggacgaacgggacgtaaggtagtaatacgaacgacgtgnggactgactacatctgtacttctacttcctcccgactntcg

SEQ ID NO: 159105 - DNA, 706 bp, Homo sapiens
  misc_feature: GYAE6OF02IBXHG.22.9.A09.1.454.CMB.1.raw
  modified_base (309)..(309): a, c, t, g, unknown or other
  misc_feature (309)..(309): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagacgaccaccggagaacgttgtgttgacacagtttccagccacctgtctttgctccaggagagcgggcaccctctcctgctagggccaagtgagagttattagcgtactacgttagccttggtaccaactaggtacggccttgggccagggactccccgaggcctcctacatggttancgtatcgtcttaaccgaaaacgggcctaacgttggacctacgtcccccgagtcccgaaggtttccaaggttcggacgtaagggtcgggtcgttaggaaacggtacgaaccttttcgacttccgtaccaccgtagtaccaacgtgcccttagacgtactacgtaacgtactttctacgtaccgtagttttaacttacggttacgttaccacggtacctaacggttaaccgtaacccgtaacgggtaccggttacccgtttaccggttaaacgttttccgggacccggtagggggtaccctaacggccgttaggacgtacgtaggaccgacgtaccggtggtccgcgtcgtaccgaaccttacgtaccttacggttacttaccgtacttcttaacccgg

SEQ ID NO: 159106 - DNA, 738 bp, Homo sapiens
  misc_feature: GYAE6OF02GSC21.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacactagtttccagccaccctgtctttgtctccaggagagcggccaccctctcctgcaggccaatgagagtattagcgactacttacgccgtaggtaccaacagacggcctggccaggcctacccaggcctcctcatgtatgatcgtccttaccaaaacgggtccaacgttgggacctactcccgaacgcccgtaagggttaacggtacggactagggttcggggtacgtagggaaggaacggtacctttaccgtacttaccgtaccgtaaccctaagttacccaaacgacgacccttaaggacgtacccgtacggaaccgtaacgtttcgtacgtaaccgttagttttaacttaccgttcggtaccgtacggacctacgtaccggttaacccgaagggttaccggtcccgttacccgttaccggttttacgggacccgtaacggggggtaccctaacggtacgtacgggacgtaacgttacgaacgggtacccgtacggttcgggtacggtccgtaacggtacccgaaccgtacgttaccgttcgtttaccttaccgtacgttaccccgttcccgtaacccg

SEQ ID NO: 159107 - DNA, 509 bp, Homo sapiens
  misc_feature: GYAE6OF02FIMZF.22.9.A09.1.454.CMB.1.raw
  modified_base (362)..(362): a, c, t, g, unknown or other
  misc_feature (362)..(362): n is a, c, g, or t
  modified_base (457)..(457): a, c, t, g, unknown or other
  misc_feature (457)..(457): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctccaggctcctcatgtatgatgcttcaaaaggccactggcactccagccaggtcagtgcagtggctggagagactcactctcacatcaacncgcctagacgcctgacgtattctgctagtttatactgtcagcagcgtaacaggtcgcctccgtacgtttcggccgtacggggccaagcgtggagngtacgagacgacgtgtggctcgacacgatctgttccttctacttccttcccg

SEQ ID NO: 159108 - DNA, 791 bp, Homo sapiens
  misc_feature: GYAE6OF02FX8BS.22.9.A09.1.454.CMB.1.raw
tcagacatacgcgtcacgaccggtgctcgatttagcgagacgcgcaggggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcaggccaatgagagtattagcgactacttagcctggtaccaacagaggcctggccaggcctcccaggcctcctcactgtatgatgcttacgaaaagggcctacgtggcaactcccaagtacccgtaggttaccaaggtcggtacgaacggttggggttacctaggggaaacgtacgggtaacctttcgaacttccgtaacccaacctaacttaaccgaaacctacggtaacccgttaacggacggttaccgtacggtaacgtaagtttccgtacgtacgtaacggttttaactttaccgttacgttacgtaggaccgtaacggtacccgttaaaccgtaacggttacgggtaccccgtttacccggttaacggtttttaccggggaccccggtaaacgggggggtaccccgtaaacgggttaccgttaacgggtaaacggtacggtttaaccggaacggttaaacccgggtaaaccggtttcgggttaacgggtacccggttaacggaacccgtaaccggttaaacgttccgtttacggttacccgtttacgtaccctttaccccggtttaccccccgg

SEQ ID NO: 159109 - DNA, 674 bp, Homo sapiens
  misc_feature: GYAE6OF02JY1U5.22.9.A09.1.454.CMB.1.raw
  modified_base (190)..(190): a, c, t, g, unknown or other
  misc_feature (190)..(190): n is a, c, g, or t
  modified_base (201)..(201): a, c, t, g, unknown or other
  misc_feature (201)..(201): n is a, c, g, or t
  modified_base (217)..(217): a, c, t, g, unknown or other
  misc_feature (217)..(217): n is a, c, g, or t
  modified_base (241)..(241): a, c, t, g, unknown or other
  misc_feature (241)..(241): n is a, c, g, or t
  modified_base (400)..(400): a, c, t, g, unknown or other
  misc_feature (400)..(400): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccacctgtctttgctccaggangcggccacctncctgcaggccaatgangtatagcatactagcctggacaangacgctgccaggctccgagcctcgcatcgtatgatgtccttaccgaaaagggcctaacgtggactaacgtccccaagccgacggttcacggtcggaacgtggtacgggtttcctaggggaagacgtaccgtttacaacgttcctacgaccatacgtaanacgggtccttagacgcctagactcttacctgtacgtaagtttacttacgtacgtacctagtaccgaacggttcctaaaccggttaacgggtccggtaaccctttcccgggttaccggttttttaaccgggacccgggttaaccggggacccggttaaagtccccggttaagggaacttaacgggtacccgtaacggtacggttaaccggtcggtaacgtccggttaccgaccgtacgtactcggtacgttccttacgtaccgttcccttacccg

SEQ ID NO: 159110 - DNA, 529 bp, Homo sapiens
  misc_feature: GYAE6OF02IUBSN.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttccaaaagggccaactggcatcccagccaggttcagtggcaggtggtctggaagagacttcactctcaccatacaaacagcctagagccctagacgattctgctagtttattactgtcagcagcgtaacaagtcggacctccgtacgtttacggccgtacgggggaccaaggctaggagatcgagacgaacgtggtcgtctgccactactcttacgtcttacgatccgtcccg

SEQ ID NO: 159111 - DNA, 544 bp, Homo sapiens
  misc_feature: GYAE6OF02GTJZ3.22.9.A09.1.454.CMB.1.raw
  modified_base (378)..(378): a, c, t, g, unknown or other
  misc_feature (378)..(378): n is a, c, g, or t
  modified_base (503)..(503): a, c, t, g, unknown or other
  misc_feature (503)..(503): n is a, c, g, or t
tcagacatacgcgtcacgaccggtgctcgatttagcgagacgcgcaggggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttaccaaaaagggccactggcatcccagccaggttcagtggcaggtggtctggaagagtacttcactctacaccatcaaacncgacctagagcctgacgtattctagctagtttactacttgtacagcagtcgtaccagtcggccctccgtactttcgggaccgtgggggaccctaaggctagggatacgcgagaacgaacgttggnggctcgccactacgtcttaggtcttcctattcccttacccg

SEQ ID NO: 159112 - DNA, 551 bp, Homo sapiens
  misc_feature: GYAE6OF02H4IG9.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgacttactagcctggtaccaacagacggcctggccaggcctcccaggctcctcatgtatgatgccttaccgaaaagggccacgtggacactcccagccaggttcagtggctaggtggtctggaagagtacttcactctacaccatacaaacacgacctagagacctagaacgtatttctagtactagtttattacgtgtacagcagtaccgtacgaagtcggacctcgtacgtttaggaccgtaggggacctaagcgtaggagagtacagacgtacgtgtacggctcgacaccgtatctcgttactctactcctaccg

SEQ ID NO: 159113 - DNA, 615 bp, Homo sapiens
  misc_feature: GYAE6OF02FV4Y5.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggcctcctcactgtatgatgacttaccgaaaagggccacgtcggcacgtccccagcctaggttcaggtggcgaggttggtactggaagagactttcactcacaccatccaacacgcctagacgcctagacgtattctgtctagtttactactgtacgacgctacgtacgtaacgtacgtcggtacccgttaccgtacgttttcgggaccggtacgggggtacctaacggtcgtacgggacgtacgtaccgacggtaaccgtaacgttcgggtacggtccgtaccggtaccgtacccgtacttcgttacgttcctttaccgttaccttcccgttaccccg

SEQ ID NO: 159114 - DNA, 564 bp, Homo sapiens
  misc_feature: GYAE6OF02F002L.22.9.A09.1.454.CMB.1.raw
  modified_base (339)..(339): a, c, t, g, unknown or other
  misc_feature (339)..(339): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagtttgtgttgacacagtttccagccaccctgtctttgtctccaggagagcgggccaccctctcctgcagggccaatgagagtattagcgactacttagcctggtaccaacagaggcctgaccaggctcccaggctcctcatgatgatgcttccaaaaggccactggcatccagccagttcagtgcagtggtcnggaagagtactcactctcaccatacaacagcctaagacgcctagaacgtacttctcgctacgtttaacttactcgtactacgacgtacgaccgtaccaaggtcgacccttccggtacttttcgggcccgtaacggggccaaagggctagggacgagtacgacgacgaacgttggtcggctggtacctaccgacttcgttcgttcctacgtacttcccttaccccg

SEQ ID NO: 159115 - DNA, 723 bp, Homo sapiens
  misc_feature: GYAE6OF02FLFSW.22.9.A09.1.454.CMB.1.raw
  modified_base (256)..(256): a, c, t, g, unknown or other
  misc_feature (256)..(256): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagcccaccctgtctttgtctccaggagagcggccaccctctcctgcagggccaatgagagtattagcgactacttagcctggtaaccaanaggaggccgtggccaggcctcccgaggcctcctcatgtatgatgcttaccgaaaagggccacgtggacactcccagccgtaggttcgagtggcgaggtcgggtctggaagacgtactttcgaacttcctacgaacctactaccaaaaccgtacgtacccgtaagacgtaccgtacggaaccgtaactttccgtacgtaccgtttacgttttaacgtttaccttcggttaaccgtaacggtacgtaaccggtaccgttaaacccggtaacggtaccgggtacccgttacccggtttaaccgtttttcggggaccccggtacgggggggtaacccgtaaccgggtacggtaccgggtagtaacgtaccggtaacggtaaccggtaacggttgggtaccggtacgttccggaccgtaaccgtacgttccgttacgttccctttaccgtaccttttacccgtaccccccgg

SEQ ID NO: 159116 - DNA, 554 bp, Homo sapiens
  misc_feature: GYAE6OF02GWN5F.22.9.A09.1.454.CMB.1.raw
  modified_base (357)..(357): a, c, t, g, unknown or other
  misc_feature (357)..(357): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagacggcctggccaggcctcccaggcctcctcatgtatgatgcttaccaaaagggccacgtggcactcccagcctaggttcagtggcaggtggtctgggaanagacttcactctacacatcaacagcctagacgctgacgtatctagtactagttattacgtgtcagtcagtaccgtactagtcgaccgtcgtacgtttcggccgacggggtaccacgcgtcggacgtataccgtacgacgtaacgtggtacggtcgtggacctacgtacttcgtacgtctttactacttccgtacccg

SEQ ID NO: 159117 - DNA, 533 bp, Homo sapiens
  misc_feature: GYAE6OF02G64ZA.22.9.A09.1.454.CMB.1.raw
  modified_base (352)..(352): a, c, t, g, unknown or other
  misc_feature (352)..(352): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctccgtcatgtatgatgcttccaaaagggccactggcactcccagccaggttcagtggcaggtggtcgtggaanagacttcactctcaccatcaacagcctagacgcctagacgattctgtactagtttattactgtcagcagcgtactagtcgtcctccgtactttcgggccgtacggggcacgtcgtacggagatacgagacgaacgtggtcggtctagcctacgactctcgtcttacgtacttccgtccccg

SEQ ID NO: 159118 - DNA, 666 bp, Homo sapiens
  misc_feature: GYAE6OF02HSHX6.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagcccaccctgtctttgtctccaggagagcgggccaccctctcctgcagggccaatgagagtattagcgactactagcctggtaccaacagagcctcggccaggcctcccgaggcctcctctatgtactgactgtccttaccgaaaacgggcctaacgtggctactcccgagccaggttcaggtgccgtaggttgggtcgtgggaaagacggtacctactacgtacctacgaaccagtaccaaacgacgtccgtaacgacgtccctaggacgtactccgtagtcttaacgttacttacgtagttacgagcgtaacgtaccgtaacgtaacggtccggtacccttaccggtaccgttttcgggaccggtaccggggaccgtaacgtaccggtaagggagtaactcggacggtaacggtaaccggtcggtagggtaccgtcggaccctaaccgtacttaccggttccgttaccgtttacctaccgtttccccgttaaccccg

SEQ ID NO: 159119 - DNA, 591 bp, Homo sapiens
  misc_feature: GYAE6OF02H5VTS.22.9.A09.1.454.CMB.1.raw
  modified_base (193)..(193): a, c, t, g, unknown or other
  misc_feature (193)..(193): n is a, c, g, or t
  modified_base (460)..(460): a, c, t, g, unknown or other
  misc_feature (460)..(460): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagngcggccaccctctcctgcagggccaatgagagtattagcgatacttagcctggtacaacagaggcctggccaggctccaggcctcctcatgtatgtatcgacttaccgaaaagggtcccaacgttggaccactccccgagccaaggttcaggtcggcgaggttggtacctgggaaacgaggtactttacacgtcttccgaacctataccaacgacgtaccgtagtacgcctacgacgtattcgtagtactagtttactacgtgtacngtacacgacgtacagtcgccgtcgtacgtttcggcgtacgggacctagcgtaggaagactacgagaccgtacgtggtcggtactggtacccacgtacgtccgttagttcctttcgtaccttccgtaccccg

SEQ ID NO: 159120 - DNA, 596 bp, Homo sapiens
  misc_feature: GYAE6OF02F5P8Z.22.9.A09.1.454.CMB.1.raw
  modified_base (257)..(257): a, c, t, g, unknown or other
  misc_feature (257)..(257): n is a, c, g, or t
  modified_base (391)..(391): a, c, t, g, unknown or other
  misc_feature (391)..(391): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccacccgtctcctgcagggccaatgagagtattagcgactacttagcctggtaccaacngaggcctggccaggctccaggctcctcatgtatgatgccttaccgaaaacgggccaacgtcggcactcccgagccctaggttcaggtggctaggttgggtactgggaagagacttcactctacaccatacaacncgacctagacgcctagacgtattcgtgcttagtttactactgtcagcacgcgtactaaggtcggtccttccgttacgttttcggaccggtacgggggaccctaaggtcgtagggacgtacgtcgagtaccggtaacgtcggtacggtactccgaccgtaacctacgttccttaggttacccttcgtaccgttcccgttaccccgg

SEQ ID NO: 159121 - DNA, 725 bp, Homo sapiens
  misc_feature: GYAE6OF02FIGEY.22.9.A09.1.454.CMB.1.raw
  modified_base (256)..(256): a, c, t, g, unknown or other
  misc_feature (256)..(256): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacngaggcctggccaggcctccgaggcctcctcatgtatgatgctaccaaaaggccactggcatcccagccaggttcaggtgcgtagtcggtctggaagacgtacttcgactcgtaccactacgtacaaccgagacccttaaggacgtacccgtagtaaccggtacttacgtagtaccgttaagttttaccgttaacttcggttaaccgaacgtaccgtaacggtaccgggttaaacccgtaaacgggttaccggtacccgttaacccgggtttacggtttttacccggggaccggttaaccgggggggtacccgttaaacgggtcggttaacggggacggtaaccgttaccggaacgggtaacgtaaaccgggttcggtccgggtaaccggttaccggaacccgtaacccgtaacggtttcccggttaccgtttaccggtttaccgtacgttttccccgttaaccccccgg

SEQ ID NO: 159122 - DNA, 602 bp, Homo sapiens
  misc_feature: GYAE6OF02FJKRI.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactactagcctggtaccaacagagcctggtcaggcctccaggctcctcatgtatgatggccttaccaaaagggccctaactggcactcccaggccaggttcagtggcgaggtcgggtctagggagagtacttcactctcaccataccaacacgacctagacgccgtgacgattctagctaagtttacttactgtacagtcgacgccgtaactaacggtcggtacccgttccgtacgttttccgggaccggtacgggggtaccgtaacggtcgtaggaacgtacgtacgagacgtaacgttggtacggtccgtacggtccaaccgtacgttccgttacggttcccttactaccgttcccgttaccccgg

SEQ ID NO: 159123 - DNA, 743 bp, Homo sapiens
  misc_feature: GYAE6OF02H83OA.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctctgctactctggctcccagagaccaccggagaagttgtgttgacactagttccagccaccctgtctttgctccaggagagccggccaccctctctgcgacggccaaatgagacgtatagcgtactacgttacgacctggtaaccaaagaggacggtcctacggaccgacggtcctaccccgacggccttccctagtaacgtcggtaattcgaagtcgtaccgttaaccgaaaaacgggtccctaaccgtggacctactaccccgacggtacccgtacgggtttacgaacgggttcggtaccgtagggttacggggtaaccgtagggaaacggtacgtaacccgtttcgaacccgttactaccgaacctaactaccgaacacggtacctaacggcgtaccgtagtaaccgttactacgtcggtactttaacgtttaacgttacgtacgtacgacgtacgtacgaaccgttaccgtaacggtccggttccttaccggttacgtttcgggacccgggtaacggggtaccctaaggtcggtaggtaaccgttacgaacgtaccgggaatcggtaacgccgggtactacgaccgtacgtacttccgtaggtttcctacgttaccttcccgttaccg

SEQ ID NO: 159124 - DNA, 536 bp, Homo sapiens
  misc_feature: GYAE6OF02IAAF8.22.9.A09.1.454.CMB.1.raw
  modified_base (282)..(282): a, c, t, g, unknown or other
  misc_feature (282)..(282): n is a, c, g, or t
  modified_base (331)..(331): a, c, t, g, unknown or other
  misc_feature (331)..(331): n is a, c, g, or t
  modified_base (334)..(334): a, c, t, g, unknown or other
  misc_feature (334)..(334): n is a, c, g, or t
  modified_base (353)..(353): a, c, t, g, unknown or other
  misc_feature (353)..(353): n is a, c, g, or t
  modified_base (369)..(369): a, c, t, g, unknown or other
  misc_feature (369)..(369): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagctggtaccaacagaggcctggccaggctccaggctcctnatgtatgatcgacttaccaaaagggccactggcatccagcaggttcagngcngtggtctggaagagacttnactctccacatcaaanacgaccctagagcctagacgtatactgactagttaattactgtacagctagcgtacaagtcgccgtccgtacgttttggccgaggggccaaagcgtaggagagtacagaaccgacgtggtacggcgtcgtccactactcgttacgttcttactacgtccttaccccg

SEQ ID NO: 159125 - DNA, 764 bp, Homo sapiens
  misc_feature: GYAE6OF02IPGTS.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtaattagcgaacttacttagccttggtaaccaacagacggccgtggccaggcctcccaggcctcctcatgtatggatcgacttaccgaaaacgggcctacgtcggactacgtcccgtacgaccgtacggtttaccgaacggttcgggaccgtagggtcggggttacgttaacgggaaaggtacggtactttaccgtacttaccgtacctaacctaacttaccgaacctacgacccgttaacggaaccggaccgttaacggaaccgttaaacgtttccgtacggttaccgtttaaggttttaacttacgtttacggtacgtaacggtccgtaaacggtaccggttaaaccgtaacggtacggttacccgttaccggtttaaccggtttttacgggacccgggtacgggggtacccttaacgggacggtttacgggaagtaacgttaccggacggtaaccgtaacggttcgggtacggtccgttcggaccgtaaccgtacgttcgttacgttaccttaccgtacgttcccttaaccccgg

SEQ ID NO: 159126 - DNA, 727 bp, Homo sapiens
  misc_feature: GYAE6OF02I43KN.22.9.A09.1.454.CMB.1.raw
  modified_base (258)..(258): a, c, t, g, unknown or other
  misc_feature (258)..(258): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtcctccaggagagcgggccaccctctcctgcaggccaatgagagtattagcgaaactacttagcctaggtaccaanagaggcctggccaggctcccgaggcctcctacatagtatgtatgtaccttaccgaaaacgggtcccacgtggacacgtacccacgtaccagggttcaggtacggtcgtaggttcgggtacgtaggaagtacgtacttaccgaacgttctaccgaacctactaccaactacgaccgtaaggaccgtacccgtagtacgtaatttccgtacgttacgttaacgttttaacttacgtagttaccgacgtaccgtaaccgtaccgttaaaccgtaacggtccggttacccgttcccgtttaaccgttttaccgggacccgggtaccgggggtaaccctaacgggtacggtagggaaccgtaacgttacgtacgggtaacgtaacggttcgggtaacggttccgtaaccggtaccgtaaccgttacgtccgtttaccggttccctttaaccgttacctttccccgttaccccgg

SEQ ID NO: 159127 - DNA, 636 bp, Homo sapiens
  misc_feature: GYAE6OF02F1R8J.22.9.A09.1.454.CMB.1.raw
  modified_base (372)..(372): a, c, t, g, unknown or other
  misc_feature (372)..(372): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccgaggctcctcatgtatgatgcttccaaaagggccactggcatcccagccaggttcagtgcagtggtctggaagagacttcactctacaccatcaacncgacctagacgcctagaccgtatttcgtagcgttaagttttacttacgtggttaccgtacgccgtaacggtacccggttaaccgtaaaggttccgggtacccgttacccggttacgtttttaccgggacccggtaacggggggtacccaaacgggtccgtagggaaccgtacgtacggtaacggaacggtaaccgtcgggtacgggtcctcggaccacccgtacgttccgttacggttctttacctaccttccccgttaccccg

SEQ ID NO: 159128 - DNA, 626 bp, Homo sapiens
  misc_feature: GYAE6OF02GP6CP.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctaggtaccaacagaggcctggccaggctccagctctcgatgtatgatgcttaccaaaaggccactggcactcccagcctaggtcaggtgcgagtggtcgtagggaagagtactttacgactctaccacgtaactacaaacgacgactacgacgccgtagaacgtatttacgtgtacgtaagtttagttaccgttgtacgacgactaacggtaccgttaacgaaacggtccggaccgttacccgtacgttttcggacccggtacgggggtaccgtaacggtaggtcggaagtacgtacgtacgaacggtaacgttacggtcggtacgcgtaccgaaccgtacgttcgttacgttacctttacctaccgttcccgttaccccg

SEQ ID NO: 159129 - DNA, 701 bp, Homo sapiens
  misc_feature: GYAE6OF02IOM6X.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccacctgtctttgtctaccaggagagcggccaccctctcctgcgagggccaatgagtagtatagcgactacttagccttaggaccaacgagagcctggccaggctaccgaggcctcctcattcgtatggtactgaccttaccgaaaaacgggtccaacgttggacctacgttaccccgaagccgtaaggttccaaggttcgcgtaggtcggtacgtagggaacgcgtaactttacgacctacgtacaacctatacgaaactgtaacccttaggaacgtccgtacggtaacgtacgttacttacggtacttaaacgtttttacgttaacgttacgtacgaacgtactacggtacccgttaaacgtaacggtccggtaccccgttaccggtttaacccggttttcgggaacccgggtaccgggggtacccgtaaacggttaccggtagggaaccgttagttacccggacgtaaccgggttaacgtacggtcggtactcgaccgtactacgtcttcgttactctacgtcgtacccg

SEQ ID NO: 159130 - DNA, 583 bp, Homo sapiens
  misc_feature: GYAE6OF02ICNZG.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccgaggctcctcagtgtatgatgaccttaccgaaaaagggtccaacgtggaccactccccaagccgaggttcaaggtggctaggtacgggtctagggaaagacggtactttcgaacctctaccaacctagtaccaacgacgacctagacgcctagacgtattctagtctagtttacttactgtcagtcacgacgtaacgagtcggctccgttacggtttcggaccggtaacggggccaacggtcgtggaagtactcgagacgacgtggaggctcgacacgtatccgttgtccttcgtactccgttacccg

SEQ ID NO: 159131 - DNA, 574 bp, Homo sapiens
  misc_feature: GYAE6OF02JBEKT.22.9.A09.1.454.CMB.1.raw
  modified_base (255)..(255): a, c, t, g, unknown or other
  misc_feature (255)..(255): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaanagaggcctggccaggctcccaggcctcctcatgtatgatgtacttaccgaaaaacgggccaacgtcggacaactccccagacccaggttacgacgtggcgaggtgggtcgtagggaagagtacttcactctacacagtaccaacacgactagacgactgactattctagtctagtttattactgtacagtctacgacgtactacggtcggtcctccgtacgtttcggaccgtacggggctaacgcgtaggacgtagtacgacgacgtaacgtggtcggcgtacgccaccgtactcttacgtcttcctactccttacccg

SEQ ID NO: 159132 - DNA, 823 bp, Homo sapiens
  misc_feature: GYAE6OF02F74F6.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagacggcctggccaggcctcccgaggctccgtcatgtatgatcgtacttaccgaaaaacgggcctaacgtgggacctacgttacccccgaacggtaccccgtaagggttttaccgaacggggttcggggtaccgtaacgggggtttcggggggttacccgtttaaggggggaaacgggtaacggtacccgtttttaccgtaaacccgtttcccggttaccctaaaccccgtaaacttacccggtaaaacccgtaacgggtaccccgttaaggaaccggtacccgtttaacgggaaaccgttaacgttttccgtaagtaccgttaaggtttttaaccttaaccgttacggttacgaacggtccgtaaaggtacccgttaaaccgtaaaggtccgggtaccccgtttccggttaaccggtttttcggggtaccggttacggggggtacctaacggtcgtacgggagtaacgtaccgacgtaacggtaacggttcgggtacggtccgtcggtaacctaccgacgttaccgttcggtttaccctttacctaccgtttccccgttacccccgg

SEQ ID NO: 159133 - DNA, 689 bp, Homo sapiens
  misc_feature: GYAE6OF02I1QAV.22.9.A09.1.454.CMB.1.raw
  modified_base (192)..(192): a, c, t, g, unknown or other
  misc_feature (192)..(192): n is a, c, g, or t
  modified_base (230)..(230): a, c, t, g, unknown or other
  misc_feature (230)..(230): n is a, c, g, or t
tcagacatacgcgtcacgaccggtgctcgatttagcgagacgcgcagggggaggaactgctcagttaggacccagagggaaccatggaagccccagctcagcttctcttcctctgctactctggctcccagacgaccaccggagaagttgtgttgacacagtttccagccaccctgtcttgtctccaggganaggcgggcccacccgtctcctgcacgggccaatgaagngtaatagcgtaactactagcctacggtaccaatacgaggcctaggccgaaggccttacccgagggccttccgactagtacgttaacgtcgacgttcgaccgttaaccgaaaacgggcctaaccgtggtaccacgttacccgaagtccgtagttacaggttcggactaggtcggtagaggaaagtcactttcacgtcttacgacactacgaacgtcgacccgtagacgtaccgtagaacgttctacgtacgtacgtaacgttacgttaccgtagtaccgtagtacgtacgtacgtaacgtacgtccggtaccgttaccgtaccgtttacgggaccggtaacgggtaccgtacggtcgtacggacgtaacgtacgtacgtaacggtacgtacggtcggaccggttcaaccgtaccgtaacgttccgtagttcccgttacgttaccttacccgttaccccgg

SEQ ID NO: 159134 - DNA, 602 bp, Homo sapiens
  misc_feature: GYAE6OF02FVCF3.22.9.A09.1.454.CMB.1.raw
  modified_base (287)..(287): a, c, t, g, unknown or other
  misc_feature (287)..(287): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggcctcccgaggcctcctnatgtatgatgcttaccgaaaagggccactggcactccccgagcctaggttcaggtggcgtaggtggtcgtaggaacgagtacttcacgttccgtacaccataccaactacgacctagacgtcctagacgtactctgtctagtttactactgtacagtacgacgtacgtaacgtaggtcgccgttccgtacgtttcggaccggtacggggtcctaaggcgtaggacgtacgtacgacgaacggtacgtcggtcggtccgtacgtcgtaacccgtagttaccgttcgttaccgtttacctaccgttcccttaccccg

SEQ ID NO: 159135 - DNA, 650 bp, Homo sapiens
  misc_feature: GYAE6OF02HXBGI.22.9.A09.1.454.CMB.1.raw
  modified_base (299)..(299): a, c, t, g, unknown or other
  misc_feature (299)..(299): n is a, c, g, or t
  modified_base (326)..(326): a, c, t, g, unknown or other
  misc_feature (326)..(326): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgttctttgtctccaggagagcgggccaccctctcctgcagggccaagtgagagtattagcgactactacgcctggtaaccaacagacggccgtggccaggcctccaggcctcctcagtgtatgntgcttaccgaaaacgggcacgtggacncgtacccagccgaggttcagtcggcgaggtggtcgtagggaagagtacttacactcgacacctataccgaaacacgtcccgaagacgacccgtacggtacgtaatttccgtacgtactttaacgtttaacctttaccgtacggttaaccgacggtacgtacggacccggttaaccgtaaggtccgggtcccttaccggttaacgttttaccgggacggtacgggggacccaaggtcggtaggagacgacgtagtacgaaggtcggttgaccgtcgaccgtactcgttacgttacgtttccgtacttaccgttacccgttacccg

SEQ ID NO: 159136 - DNA, 773 bp, Homo sapiens
  misc_feature: GYAE6OF02JYEUA.22.9.A09.1.454.CMB.1.raw
tcagacatacgcgtcacgaccggtgctcgatttagcgagacgcgcagggggagggaacgtgctcagttaggacccagagggaaccatggaagccccagctcagcttctcttcctctgctactctggctcccagagaccaccggagaagttggtgttgacacagtttccagccaccctgtctttgtctccaggagagcgggccaccctctccctgcacgggccaatgacgagttattagcgaacttaccgttagcccgtgggttaacccaacgtacgacggcctaggccagggcctacccgacgggtcctacccgttcactacggttatagtaagtgaccgtttaccgaaaaacgggccctaaaccggtgtacccggaattccccgaaagccctaacgggttccacggttacggcgtcggtagggtccgtagggtaaagacgtactttacggacttcctacgacctaagtaccaaacacggtaccctagacgtccgtacggacgtactttcgtacgtacgtaacggtttattaacccgtaggttaccgtaaggtaccctaacggggtacccgttaaccggtaaacggttccgggtaaccgttaccccgttaaccggttttttcccgggaaccgggtaaccgggggttacccgtaaacgggttcgttaccgggtaaacgttacgttacggaaccgttacggtaaacccggtggttacggaccgtacggtacgtacccgaacgttcgtaccgtcctcgttacctaccgttccccgg

SEQ ID NO: 159137 - DNA, 692 bp, Homo sapiens
  misc_feature: GYAE6OF02IXW2R.22.9.A09.1.454.CMB.1.raw
  modified_base (258)..(258): a, c, t, g, unknown or other
  misc_feature (258)..(258): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttggtgttgacacagtttccagccaccctgtctttgtctccaggagagcgggccaccctctcctgcagggccaatgagagttattagcgactacttagcctaggtaccaanagacggctggaccaggcctacccgaggctacctcattgtatgtatcggtcttaaccgaaaagggccaacgtggcactcccagccctaggttcgaggtcggaccgaggttcgggtacgtaggggtaaacgtaacggtaccgtttacaccgttccttacgaacccgtaataccaaacgaccggtaccctaaggacgtcccgtaggaaccggttactttacgtcggtacgtttaagttttaactttaccgtgtaacgtcgtacccgtaggtacccttaaccgaacgttccgggtacccttccggtttacgtttaccgggcggtacggggtaccgagtcgttacggacgacgtcgaacggtacgtaaccggtcggtacggaccgtcggaccgaactaccggttcttacgtttacccgtcttaccggtccttaccccgg

SEQ ID NO: 159138 - DNA, 569 bp, Homo sapiens
  misc_feature: GYAE6OF02GLAGY.22.9.A09.1.454.CMB.1.raw
tcagacatacgcgtcacgaccggtgctcgatttagcgagacgcgcagggggaggaactgctcagttaggacccagagggaaccatggaagccccaactcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttaccgaaaagggccaacgtggcactcccagcctaggttcagtggcaggtgggtctaggaagagtacttcactctcaccatcaacacgcctaagacgcctagaccgtattcgtgtctagttttacttactgtcagctacgtcgtaacgagtcgccttcgtactttcgggccgtaggggaccaacggtcgtacggagtaacgtaccgaggacgtaacgtggtacggcgtacgcctacgtacgtcgttcgttaccttcgactttccgtcccgtacc

SEQ ID NO: 159139 - DNA, 707 bp, Homo sapiens
  misc_feature: GYAE6OF02JUWCU.22.9.A09.1.454.CMB.1.raw
  modified_base (328)..(328): a, c, t, g, unknown or other
  misc_feature (328)..(328): n is a, c, g, or t
tcagacatacgcgtcacgaccggtgctcgatttagcgagacgcgcaggggaggaactgctcagttaggacccagagggaaccatggaagccccagctcagcttctcttcctcctgctactctggctcccagagaccaccggagaagttgtgttgacacagtttccagccaccctgtctttgctccaggagagcgggccaccctctcctagccagggccaatcgagagtacttagcgactacttagccctaggtaccaacagacggcctaggcctaggcctcccgagtcctccgtcatgtactgatcgcttaccgaaaacggcctacgnggacctacgtcccacgaccctaggttccaggtcggacgtaacggtcgggtactagggaaacgtacgtaccgtttacgacctacgtaccgtaacccagttaacccaacgtcggtaaccctaggacgtacccgttaggaacgttaacgttccgtagtacgttaacgtttaacgttaccgtacggttaccaacgtaccgtacgtaccgggtaaaccctacgggtacggtccctaccggttacgttttaccggaccgggtaaccgggtcccgaaagtcccggtaggaacgtaccgacgtacggtaaccgtaaccgtcggttacggtacctacggtaccgtaccgtacgtacgttacgtaccttaccgtacgttcccgtacccg

SEQ ID NO: 159140 - DNA, 1027 bp, Homo sapiens
  misc_feature: GYAE6OF02HCG9O.22.9.A09.1.454.CMB.1.raw
  modified_base (91)..(91): a, c, t, g, unknown or other
  misc_feature (91)..(91): n is a, c, g, or t
tcagacatacgcgtcacgaccggtgctcgatttagcgagacgcgcgagggggaggaactgctcagttaggacccagagggaaccatggaanccccagctcagcttctcttcctcctgctactctggcctcccaggagaccgaccggagtaacgtttggtgtttgactactacgttttccagccacccttgttctttgtctccagggtagaggccgggccaccctcgtcctggcgaacgggcctaagtcggaacgtagttaacgttacggaccgtaacttacgttacgtcccgttagggtaaccaaacgtaggtaccggtcccgttacgggacccgtaacgggtaccccttaccccgaacgggtacccctttaccccgtacctaaacgtttcccttaagttacggtaacgtttaccggtacttaacgttttacccggttaaaccgggaaccgggggtaccctaaccgggttccggtaaccttaaccggttaccccgtaacggttaccccgtttagggttaacccgtaagggttccggacggttacggggttccggggttaccggtaacggggtaacccgttacggtaaccttttacccgtacccgtttcccgtaaaccgtaacccgttaacgtttaccacgggtaaccctaacgttaccccgttaaaggacccgttacccgtaaaggggttaaaacgttttacgtttttacgaaaccggttttttaaactttttaccggttacgttaacggtacctaagggttcccttaaaacggttaccgggtttaaacctaacccgttacccgtttaacccggttcggttaccggggggtttaaccggggaaccggggttaaaccggggtaaaccggtaaggggttaaggaaccgttaaccgggtttaacgaaaaccgggttttccgggtagggtacccgggtaccgttacccgaaaccctttaccccggtttgtttttccccgggaacggtttttaaccccgtacgtttacccggtttacccccgttaacccggg

SEQ ID NO: 159141 - DNA, 593 bp, Homo sapiens
  misc_feature: GYAE6OF02HPBI6.22.9.A09.1.454.CMB.1.raw
  modified_base (257)..(257): a, c, t, g, unknown or other
  misc_feature (257)..(257): n is a, c, g, or t
  modified_base (283)..(283): a, c, t, g, unknown or other
  misc_feature (283)..(283): n is a, c, g, or t
tcagacatacgcgtcacgaccggtgctcgatttagcgagacgcgcagggggaggaactgctcagttaggacccagagggaaccatggaagcccccagctcagcttctcttcctcctgctactctggctcccagagaccaccggagaagttgtgttgacacagtttccagccaccctgtctttgtctccaggagagcgggccacccgtctcctgcagggccaatgagagtattagcgactacttagcctggtaccaanagagcctggccaggctccaggctccncagtgtatgatgctttaccaaaagggccacgtggctactcccagccaggttccaggttcggcaggtcgggtcgtggaagactacgttcactctacactactacaacagtccctaagacgcctgaacgtacttctcgtactagtttattacgtgttcagcgagtacgtacacgtcggtcctccgttaccgttttcggccgtaggggtaccaacggtcggtaggaacggtactacgaggtacgaacgttcggtacggtcgtacgtaccgaaccgtacttcgtacgttcttaccgtaccgttccgttaccccg

SEQ ID NO: 159142 - DNA, 665 bp, Homo sapiens
  misc_feature: GYAE6OF02FXO55.22.9.A09.1.454.CMB.1.raw
  modified_base (208)..(208): a, c, t, g, unknown or other
  misc_feature (208)..(208): n is a, c, g, or t
  modified_base (304)..(304): a, c, t, g, unknown or other
  misc_feature (304)..(304): n is a, c, g, or t
tcagacatacgcgtcacgaccggtgctcgatttagcgagacgcgcagggggaggaactgctcagttaggacccagagggaaccatggaagccccagcgcagcttctcttcctcctgctactctggctcccagtttcagataccactgagaaatagtgatgacgcagtctccagccaccctgtcctgtgtctccaggggaaagagccanactctccctgcagggcccagtcagagtgttagcagccagcttagcctgtaccagcagaacctggccagctcccaggctcctcatctactggtgcancttacgacgggccaccgtgtactccacgccaggttcaggttcggactaggtcgggtcgtgggggtaacaggtacggttttccaccgttacctttccgaaccacgtttacgaaccggcgtaacgggacccttcggaccgacggttaccgttacggtaaacggtaagttttttacgtaccgttaaggtttttactttaaccgttcggttacgacgttaccgtaccttaaagttaaacttaaccgtcgtacccgttaccgttaacgttacgtttttggacccggtaacgggggacctaacggccgttaccgggaagtaccgttacaaaaccgggttaaccgtaggtaccggacgttccgtaacc

SEQ ID NO: 159143 - DNA, 738 bp, Homo sapiens
  misc_feature: GYAE6OF02HNFYO.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccagagagcggccaccctctcctgcagggccaatgagagtattagacgactacttagcctaggtaaccaacaggagcctggccaggcctcccgaggtcctcctcatgtactgatgtaccttaccgaaaacgggccacgtcggcactcccacgccgtaggttcgacgtaggcgtaggtcgggtacgtagggaagacgtacctttacgacctacgtaccaacctactaccgaaaccgtacgaccctacggaccgtaccctaggaaccgttactttccgtacgtacgtttaagtttacttaacgtcgttacgaacgtcgaacggttaccgtaaccgtaagggtccgtacccgttaccggtttaacggtttccggggacccggggtaacgggggtacccctaagggtaccggtacgggtaaccgtaacgttacccggaacggtaacccgggtaacgttcggggtccggtaaccgtccggtaaacccgttaacccgttacgttacccgtttacggtttacccctttaaccgttacccgtttcccccgttaacccccgg

SEQ ID NO: 159144 - DNA, 720 bp, Homo sapiens
  misc_feature: GYAE6OF02GE70H.22.9.A09.1.454.CMB.1.raw
  modified_base (261)..(261): a, c, t, g, unknown or other
  misc_feature (261)..(261): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagcccaccctgtctttgtctccaggagaggcgggcccaccctctcctgcgagggccaatggagagtattagcgactacttacgcctggtaccaanaggacgcctggcccaggcctcccgaggcctccctcagtgtatgatcgcttaccgaaacgggccacgtcggcactcccagccgtaggttcaggtggcgtaggttgggtacgtagggaagtcggtacctttacaccgtacctcaacctactaaccaaacgacgtaccgtacggacgaccgtacggtaacgtactttccgtacgtacgtttaagtttaacgttacgtagttacgtacgtacgtaacggtaccgtaaaccgtaggtacccggttacccgttaccgggtttaccgttttcccggggaacccgggtacgggggtacccaacgggtcggtaaacggtaacgggtaacgtaccgacggtaaccggtaccggttagggtaccggttacggtaccgtacctaacccggttacgtttccgttacggtttcctttaccgtacccgtttcccttacccccgg

SEQ ID NO: 159145 - DNA, 723 bp, Homo sapiens
  misc_feature: GYAE6OF02F15U2.22.9.A09.1.454.CMB.1.raw
tcagacatacgcgtcacgaccggtgctcgatttagcgagacgcgcagggggggggaactgctcagttaggacccagagggaaccatggaagccccagctcagcttctcttcctcctgctactctggctcccagagaccaccgggagaacgttgtgttgacacgagtttccagccaccctgtcttgtctcaggagagcggccacctctcctagcaggccaatgagagtattagcgactacgttagccgtaggtaccaacaggacggcctggtccacggcctcccgaggccttccgtacacgtcgtaatggaatcgtacttaccgaaaacgggcctaacgttcggacctacgtaccccgacgcccgtaaggtttcgaaggttcggaccgtaggtacggggttcgtacggggaaacggacgttacgttaccaaccgttaccgtacctaacctaacgttaccaaaccgaggtacccgtaaggaccgtacccgtagtaacggtaacgtttctacgggtccttaaaggtttacttacgttgtacgagtaccgacgtacgtacccgtaagtccgtccttaccgtgtttcgggaccggacgggggtaccacggtcgaggtaacgtacgtacgagtacggtaacgttcggtacggtacgttacggaacccgttacctaacggttccgttaccggttaccttacgtaacgtttaccccgtcccggttaacccg

SEQ ID NO: 159146 - DNA, 766 bp, Homo sapiens
  misc_feature: GYAE6OF02IEIJ4.22.9.A09.1.454.CMB.1.raw
  modified_base (133)..(133): a, c, t, g, unknown or other
  misc_feature (133)..(133): n is a, c, g, or t
  modified_base (256)..(256): a, c, t, g, unknown or other
  misc_feature (256)..(256): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagngaccaccggagaagttgtgttgacacagtttccagccacctgtctttgtactccaggagagtcgggccaccctctcctgcagggccaatgagagtattagcgtactacttagctggtaccaanagagcctggcaggctcccgaggcctccgtcatgtatgatcgcttacgaaacggtccacttggaccacgtcccagtacccgacggtttacgacggtggtcgacgggttcgggtacgtgggaaagtacgtacctttagtaaccgtccgttacccaacccgttaatacccgtaaacacggtaccctaaggtaaccggtacccgtacggaacccgttaacgtttccgttcgtaacctttagggtttaaacctttaccgtttggtacccgtaagtaccgtacggtacccgttaaccgtaaacggttaccgggtacccgttaccgttaaccggtttttccgggacccggttaacggggggtacccttaacgggtaccggttacgggtaaccggtacgttacccgtaagggtaaccggtaaccggttacgggtaccggtacggttaccggaacctaacccggttacgttaccggttccgtttaccgtttacgttacccgtttacccgttacccccgg

SEQ ID NO: 159147 - DNA, 644 bp, Homo sapiens
  misc_feature: GYAE6OF02HFE2P.22.9.A09.1.454.CMB.1.raw
  modified_base (257)..(257): a, c, t, g, unknown or other
  misc_feature (257)..(257): n is a, c, g, or t
  modified_base (622)..(622): a, c, t, g, unknown or other
  misc_feature (622)..(622): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacactagtttccagccaccctgtctttgtctccaggagagcgggccaccctctcctgcagggccaatgagagtattagcgactacttagcctggtaaccaanaggagcctggccaggcctcccgaggcctccgtcagtagtattgacgttgaccttaaccgaaaacgggtcccacggtggacctacacccgacgtccgtaacggttcgtaggtggaccgtaggttcggtacgttaggggaagtacgacgtttccacttctaccgacctactacaacacgtaccgtagacgtccgtagtaccgtattcgtacggtatttactttaagtttcctcgtacgactcgacgtccgtaacgtaacggtcgtcccttaccggttacgtttacgggacccgtacggggccgtagtcgtgggacgttacgtcgagtaacgtagtcgtcgtacgtccgactacccgtacttccggtntcttccttacgttaccctcccg

SEQ ID NO: 159148 - DNA, 588 bp, Homo sapiens
  misc_feature: GYAE6OF02FLOFI.22.9.A09.1.454.CMB.1.raw
  modified_base (192)..(192): a, c, t, g, unknown or other
  misc_feature (192)..(192): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccagganagcgggccaccctctcctgcagggccaatgagagtattagcgactacttagcctggtaccaacaggaggcctggccaggcctcccgaggctcctcattgtactggatgaccttaccgaaaagggtcccacgtcggcacgtcccagcctaggttcaggtggctaggtcggtctagggaagacgactttacactctcaccatacaacacgcctagacgtcctagactattcgtatcgttaagtttacttaactgtactagacgtacgtaccgtacaaggtcgccttccgtacgtttcggaccggtcgggacctagccgtggacagtccaggacgtaacgttggacggtcgtcgacctacgtacttccgttagttccttacgttactcccgttaccccg

SEQ ID NO: 159149 - DNA, 845 bp, Homo sapiens
  misc_feature: GYAE6OF02HC5EM.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagttccagccacctgtctttgtctccaggtagagcgggccacccgtctcctcgcacgggccaagtcggagagtacgttagcgtacttaactacgacctacggtaccaactaggaggcctcggaccaacggtcctccgacggcctccgtacacgtcgtacgtagtactcgaccgttaccgaaaacgggcctaacgtcggactactaccccgagtcccggtacggttacgacggttaaggccgtaggttacgggtacgttagggaaaggacggtaacctttcgaacttccgtacgtaacccgtaaccgttaccgaaaccctacggtaccctaacgggtaccggtacccgtacggtaaacggttactaccggttcgtaaccgtttaacggttttaccttaaaccggttcgtttaaccggaacgggttacccgtaacgttacccggtaaaacccggtccggtttaccgggttaccccgtaaacccggggttttaccctttacccggggggtaccccgggtaaaccggggggtaccccggtaaagttcccgggttaaacggggtaccgtaaacgttaccggggaaccgtaccgggttaaccgtagggttcccggtacgttaccggacccgttaaccgttcgttaacccggtccgttttacgttacccggttacgttcccccgttaacccgg

SEQ ID NO: 159150 - DNA, 951 bp, Homo sapiens
  misc_feature: GYAE6OF02IRPHY.22.9.A09.1.454.CMB.1.raw
tcagacatacgcgtcacgaccggtgctcgatttagcgagacgcgcaggggggaggaactgctcagttaggacccagagggaaccatggaagcccccagctcagcttctcttcctcctgctactctgctcccagacgaccaccggagaagttgtgttgacactagtttccagcccaccctgttctttgtcctccagggagaggcgggccctaccctctcctagccgaggccaatgagagttattagccgtaacttacgttacgacccttaggtaacccaagtacggaacgggtcccgttggggacccgaggtcccgtaccccgtaggccttccctcctattcggtattaggactttcggtccttaaccgaaaaccggggtcctacggttacgggaaccctaccgtaccccgaacggacccgttaaccgggtttcgtaacggggtcggggtacggtaaccggggtttcggggttacggtaacggggtaaacgggtaaccgttacccggtttaccgtaaccccgtttaccttacccaaacccgttaccggtaaccgtaacccggaaccgggtaccccgttaaacgaccggttaccccggttaacggtaaccgttaacgtttccgttaccggttaagtttaaccggtttttacttaacccgggtcgttaaccggttacgtaaccgtttaacccggtaacccgttaaaccgtacgggttaccccggttaccccgtacccgggttttttaaccggtttcccggggggaaccccggggttaagggggtaacccccgaaagggttacccggttaggtaaacgttacccgtaaaggttaccggtaaacgggttacgtacggggttacccgggtacgtaacccggttacgtaacccccgtttaacgggtcctttacccggttacccgtttacggtaacccccttttccccggggttccccg

SEQ ID NO: 159151 - DNA, 800 bp, Homo sapiens
  misc_feature: GYAE6OF02HDVZN.22.9.A09.1.454.CMB.1.raw
  modified_base (199)..(199): a, c, t, g, unknown or other
  misc_feature (199)..(199): n is a, c, g, or t
tcagacatacgcgtcacgaccggtgctcgatttagcgagacgcgcaggggggaggaactgctcagttaggacccagacggaaccatggaagccccagcgcagcttctcttcctcctgctactctggctcccaggtgccagtgcagaagtagtgatgacgcagtctccaggccaccctgtctgtgtctccgaggggaaancgcccaccctctccgtgcgagggccaggtccaggtagtattagaccaaactaacttacggcctaggtaccaggtcaagacgacccgtcgggaccacgggcccctaccccgacgggtcccttcccgtacctaacgttcgttaacttcgggtttacggacccttaacgttccccggaaggacccgtaacgggggacccccttaacccgggttcccgggttaaacccccccgaggtacccccgttaagggggttttacccaaggggtcgggtaccggttacggggttcgggggtttaccgtacgggggtaactaacgggtaacggtttacccgtaaccgttcctaaccgacccgtacgtaccgacggtaccgacggtccgtacggtaccggaacgttccggtaaggttaacgtttacgttttacggacgttttaaacgttttagttaccttagttccgtaagttacgtaagtttaactttaacgttcgtacggtaccgttacgggtacggttaccggaaccggtacgggtaaccgtagggtacggtaacgtaaccggtaaccgtacgtaggttccgacgtcgacgtactacgtctgtacctacg

SEQ ID NO: 159152 - DNA, 608 bp, Homo sapiens
  misc_feature: GYAE6OF02IOIBF.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacaccgtttccagccacccctgtcttttgtctccaggagagcgggccaccctctcctgcagggccaatgagagtatagcgactacttagcctggtaccaacagacggcctggccaggctcccaggctcctcatgtatgatgcttaccgaaaagggccacgtggcatcccagccaggtcagtgcagtggtctggaagagacttcactcacacatcaacagcctagacgcctgaacgacttcgtgactagtttacttacgtcgtctacgcaacggccgttaacgaaacggtcgtcccgttccgttacgttttcgggaccggtacgggggaaccgtaacggtaccgttaggggacgtaacgttacgaacgggaccgtaacgtgggttacggtaccgtcggtaccaccgtacgtaccgttcgttaccgttcctaacgttcccttaccccggtacccg

SEQ ID NO: 159153 - DNA, 585 bp, Homo sapiens
  misc_feature: GYAE6OF02GN7KC.22.9.A09.1.454.CMB.1.raw
  modified_base (262)..(262): a, c, t, g, unknown or other
  misc_feature (262)..(262): n is a, c, g, or t
  modified_base (296)..(296): a, c, t, g, unknown or other
  misc_feature (296)..(296): n is a, c, g, or t
  modified_base (342)..(342): a, c, t, g, unknown or other
  misc_feature (342)..(342): n is a, c, g, or t
  modified_base (358)..(358): a, c, t, g, unknown or other
  misc_feature (358)..(358): n is a, c, g, or t
tcagacatacgcgtcacgaccggtgctcgatttagcgagacgcgcaggggggaggaactgctcagttaggacccagagggaaccatggaagccccagctcagcttctcttcctcctgctactctggctcccagagaccaccgggagaagttgtgttgacacagtttccagccaccctgtctttgtctccaggagagccgggccaccctctcctgccagggccaagtgagagtattacgcgtactacttagccttggtaccanagagctgccaggctcccaggctcctcatcgtatnatgcttaccaaaagggccactggcatcccagccaggttcagtggcnggtcggtctgggaagngtacttcactctacacctatacaacagtcctaagactcccgtgacgtattctacgacgtaggttttactacgttcgtactaggctagaccgtaaccacggtacgaccgttccgacgttttcggaccgtaggggtcccaaagtccgtggaacgacgttccgagacgtaacgtcggtaggtcctaggtaccacgtactcgttccgtccttccgtatccctttaccccgg

SEQ ID NO: 159154 - DNA, 638 bp, Homo sapiens
  misc_feature: GYAE6OF02HQ6WH.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttagacacagtttccagccaccctgtctttgtctccaggagagccgggccaccctctccgtgcgagggccaatgagagtattagcgtactacttagcctggacaacagacggcctggaccgaggcctaccgacggcctcctacgtactgtaatcgaatcgtaccttaaccggaaaacggcctaacgtcggctactcccgagccgtagttcgagttcggacgtaggtcggtacgtaggaagacgtacttacgactcgtaccactaactacgaacacgtcctaacgacgccgtacggtaacgtacttcgtagtcgtaagttttaacgtacgttgtacgaacggtcgtaagaccgttaaccgagtcggtcctaccgttcgtttacggccgtagggacctagtcgcgtaagtacgtacgacgtacgacggttagacgtcgacgaccgtactacgtcgttacgttccttacgtaccttaccgttaccccgg

SEQ ID NO: 159155 - DNA, 553 bp, Homo sapiens
  misc_feature: GYAE6OF02HF2JM.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtacaacagagctgcaggctccagctcctcatgtactgatgcttacaaaagggccaactggacatcccagccaggttcagtggcaggtgggtctagggaagagacgtttacactctacacatcaaacagccctagagcctgaacgtatctgtactagtttattactgtacagcagccgtaaccaaggtcgcctccgtacgtttggaccgtacggggacctaacgtcgtaggaagactacgagaacgtaacggtgtacggtacgtggacaccgtaatccgtagtcctttacgtacttccgttacccg

SEQ ID NO: 159156 - DNA, 676 bp, Homo sapiens
  misc_feature: GYAE6OF02GL6NT.22.9.A09.1.454.CMB.1.raw
  modified_base (256)..(256): a, c, t, g, unknown or other
  misc_feature (256)..(256): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagtagtattagcgactactagcctggtaccaacngagcctggccaggctccaggcctcctcactgtactgatgacttaccgaaaacgggcctaacgtggactacgtccccagacccgtaggttaccgtagggttcggacgtaggttcggggtaccgtaggggaaacggtacggtacctttaccgaccgttaccttaccaacccgtacttaccgaaaaccgtcggaccctaggacgtaccccggtagtaacggtactttaccgtgtaccgtagtttttactaccgttcgtacagtacctaggtaccgtaacgtaggtccgtaccgttaccgtcgtttaccgggaccgtacgggaccacggtcggtaggcgtaacgtcgaacgtaccgtacgtggtacggcctaagccccgttaagcgttaccgttcgttaaccttccgtactttcccgtaccccg

SEQ ID NO: 159157 - DNA, 697 bp, Homo sapiens
  misc_feature: GYAE6OF02G3RTQ.22.9.A09.1.454.CMB.1.raw
  modified_base (674)..(674): a, c, t, g, unknown or other
  misc_feature (674)..(674): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcggccaccctctcctgcgagggccaagtgagagtattagcgactacgttacgccgtaggtaaccaacgagacggtccgtcggccacgggtcctacccgacggtccttcctcgacgtgtatcggtatcggtaccgttaaccggaaaacgggtcccaacggtcggacctacctcccgacgtcccgtaggttccgaggtcggacgtagggttcggtacgtagggaacgtacgtaccttacgccttacctaccgaccgttaacaccgtaaacgtaccgtaacccgttaggaccgtacccgtacgtaaaccgttacgtttcgtacgtacgtttaagtttacttacgtcgttacgagtaccgtaacgtccgtaacgtacggtcgtcccgttacgttacgttaccggcgggtaaccgggtctacggtggtacggaacgtcgtacgacgtaacgtagtcggtacgtctcgaccgtacgtagttccgtnttaccgtactccgtaccgtcccg

SEQ ID NO: 159158 - DNA, 686 bp, Homo sapiens
  misc_feature: GYAE6OF02JNX9G.22.9.A09.1.454.CMB.1.raw
  modified_base (260)..(260): a, c, t, g, unknown or other
  misc_feature (260)..(260): n is a, c, g, or t
  modified_base (297)..(297): a, c, t, g, unknown or other
  misc_feature (297)..(297): n is a, c, g, or t
tcagacatacgcgtcacgaccggtgctcgatttagcgagacgcgcagggggagggaacgtgctcagttaggacccagagggaaccatggaagccccagctcagcttctcttcctcctgctactctggctcccagagaccaccggagaagttgtgttgacacagtttccagccaccctgtctttgtctccaggagagccgggccaccctctcctgcacgggcccaatcgagagtattagcgacttactagcctgtaccaanagacgcctggccaggcctccaggcctcctcactgtangtatcgtaccgttaccaaaaacgggcccaacgtcggacctacgttaccccgaggaccccgtacgggtttaccgacggtttacggcgtagggttacggtaccgtagggtaagtaacgtacgtttccacgttctaccaaccgtataccgtaaaccgcgtaacccgtaggacgtacctacgaacgttacttcgacgttcttaacgtttacttacgtcgtacgtacgtacgtcggtacctaaccgtaaggtccggtaccttccggttactttaccggccggtacggggcctaaggtcgtagggtacgacgttagaccgtaacggtactcggtaggtcctggaccctacgtacgtacgttccggttacctttcgtacccgttccgttaccccgg

SEQ ID NO: 159159 - DNA, 628 bp, Homo sapiens
  misc_feature: GYAE6OF02F30LS.22.9.A09.1.454.CMB.1.raw
tcagacatacgcgtcacgaccggtgctcgatttagcgagacgcgcaggggggaggaactgctcagttaggacccagagggaaccatggaagccccagctcagcttctcttcctcctgctactctggctcccagagaccaccggagaagttgtgttgacacagtttccagccaccctgtctttgtctccaggagagccgggccaccctctcctgcagggccaatgagagtattagcgactacttagcctaggtaccaacagaggcctggccaggctcccaggctcctcatgtatgatgcttaccgaaaagggccacgtggcactcccagccaggttcagtggctaggtggtctggaagacgacttcacgtctacaccatacaacgacgacctagagtcctagacgtattctgtacctagtttaacttacgtgttacacgtctacgtaccgtaaccgtaagtccggtccgttaccggtaccgttttacgggaccggtaacggggggtacctaacgggtccgtacgggaacgtacgtacgacggaaccggtaacgttcggtacggtccggtacgaccgtaacctacgttacccgttacgttaccgttccttaccgttaccgttacccccgg

SEQ ID NO: 159160 - DNA, 674 bp, Homo sapiens
  misc_feature: GYAE6OF02FO674.22.9.A09.1.454.CMB.1.raw
  modified_base (259)..(259): a, c, t, g, unknown or other
  misc_feature (259)..(259): n is a, c, g, or t
tcagacatacgcgtcacgaccggtgctcgatttagcgagacgcgcagggggaggaactgctcagttaggaccccagagggaaccatggaagccccagctcagcttctcttcctcctgctactctggcctcccagagaccaccggagaagttgtgttggcacagtttccagccaccctgtctttgtctccaggagagcggccaccctctcctgcagggccaatcgagagtattagcgactacttagcctggtaacccaanagacggcctggaccaggcctcccaggctcctcatgtatgatcgcttaccgaaaagggcccaacgtggcactccccgagaccgtaggttccgaggtcggaccgtaggttcgggtacgtagggaagacgtaccttcgaacttctacaacccatccgaaccagtacctagacgtaccgtacgacgtacttacgtagtacttaacgtttacttacttcgtacgtacgccgtacgtacccgtaaccgtaacggtaccggtacccgttacccggtaccggttttaccggacccgggtaacggggtacccgtaacggtccgtaggacgtacgtacgacgtaacgtacggttcgtacggtaccgtcgtaccgtacctacgttccgttaccgtttaccgttacctaccttacccgttacccccg

SEQ ID NO: 159161 - DNA, 674 bp, Homo sapiens
  misc_feature: GYAE6OF02G61NO.22.9.A09.1.454.CMB.1.raw
  modified_base (256)..(256): a, c, t, g, unknown or other
  misc_feature (256)..(256): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggttccaccctctcctgcagggccaatgagagtattagcgactactagcctggtaccaanagaggcctggccaggcctcccgaggcctcctcatgtatgatgtaccttaccgaaaacgggccacgtggctactcccagccgtaggttcaggtggactagggtgggtcgtagggaagacgtacttcgaaccttcgtacctaacctaactaccaaccacggtacctaacggacgtccctaggtacgtattccgtagtacttacgtttaacttaccgttgtcgtacgtcctacgtccgtaaccgtaacggtccggtacccgttacccgttacggttttccgggacccggtacgggggaccgtaacggtcggtacgggtagtacgtaccgacgtaaccggtacggtcgggtacgtccggtaccgacccgttaccgtagtttccgttacgtttaccgttccttaccgttcccgttacccccgg

SEQ ID NO: 159162 - DNA, 774 bp, Homo sapiens
  misc_feature: GYAE6OF02JYOFF.22.9.A09.1.454.CMB.1.raw
  modified_base (233)..(233): a, c, t, g, unknown or other
  misc_feature (233)..(233): n is a, c, g, or t
  modified_base (298)..(298): a, c, t, g, unknown or other
  misc_feature (298)..(298): n is a, c, g, or t
tcagacatacgcgtcacgaccggtgctcgatttagcgagacgcgcaggggggaggaactgctcagttaggacccagagggaaccatggaagccccagctacaggcttctcttcctcctgccttactcgtggcctcccagacgaccgaccggagaagttcgtgttcgaacactagtttccagccctacccgtgttctttgtctccgaggagcggccggtcccaacccttctccnggccagggtccaatggaacgtagtattacgcgtaccttagttacggcccgtacgggtaaccaagngtaacggccgttacggacgacggtctacccgaggccttcctaccgaagttggtaactacggtataacggtcctaaccggtaaaacgggacctgttacggccaactccccggaaggcccttaagggttccgaacgggtacggtccgtaaggggttccggttaacccgggtagggtaaaacgtcggttaacccgtcggtaaccttcccggaaccttcccgaaagttaaccggaaacctacccgggtacctttagtaccggaccctaaccgtaccggtactttaccggtacgtaccgttacggtttacttacccgttacgtcgttaacggtacgtacgtaccggtaacgtacgtaccggtccgtaccgttacgtttacggacggtacggtacgagtccggtagtacgtagttaccgaggtaccgacgtacggtcgacgtcgacctacgacgttctaccgttcgttaactgtcccgtacg

SEQ ID NO: 159163 - DNA, 807 bp, Homo sapiens
  misc_feature: GYAE6OF02JAHEP.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaagtgagagttattacggctaactacttagcctagggtaaccaacgtaggacgcctggcccgaaggcctcccgaggcctcctcgaacttgtactgtactcgtccgttaccaaaaagggtccctaacggtcggaccacgttccccgaacggtccgtaacgggtttcaacggttcggaccgtaacgggtttcgggtcgttaaggggaaacggtaccgtaaccgtttcgaaccttcgtacccaacctaattacccgaaaacacggtacctacgtaacgtccgttaacgtaacgttactttaccgtcgtacgttaacggttttaactttaccgttagttccgtaacgacccgtaacgttacccgttaaacccgtaagggtccgttaccccgttcgtttaaccggttttccgggacccgggttacgggggtaccccgtaaagggtccgggtacggttaacggtacgttaaccgtacggttaaccggtaaaccggtttcggtaccgggttaacccgtcggtaacccgttaaccggtaaacccttttcgtttaaccggttccctttcggttaaccttccccggttttaacccccgg

SEQ ID NO: 159164 - DNA, 791 bp, Homo sapiens
  misc_feature: GYAE6OF02GR3DT.22.9.A09.1.454.CMB.1.raw
  modified_base (261)..(261): a, c, t, g, unknown or other
  misc_feature (261)..(261): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagaggcgggccaccctctcctgcacgggccaagtgagagtattacgcgactacttagcctaggtaaccaanacggacggccgtggccagggtcctacccgaggccttacccgtctaacgttcttaagttcgggtcacgtacgttaccggtaaccgggaccggggtaccctaacggtttacgggttaccctaccccggaacgggtaccccggttaaggggtttacccaggggttaccgggtaccgtaacgggggttcggggttacccggttacggggggaactaacgggtaccggttttacccgaaccgttcccgtaccgtaaccctattaccggaccgtaccgacgttcccgttacgaccggttacggttaccgttaaggttaacgtttaacgttttacggtacgtttaagttttaacttacgttacgttaccgtacggacttaacgttaaataacgttacgtccgttacccgtacgttaacgttcggtttaccggaccgtaacgggtaacctaggtcgtagtacgtacgtacgtaaacgtcggtcgtaccggtctacggacctacgtcgttaccgtacgtttacgtctaccgttaccccg

SEQ ID NO: 159165 - DNA, 719 bp, Homo sapiens
  misc_feature: GYAE6OF02GE0H5.22.9.A09.1.454.CMB.1.raw
  modified_base (203)..(203): a, c, t, g, unknown or other
  misc_feature (203)..(203): n is a, c, g, or t
  modified_base (222)..(222): a, c, t, g, unknown or other
  misc_feature (222)..(222): n is a, c, g, or t
  modified_base (299)..(299): a, c, t, g, unknown or other
  misc_feature (299)..(299): n is a, c, g, or t
  modified_base (321)..(321): a, c, t, g, unknown or other
  misc_feature (321)..(321): n is a, c, g, or t
  modified_base (384)..(384): a, c, t, g, unknown or other
  misc_feature (384)..(384): n is a, c, g, or t
  modified_base (403)..(403): a, c, t, g, unknown or other
  misc_feature (403)..(403): n is a, c, g, or t
  modified_base (435)..(435): a, c, t, g, unknown or other
  misc_feature (435)..(435): n is a, c, g, or t
  modified_base (486)..(486): a, c, t, g, unknown or other
  misc_feature (486)..(486): n is a, c, g, or t
  modified_base (699)..(699): a, c, t, g, unknown or other
  misc_feature (699)..(699): n is a, c, g, or t
tcagacatacgcgtcacgaccggtgctcgatttagcgagacgcgcaggggggaggaactgactcagttaggacccagacgggaacccatggaagccccagctcacgcttctcttcctacctgctactctggctcccagagaccaaccggagaagttgtcgttgacactagtttccagcccacccgtgtctttgtctccgaggngagcggccaccctcgtccngacgcggacctagagagtagttagtacgcgtacttacgtcgcgtacgaaccaagacgacgcgcggaccacggtcccnccgagtcccttcactagtgtangtactcgtaccgttaaaccggaacgtaccacgtcggaccaccgccgaacgtcgtacgttacgngtcggcgtagggtccggtnaaaggtagccgttactccgtacctctaccacnctaaaccacgttaccgaccttagaccgtaccgtagtaacgttcttacggtntaacgttttacgtttaactcgtttgaacgtacggtactacggtacccgtaaggtacctcggtcccgtttacgttacggtttccgggaaccgggtcgggtaactagggtcccaagggtacctacgtacggtaacggtaaccggtacggtttcgggtaaccggcccttacggaacccgacgtttaccggttacctttcgttacccggttttaccncccgtttaaccccgtccccg

SEQ ID NO: 159166 - DNA, 816 bp, Homo sapiens
  misc_feature: GYAE6OF02JFO3B.22.9.A09.1.454.CMB.1.raw
  modified_base (304)..(304): a, c, t, g, unknown or other
  misc_feature (304)..(304): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagacgaccaaccggagaagttgtagttgacacagtttccagccaccctgtctttgtctccaggagtagcggccacctctctgacaggtccaatgacgagtattagcgactacttgcctggtaaccaactaggacgcctggccaggcctccgaggcctccgtacagtcgtatagntcgtactcgaaacggcctacgtcggtcactcccacgacctacggttacagttcggacgtacggttggtaccgtagggtaaacgacgttaccttacgaaccgttccgttaacgtaacccgtaaactaccgtaaaccgtacgtaacccggttaacgaaccggtccccgttaagggacgtttaacctttccggttacgggtacctttaaacgttttaaggttaacccttcgggtttaccaaaccggttacgttaaaccggtccccggtaaacggttaacggtttacccgggaccccgttttaaccggttaacgttttaccccggggtcccgggtaaaccgggggttaccccgtaaacgtaccgggtttaccgggaaacgtacccgggttttaacaaaacggggttacccgtaacggttaacggggttacccgtacccggttagggacccttaacccgggaacttttccggtacccgtttaacgttccccgttaaacgtttcccgttaacccccgg

SEQ ID NO: 159167 - DNA, 682 bp, Homo sapiens
  misc_feature: GYAE6OF02GGZOZ.22.9.A09.1.454.CMB.1.raw
  modified_base (298)..(298): a, c, t, g, unknown or other
  misc_feature (298)..(298): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccgggagaagttgtgttgacacagtttccagccaccctgtctttgtctccaggagagcgggccaccctctcctgcagggccaatgagagtattagcgactacttagcctggtaccaacagacggcctggccacggcctcccgaggcctccgtcatgtatnatcgtcttaccgaaaacggcccaccgtggaccactccccgacgcccgtaggttccgaaggtcggcgtaggtcgggtcgtagggaagtaggtacctttcaacttcgtaccacctataccgaacacgtaccgtacggacgtaccctaggtaccgtactttcgtagttaccttaagtttaacgtttaccgtgtaccgtacgtacgacggtaaccgttaaccgtaacggtccggtacccgttcccgttacggttttaccgggacccggggaacggggtacccgtaacgggtccgttacgggaacgtacgtaccggacggtacggtaaccggtggtaccggtcgcgtacccgacgttactccgtcgttacctcttactcccttccccgg

SEQ ID NO: 159168 - DNA, 626 bp, Homo sapiens
  misc_feature: GYAE6OF02GUW26.22.9.A09.1.454.CMB.1.raw
  modified_base (610)..(610): a, c, t, g, unknown or other
  misc_feature (610)..(610): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgctccaggagagcggccaccctctccgtgccagggccaagtcggaagagtattagcgtaacttacttagcctaggtaccaacaggacggcctggtccaaggcctcccgaggctcctcatgtatgatgcttaccgaaaaggccagtcggcacgtcccagccaggttcaggtgcaggtggtacgaggaagagacttacgactctacgaacatacaaacgtacgaccgtaacgacgaccctaggaaccgtacgtttccgtagtaccgttaagtttacgttactcgtacctaaggactacgacgttaaccgaaggtccgtaccgttaccgtacgttttacgggaccggtacggggacctaaggtccgtagggaacgtacgacgtacggacgtaacgtggtacgaccgtgaaccacgtacttcgtcgttacctntaccgtccgttacccg

SEQ ID NO: 159169 - DNA, 653 bp, Homo sapiens
  misc_feature: GYAE6OF02JCHGM.22.9.A09.1.454.CMB.1.raw
tcagacatacgcgtcacgaccggtgctcgatttagcgagacgcgcaggggggaggaactgctcagttaggacccagagggaaccatgggaagccccagctcagcttctcttcctcctgctactctggctcccagagaccaccggagaagttgtgttgacacagtttccagccaccctgtctttgtctccaggagaggcgggccacccgtctcctgcgagggccaatgagagtattagccgactacttagcctggtaaccaacaggacggcctggccaggcctcccgaggcctcctcatgtatgatcgtcttaccgaaaagggtccacgtggacaccgtccgacgaccctaggttccaggtggacgaggtcgggtacgtagggaacgtacggtacctttacacgttctaccgactactacaacacgtaccctagacgtccgtagtaacgtacttacgtcgtacgttagtttatacgttgtacgacgtcgtacgtaccgtaacgtaggtccgtacccgttaccggttacctttacgggtccccgggaagggggtacccaaggtccgtacgggtacgacgtacgacggtaacgtacgtcggtaggccgtacgtaccgacgtacgttacgttacttccgttactacctccgttcccg

SEQ ID NO: 159170 - DNA, 845 bp, Homo sapiens
  misc_feature: GYAE6OF02JK8SI.22.9.A09.1.454.CMB.1.raw
  modified_base (134)..(134): a, c, t, g, unknown or other
  misc_feature (134)..(134): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccaganaccaccggagaagttgtgttgacactagtttccagccaccctgtctttgtctccaggagacgcggccaccctctccgtgcgagggtccaagtcgagtagtattacgcgacttacgttagcccttggtaaccaacgagacggtacccgtggcccaaggccctaccccgaggcctcctcaagttcgtatcgtattcgaccgttaccgaaaacgggtcccacgtacggcctaacgtccccgaggtacccgtaggttacctaggttcgggaaccgtaggggttacggttaccggtaaggtaaacgggtaccgttaaccgtttccgaaaccgtttaccgtaccccgaactaaacctaccgtaaaacccgtagtaacccgttaacggtacgtacccgttacggtaaccgtactttaccgtacgttaaccggttaagttttaaccgttacttcggttaaccgacgttaccgaaggttacccgtaaaccggttaacgtcgggttaccccgttacccggtttaacgttttaccggggaccggttaaccgggggtaacccgtaacgggtaaccgggttaccggtaaacggtaccgttaccggtaacgggtaaacccggtaacggtttccgggaacggttccggtaaccgtaccccgtaacgtacccggtttcgttaaccggtttcctttaacccggttcccttaaccccggtttaccccgg

SEQ ID NO: 159171 - DNA, 687 bp, Homo sapiens
  misc_feature: GYAE6OF02ITHB4.22.9.A09.1.454.CMB.1.raw
  modified_base (149)..(149): a, c, t, g, unknown or other
  misc_feature (149)..(149): n is a, c, g, or t
  modified_base (186)..(186): a, c, t, g, unknown or other
  misc_feature (186)..(186): n is a, c, g, or t
tcagacatacgcgtcacgaccggtgctcgatttagcgagacgcgcagggggaggaacgtgctcagttaggacccagagggaccatggaagcccagctcagcttctctcctcctgctactctggctcccagcgaccaccggagaagttgngttgacacagtttccagccacctgtctttgctcagangcggccaccctctctcgcacggccaagtcgagtacgtattacgcgtacgtacttacgccttcggaacctacaggaggccttaggccctaaggcctcccgacggtcctccgtcattgtactgatgccgttacgaaaacgggcctaaccgtggtacctaactccccgtagtcccgtaacgggtttacaggtaccgggtcgtacggttaacgggtccgttaggggaaacgtacggtaacgttttcccgaacgtttcccgtacgtaaccaacttccgtaaaccgtacgtaccaagtacgtcctacgaagtctacggtgtacctaggtttaatccggtagtacgtacgactaacggtcctaacgtgtacggtacccttacggttaccttcggtacccgtacgggtcccaacgggttccgtaggtaaccgtagtaccgagtccgaaggtcgtacggtctacgtacctacgtacgttacgtaccgtcgtttacgaccgtcttacccgg

SEQ ID NO: 159172 - DNA, 666 bp, Homo sapiens
  misc_feature: GYAE6OF02HXJ85.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagcccaccctgtctttgtctccaggagaggcgggccaccctctcctgcagggccaagtgagagtattagcgactacttagctcggtaccaacagaggcctggccgaggcctcccaggctcctcatcgtatgatcgtaccgttaccgaaaacgggcctacgtagacacctacccacgcccgtaggttcgaggtcggcgtagggtcggtcgtaggaaggtacgtacgttactaacttcctaccaacctataacaaccgacggtaccgaacgtacgtccgtacgaacgtacgtttcgtagtcgtttaacgtttacttacgtacgtagacgtacgtacggtaccgttaacgacggttccggtacccgttaccgttaccgggtttcggacccgggaagggtcccgaaggtcggtaggaacgtactaccggacgtacggtaacggtggtcggacgtcgaccctacgtacttaccgtcgttacctttacgtacgttcccgttacccg

SEQ ID NO: 159173 - DNA, 794 bp, Homo sapiens
  misc_feature: GYAE6OF02IF9U8.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacactagtttccagccacccttgtctttgtctccaggagacgcgggccaccctctcctgcgaggccaatgagtagtattagactactacgttagccgtcggtaccaacgaggacggcctggccacggcctacccgaggcctctcatgtactgtatcgtaccttaaccgaaaacgggcctaacgtggtccacgtccccacgtacccgtaggttaccgaaggtcggacgtagggttcgggtacgtagggaaacgtaggtacctttacgtacgtccttaccgtaacctaacgttaccaaacgtaccgtaccgtaacggtaccgtacccggtaacgtaaccgttaacgtttcgtagttaacgtttaacgtttaactttaccgttacgttacgtacggtaccgtacggttacccgttaaccggtaacggttaccgggtacccgtttacccgggtttaccggtttttaccggggacccgggtaaccggggggtaccgtaaccgggtacgggtacgggttaaacgtaaccgttacggaaccgggtaaccggtaacgttcgggtacggttaccggtaccgtaaccctaaccgttcgttccctttacggtttaccctttaccgttacccgttaccccgtttacccccg

SEQ ID NO: 159174 - DNA, 636 bp, Homo sapiens
  misc_feature: GYAE6OF02GPFJ4.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacgagaggcctggccaggcctcccgaggcctcctcatgtatgatgccttaccgaaaagggccacgtggcactcccagccaggttcaggtcggcaggttcgggtacgtagggaaagtacgtactttcacgttccgtaccaacctactaccgaacacgtaccctaaggcgtacctaggaacgtattctacgtacgttagtttacttacctgtcgacgtctacggtaccgtaaccgaggtccggcccgttaccggttacgtttacgggccggtacgggggtaccaaggtcggtagggacgtacgtacgacgtaccggtaacgtcggtacggtcctggacccacgtacgttccttacggttacctaccgtacttccccgttaccccg

SEQ ID NO: 159175 - DNA, 680 bp, Homo sapiens
  misc_feature: GYAE6OF02FPLY2.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttacgcctggtaccaacagacggcctggccaggcctcccgaggtcctccgtcatgttatgattgtccttaccgaaacggggtcccacgtacgggactactcccgagcccgtaaggtttccaggttggcgtaggttcgggtacgtagggaagggtacgtacctttcgaaccttctacaacctacgtaccgaaacacgaccctaggacgtccgtagtacgtcttactgtcttagtttaattacgtcgttactacgacgtaccggtaccgtaaccgtacgggtccgacccgttccgttaccgttttgggacccgggtaacggggaccgtaacggtcgtagggaacgtacgtaccgaggtaaccgtaacggtcggttcggtaccgtcgaccgtaacccgttacgttccgtttcggttacctttcgtaccgttccccgttaccccg

SEQ ID NO: 159176 - DNA, 755 bp, Homo sapiens
  misc_feature: GYAE6OF02HGIJG.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacacgtttccagcccaccctgtctttgtctccaggagagcgggcccacctctcctgcgacggccaatgagagttattagcgtaactacgttacgccgtacggtaaccaacgacggacggccgttcgggacccacgggtccctacccggacggccttcccctcgtacgtacgttagtacgtacgtacggtaccttaacccggaaaaacggggtcccaaccggttcgggaacctaccgtacccgacggacccttacgggttacctacggtacgggacgtaaggggtccgggttaaccgttaggggaaacgtacgttaccgttacctaccgttcctacctacccgtaactaaccgtaaccgtacgtaaccgtacgtacgacgtaccgtaacgtacgttacgtacgtacgtttacgtttacttacgtcgtagtacgtacgacgttaccgacgttacggtaccgtaccgttaccggttacgttaccgggtacggtaccgggaccgtaacgtcggttacggacgtacgtacgacgtacgtaacgtcggtacgtacggtccgtacgacgtactcggttacgttacgttcttacgttccctacccg

SEQ ID NO: 159177 - DNA, 656 bp, Homo sapiens
  misc_feature: GYAE6OF02INZZD.22.9.A09.1.454.CMB.1.raw
  modified_base (363)..(363): a, c, t, g, unknown or other
  misc_feature (363)..(363): n is a, c, g, or t
  modified_base (400)..(400): a, c, t, g, unknown or other
  misc_feature (400)..(400): n is a, c, g, or t
tcagacatacgcgtcacgaccggtgctcgatttagcgagacgcgcaggggggaggaactgctcagttaggacccagagggaaccatggaagccccagctcagcttctcttcctcctgctactctggctcccagagaccaccggagaagttgtgttgacacagtttccagcccaccctgttctttgtctccaggagagcgggcccaccctctccctgcgacgggccaatgagagtattagcgtactacttagcctggtaccaacagaggcctggaccaggcctcccgaggcctcctcatgtatgtatcgtacttaccggaaaagggccaacgtggacactccacgccaggttcgagtcggacgnggtcggtcgtagggacaggtattcactctacacctancagcacgtcctagctacgtcgtaacggtagttagtttcgaacgttacgttttaacttacgtcgttacgaacgtacttaacttaattaacgtaaccgttaccggtacccttaccgggttaacgtttacggttttacggaaccggtacgggtaaaccaggtaccgaggtacgaacgtaacgtaaacggtacgttacggtacgtacgtacgaccgttaacgtacttaccgttacgttaccgttacctaccgttaccccg

SEQ ID NO: 159178 - DNA, 566 bp, Homo sapiens
  misc_feature: GYAE6OF02HASYQ.22.9.A09.1.454.CMB.1.raw
  modified_base (433)..(433): a, c, t, g, unknown or other
  misc_feature (433)..(433): n is a, c, g, or t
  modified_base (525)..(525): a, c, t, g, unknown or other
  misc_feature (525)..(525): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagacggcctggccaggcctcccgaggcctccctcagtgtactgatgcttaccgaaaagggccacgtcggcacgtcccagcctaggttcaggtggactggtcggtctggaagagactcaatctacaccatacacacgcgtagcgtctgacgtattctgtacgtagtttactagtcgtanagtcacgtccgtacgtagtcgtccgtccgttcgtttacggccgtaggggtaccgaggtcgtaggagtacgtacgacgtacgtacgtgtcggngtcgactacgtacgtccgtagttacctactcgtcctacccg

SEQ ID NO: 159179 - DNA, 717 bp, Homo sapiens
  misc_feature: GYAE6OF02GRWYW.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccgggagaagttgtgttgacacagtttccagccacctgtctttgtctccaggagagcgggccaccctctcctgcagggccaatgagagtattagcgactacttagcctggtaccaacagaggcctggccaggctccaggctcctcatgtatgatgtcttaccgaaaagggccacgtggacactcccagaccgtaggttacgaggtcggacgtaggttgggtcgttagggaaagagtaaccgtttacacgttactacgtaacccaagtacccaaaccgacgtaccctaaggaacgcccgtacggaacgttaacgtttcctacggtaccgttaagttttaacgttaaccgttgtaccgtaacgacgtaacggtaccgtaaacccgtaaggtccggtaccccgttaccggttaccggtttttacgggacccggtacggggggaccctaaacggtccggtacgggaacgtacgttaaccgaacggtaaccggtaacgttcggggtacgttacggtaccggtacctaaccgttaccgtttaccgttaccgttacctttaccgtaccttcccgtttaacccccgg

SEQ ID NO: 159180 - DNA, 798 bp, Homo sapiens
  misc_feature: GYAE6OF02IJOAN.22.9.A09.1.454.CMB.1.raw
  modified_base (201)..(201): a, c, t, g, unknown or other
  misc_feature (201)..(201): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggcctcccgagacgaccgaccggagtaagttggtgttgacacgtagtttccagcccaccctgttcttgtctccgaggngagcggccacccgtctcctagccgagggaccaagtgacgtagttaacttaggccgtaacttaccttaacgccgttacggtaacctaacgaggtaccggtccgttaccgggaccgtagggtacccctaccccggtagggtcccttaccccgtagtaagttacggttaagtcggtaacgttcccggtaacctttaaaccccgggaaaacgggtccctaacggttcgggaacctccgttacccgaggtacccgttaggttacagggtcgggtacggtaccggttggtaccgaagggtaacgtacggtcctttaccgaccttaaccgactaaccgtaacgtaaccctaacgacgtacgtaacggccgtacgtaacggtactttctacgtacgttacgtttacgttaacgttctaccggtaagtccgacgtaccggttaaccgtaaacggtcggtaacctcccggttacgttcgggttaaccggccggtaggtacgtcgtaacgggtacgtccgaggttaccgaagcgttacgggtagttccggacttaccgacctcgttaccgtcggtttactaccctttacggtacccgtcccggttacc

SEQ ID NO: 159181 - DNA, 844 bp, Homo sapiens
  misc_feature: GYAE6OF02I3M9R.22.9.A09.1.454.CMB.1.raw
  modified_base (773)..(773): a, c, t, g, unknown or other
  misc_feature (773)..(773): n is a, c, g, or t
tcagacatacgcgtcacgaccggtgctcgatttagcgagacgcgcagggggaggaactgctcagttaggacccagagggaaccatggaacgccccagctcagcttctcttcctcctgctactctcggctcccagagaccgaccggagaagttgtgttgacctacgtagtttccacggccacccgtagttctttcggtcgttacccgagggacgtacggccgggcccctacccttcctccttcgccgaacgggtacccaagtcgaaggtacgttaacttacggacctacttaccgttacggcccttagggtaacccaacgacggtagggcccttaggcccgacggccctccccgacgggtcctccgtactatcgtatcgaacttcggtactaccggtaaaagccgattaccggaccacgtcccctaagcccgtaggtttaccgagtacggcgtaacggttggtaccgtacgggtaaagtccggtaattacaaccgttccgtaccacctaaacgtaccaaaccggttaccgaccttaaggggccctaccggttacggtaacgttaccgtttaccctacggtacgttaaacgtttccggtaagttttaccgccggttaaacgtccgttagtaaccccggttacgaaacggttcgggttacccgtttaacccgtttccggttttaccgggacccggggttagggtaacccccgtaggttacccggttacggtacggaccgtttaccgacggtaacggtccgttacggaaccgggttnaacggtaaccccgttcctaacgggtcctttacggttaaccgtttccccgttaggtcccccgttttccccgg

SEQ ID NO: 159182 - DNA, 729 bp, Homo sapiens
  misc_feature: GYAE6OF02JDCSB.22.9.A09.1.454.CMB.1.raw
  modified_base (202)..(202): a, c, t, g, unknown or other
  misc_feature (202)..(202): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctacccagagaccgaccggtagtaagttgtggttgacacgtagtttccagcccacctgtctttgtctccgaggtagngccgggtccaccgttcctctcgccgaggtccaagtgagacgttagttagccgtaactacttagcccgtagtaacccaacgaggacggcctggccaggcccttacccgacggccttcccgtaccgtattacgtaagtcggtattcgtaccttaccggaaaaacgggtccctacgtcggactacctacccgagtacccggtagtacggacggtcggtaccaggttccgggtagaagggtaacgtaacggtacctttacgaacccgttctaccaacggtaacttaccaacggacttacgagaccgtcgtaacgactactacgtacgttcgttaaagtttctacctcgttagaacgtacgtatacccggtaacgtaacggtccgtacccttaacggtcccggtttagggacccgggttaacgggaccgtacgtaccgtaggaagtacggttaccaaggtaaccgaaggttcgtacgggtcctagaccctagtacgtcgtttaacggttccttacgtccttacccttaccgg

SEQ ID NO: 159183 - DNA, 629 bp, Homo sapiens
  misc_feature: GYAE6OF02F6VYY.22.9.A09.1.454.CMB.1.raw
  modified_base (458)..(458): a, c, t, g, unknown or other
  misc_feature (458)..(458): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctctgcgacgggccaatgagacgtatagcgactactagcctcggtaccaagagacggctgccaggcctcccaggctcctcatgtatgatcgtctaccgtaaacggccacgtggccacgtcccagtacgacgttcaggtggactaggtcggtacgtaggaagcggtacttcgacgtcgtaccacctagtacctaaacacgtaccctacgtacgaccgtagtaaccgtatttccgtagcctttaagttatttacncgttacacgccgaacggtcgtaacgtacggtcgacccgttaccgttacgtttcgggacccggtacggggtcctaaggtccgtggaagtaaccgtgtaaccggactaacggttcgtcggtacctacgacgaaccgtcttcgttacgtcctacgttacgttaccctaccccgg

SEQ ID NO: 159184 - DNA, 726 bp, Homo sapiens
  misc_feature: GYAE6OF02FX4JC.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagccgactacttagcctggtaccaacagagcctggccaggcctcccgaggtcctcctcatgtatgatcgaccttaccgaaaacgggtccaacgtggaccactcccgacgccgtaggttcaggttcggacgtaggtcgggttacgtagggaaaggtacggtacctttacgtaaccgttcctaccgtaacctaacgtacctaaaccgtaaccgtacccgtaaggtaccgtacccgtacggtaaccgtacgtttccgtagttacgtttaacgttttaactttaccgttcgtaccgtacgtacgtaacgttcccgtaaccgtaacggtccggtacccgttaccggttaccgttttccgggacccgggtaacggggtaccctaggtccggtaggtaacgtacgtaccgtacggtaaccgtacggttcggtacggtaccgtcggacccgtaccgtacgttccgtttagttaccgtttaccgttacctttcccgttacccccg

SEQ ID NO: 159185 - DNA, 811 bp, Homo sapiens
  misc_feature: GYAE6OF02JKIM5.22.9.A09.1.454.CMB.1.raw
  modified_base (202)..(202): a, c, t, g, unknown or other
  misc_feature (202)..(202): n is a, c, g, or t
  modified_base (336)..(336): a, c, t, g, unknown or other
  misc_feature (336)..(336): n is a, c, g, or t
tcagacatacgcgtcacgaccggtgctcgatttagcgagacgcgcagggggaggaactgctcagttaggacccagagggaaccatggaagccccagctcagcttctcttcctctgctactctgctcccagacgaccaccgggagaagttgtgttgacactagtttccagcccacccttgttctttcgtcctaccgtaggagngccgggcccaccccgtctcctgcgagggccaagtgaagagtattacgcgaaccttacgttacgccgtacggtaaccaaacgagacggtcctaggaccgacgggtcctacccgacggccttccctgactgtacgngtagtcgtaccgttaacgaaaacgggtccctaacggtcgacctaaccgtacccgacggacccgttagggttaccgagggtacggcgtacgggtcggttaggacggtaaggacgtaccctttggaaccctttctaccgaacgttaaccttacggaaacccgtagtaacccgtagggaacctccgtaacggtaaccgttaccgtcgtagttaaccggtttaacgtttacgtttaaccgtcggttaccggtaagtaccggtacggttaaccgtacggttaccggtaccggttacccgttccggtttacccggttaccgggtaccggggacgggtaacccgttaacgccgggttagtaacggaaccgttacggaacggttaaccgtaacgggttcggttacggcccggttaacgtaccgtaccttaacgggtttacctttccgggtactttaacccgttccgttaccccggttacccgg

SEQ ID NO: 159186 - DNA, 725 bp, Homo sapiens
  misc_feature: GYAE6OF02G64XD.22.9.A09.1.454.CMB.1.raw
  modified_base (457)..(457): a, c, t, g, unknown or other
  misc_feature (457)..(457): n is a, c, g, or t
tcagacatacgcgtcacgaccggtgctcgatttagcgagacgcgcaggggggaggaactgctcagttaggacccagagggaaccatggaagccccagctcagcttctcttcctcctgctactctggctcccagagaccaccgggagaagttggtgttgacacagtttccagccaccctgttctttcgtctccgaggagacggcgggccaccctctccgtgcgagggccaagtggacgtagtacttacgcgtactacgttacgcctacggtaccaacggagacggcgtcggccgacggcctccgacgcctcctcatgtatgactcgtaccgttaccgaaaacgggtcctacgtacggaccacgtccgacgtcgtaacggttcgaggtcggacgtgggtcggtacgtaggaagtacgaccgttacacgtactaccactaactacaacgacgtaccgtanacggccgtagaacgtacttcgtacggtacttacgtttacttacgtcggtactacggacctacgggtaaccgttacgtacggtccggtacccggttacccggttaccgggttttacgggaccgggtaacgggggtcgtaaacggggcggttaaacggacggtaacgtccggtaacggtaacggtaacggttggtaccggttaccgtacggaacctaccggttagttcccgttaccgttaccgtttacccgtccgttcccgttaaccccg

SEQ ID NO: 159187 - DNA, 760 bp, Homo sapiens
  misc_feature: GYAE6OF02GNC6M.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagaggcgggccaccctctcctgcgaggccaatcggagtagtattagacgtactactacgcctacggtaaccaacgaggacggtcccgtcggaccgacggaccgtccccgacggtcctcccctcagttacgtacgttagtagtcgtaccgttaaccggtaaaaaacgggacccgtaccgttacgggaccctacgtacccccgaggtacccgtaacgggttcctaacgggtacggtaccgtacgggttacggggttaccggtaaggggtaaacgtaacggttaccttttacccggaaccgtttaccctaccaacccgtactaacccaaacgtaccgtaccgtaagaccgaccgtaacggtaaccgtacttacgtacgtacttaggtttacttaactcgtacgacgacgtagtacccgtactacggtccgtcccgttacgtacgtttccggaccggtacggggtacctacgtacgtcgggaagtacgtacgacggtaaccgtaacggtcggtaacggtcctacggtacccacgttactccgttaccggtatttccgtacttcccgttaacccg

SEQ ID NO: 159188 - DNA, 814 bp, Homo sapiens
  misc_feature: GYAE6OF02G89J0.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagacgaccaccggagaagttgtgttgacactagttccagccctacctgttctttgtctcaggagaggcggccctaccgtctccgtgcgacgggccaagtcgaagtagttaagttacgacgtaacttacgttacgtccgttacgggtaacccaaagacggtaaccggtcccgttacgggacccgaacggggtcccttacccccggaacgggttccccttaccccgtaccgtacgttacggttaaccgtaggtacgttcgttacccgttaaacccggaaaaacgggtcccgtaacgtcgggacctaccgtcccgaacgtacccggttaggttaccgtaggtcggtacgtaaggttcgggttaccgtaaggggtaaacgtcgtacctttccgtaacgtccttaccgaacctaacgtacgaacgaccgtaccgtaggaccgtaccgtacgtacgtacgtttccgtacgtacgtttacgtttaactcgttacgtacgtacgacgtacgtaccgtaacgtacggtccgttacccgtccggttaccggtttacgggacccgggtaagggtaccgaccgttaggtacgtaacggtactacggtacggtaacgtaggtacgggttaccgacgtaccgacccgtacgttacgttaccggtacgtttcccttacgtacccgttaccgttaccccg

SEQ ID NO: 159189 - DNA, 639 bp, Homo sapiens
  misc_feature: GYAE6OF02JWGIA.22.9.A09.1.454.CMB.1.raw
  modified_base (256)..(256): a, c, t, g, unknown or other
  misc_feature (256)..(256): n is a, c, g, or t
  modified_base (292)..(292): a, c, t, g, unknown or other
  misc_feature (292)..(292): n is a, c, g, or t
  modified_base (346)..(346): a, c, t, g, unknown or other
  misc_feature (346)..(346): n is a, c, g, or t
  modified_base (383)..(383): a, c, t, g, unknown or other
  misc_feature (383)..(383): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctcctcctgcagggccaatgagagtattagcgactacttagcctggtaccaanagaggcctggccaggcctccgaggctcctcatgtangatgcttaccgaaaggccacgtggcactcccacgccgagttacaggttggacgnggtcggtcgtaggaagacgtactctactctacaaccntaccaacacgcctagacgtacctagacgttactcgtgtaccttaagtttaactacgttcgtacgactacgaacgtaccgtaacgtaacggtcggttacccttaccgttaccgtttcgggacccgggtacggggtaaccctaagttccggtacggaagaccgttacggacggtaacggtaaccggtcgggtaccgcggttacgaccgtaccgttacgttacgttaccggttcttacccgtacgttccccgtaccccg

SEQ ID NO: 159190 - DNA, 877 bp, Homo sapiens
  misc_feature: GYAE6OF02HW46P.22.9.A09.1.454.CMB.1.raw
  modified_base (195)..(195): a, c, t, g, unknown or other
  misc_feature (195)..(195): n is a, c, g, or t
tcagacatacgcgtcacgaccggtgctcgatttagcgagacgcgcagggggaggaactgctcagttaggacccagagggaaccatggaagccccagctcagcttctcttcctcctgcctactctggctcccagagaccacggagaagttgtgttgacactagtttccagcctaccctgtctttgtctccaggagngcgggcctaccctctcctggccgacgggaccaagtgagtagtattagcgactactacgccgtaggtaccaacgaggacggcctcggaccgtacggcctccgacggccttcctactagtacgtatagagttcgaccgttaaaccgaaaacgggtcctacggtcgacctactaccccgtacggtaccgtacgggtttcgacggttcgggcggtacggttacgggtcgtaaagggtaaacggtaacgtactttaccgtaccttacgaccctaacctaacgttaaccgaaaccgtaccggtacccgtacggtaaccgccccggtaagtaccgtttaacttccggtaagttaacccgttttaagtttaaccttacggtttacggtaaccaacggtttacccgaacgggtttacccgtaaacgggtccggttaacccgggttacccctttaacccgggttacgggttttccggggaaaccccggggttacgggggtaaccccgtaacggttacgggttaaacggggaccgttaacgtacccgggtaaaggttacccgggttacgggtcggggtttaacccggaacggttccggtaaaccccgtaacccggtttaacggttttaccggtttacccgtttaaaccccgggttttcctttaacccccgttccccgggtttaaaccccccgg

SEQ ID NO: 159191 - DNA, 745 bp, Homo sapiens
  misc_feature: GYAE6OF02IYOIE.22.9.A09.1.454.CMB.1.raw
tcagacatacgcgtcacgaccggtgctcgatttagcgagacgcgcaggggggaggaactgctcagttaggacccagagggaaccatggaagccccagctcagcttctcttcctcctgctactctggctccaggagaccaccgggagaagttgtgttgacacgagtttccagcccaccctgttctttgtctccgaggagagcgggcccaccctctcctgcgacggccaatgagagtattagcgactacgttagcctaggtaccaacgagacggccgtggaccgaacggcctcccgaggcctccgtcagtcttagtcgagttcgaccttaccgaaaacggggtccacgtacggtaccaccgtcccacggtcccgtaggttacgtacggggtcggtacgtaggggttcggtcgtaacggggtaacggtaacggttaccttacccacggttaccctacctaacccgtaaccttaccgaaacctaccgtaccggtaaccgaccgggtaccctaacggtaaccgtattacggtacgtacttttaagtttacgttacgttcgtactacggtaccgtacgaccgtaccgtaccggtccggtcccgtttaccggtcggtttcgggaaccgggtccgggacctacgggcggtaaggcgtacgttaccgacggtaacgtacggttacggccgtacgtccgtacgaccgtttacgttcggttaccttcggtttacccgttaccgttcccgttacccg

SEQ ID NO: 159192 - DNA, 797 bp, Homo sapiens
  misc_feature: GYAE6OF02H1M49.22.9.A09.1.454.CMB.1.raw
  modified_base (190)..(190): a, c, t, g, unknown or other
  misc_feature (190)..(190): n is a, c, g, or t
tcagacatacgcgtcacgaccggtgctcgatttagcgagacgcgcagggggaggaactgctcagttaggacccagagggaaccatggaagccccagctcagcttcctcttcctcctgctactctggctcccagagaccacggagagttgtgtagacactagttccagccacctgtcttgtctccaggagngcggccaccctctcctgacgagggaccaaagtcgagtagtaattagcgaatacttagccttaggtacaacgtaggacgtctacggacacggcctaccgaacggcctcctatactacgttaagtcgaactcgtacttaccgtaaaacggcctaacgtcggacctacgtaccccgacgtaccgtaacgttacgtaacggtggtaccgaaggttacggtaccgttaaggggtaaacggtaaggtaaccctttaccggtaaccttaccgtttaccgaaaccctaattaacccggtaaacgaacgggtaccccgttaaaggacccgtaccgttaacggaaaccgggtttaatttacggtacgttaacgttttaacgttacgttcggtaactacgtacgtacgtacggtactaaacggttcggacctttaccgtaaccgtttacggcccgggtaaccgggtaccggaaacttacgggtacggtaaacgtacgttaaccgaacggtaaccggttaaccgtaacgtcggggtaacctacggaacccgttaaacgttaccgtacggttaaccgtttaccgttacccgtaaacctttccggtaacccccgttaaccg

SEQ ID NO: 159193 - DNA, 669 bp, Homo sapiens
  misc_feature: GYAE6OF02GBGBU.22.9.A09.1.454.CMB.1.raw
  modified_base (266)..(266): a, c, t, g, unknown or other
  misc_feature (266)..(266): n is a, c, g, or t
  modified_base (307)..(307): a, c, t, g, unknown or other
  misc_feature (307)..(307): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccgggagaaggttgtgttgacacagtttccagcccacctgtctttgtctccaggagagcgggccaccctctcctgcgagggccaatgagtgtattacgcgtaactcgttacgcctcggtaaccaacgngacggtcctggccaggcctcccgaggcctacctcattgtangtatcgccttaccgaaacgggcctacgtggaccacgtcccagcccgtaggttcaggtcggacgtaggttcgggtacgagggtaacgagtaccgttcacgttccacacctataccaacacgcctaagacgctacgactagtctagtacttagttacttacgtcgtacgctacgtacgtaccgtacgtaacggttccgtacccgttaccgttaccggttttaccgggaccgggtaccggggaccgtacggtacggtacggtacgtaagttaccggaacggtaccggtaacggttcggtaggttaccggtaccgaccgtacctacgtcctttaccgttaccgtactttacccgtcccttaccccg

SEQ ID NO: 159194 - DNA, 796 bp, Homo sapiens
  misc_feature: GYAE6OF02HT3H1.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctctgctactctggctcccagacgaccaccggagagttgtgttgacactagttccagcccacccttgtcctttgtcctccgaggagacggtccgggcccaccctctcgtgcgacggccaatcgagagttatacggcgtaacttacgtacgtccgtaggtaaccaacagggacggccgtcggaccgagggtccctcccggacggtcccttaccgtctagttcggtaactacggtactacggtacccttaaccggaaacgggtccctaacggtcggttaaccacccttccccggaacgtaccgggttaacggttaccgagggttacgggtcgtaaccgggggttcggtaccgtaggggtaaacggacgttacccgttttacaccgtttccgtaaccgaccctttaacggaccgaaacctcgggtaacccgtagacccgtcgtaccgtaacgtacgttcgtacgtaccgtttaagtttaccttcgttacgtacgttacgaccgttacggaaccgttacgtacggtccggtacccgttaccgttacgttaccgggtacccgggtacgggtaccgtaacgccggttagaacgtaccgtaccggtagaacccgtggtaccggtacgggtcgtacccgtacgtaacccgttagtccgtttaccgttccttaccgttcccgttacccgtaccgg

SEQ ID NO: 159195 - DNA, 771 bp, Homo sapiens
  misc_feature: GYAE6OF02I0MJ4.22.9.A09.1.454.CMB.1.raw
  modified_base (251)..(251): a, c, t, g, unknown or other
  misc_feature (251)..(251): n is a, c, g, or t
  modified_base (264)..(264): a, c, t, g, unknown or other
  misc_feature (264)..(264): n is a, c, g, or t
  modified_base (306)..(306): a, c, t, g, unknown or other
  misc_feature (306)..(306): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccgaccggagaagttgtagttgacactagtttccagcccacctgttctttgtctcaggtagagcggcctaccctctcctgcgaggaccaatagagagttatagcgacttacgttanccgtagtaccaanagacggctcgcgtacggcctccgagcctccactatgtagtgngtcgaccgttaaccgaaaggtccaacgtggacctactcccaagtacccgtaaggttacacggtggtaccgaggttacggtcgtaacgggtaaaggcgttacctttacacctttacgacctaacgactaaaccgaactaacgtacccgtaacggtcaccgtaacaacgttacgttacgttacggttacctttaagtttaaccgttacttaacgtcgttaaacgagtaccggttaacccgaaaccggttaaggtaccgtacccgtttaacccgggttacgttttaccgggaccccggggttaacggggaaccctaagggttcccgggttaaggtaacgttaccggtacgtaaccggggtaactaaccggggtttcggtaggttccccgggtaaggtaacccctagttaccggttaccgttttagggtaacccctttacctttaccggttacccccgttaacccccgg

SEQ ID NO: 159196 - DNA, 681 bp, Homo sapiens
  misc_feature: GYAE6OF02IDS5U.22.9.A09.1.454.CMB.1.raw
  modified_base (309)..(309): a, c, t, g, unknown or other
  misc_feature (309)..(309): n is a, c, g, or t
  modified_base (420)..(420): a, c, t, g, unknown or other
  misc_feature (420)..(420): n is a, c, g, or t
  modified_base (614)..(614): a, c, t, g, unknown or other
  misc_feature (614)..(614): n is a, c, g, or t
tcagacatacgcgtcacgaccggtgctcgatttagcgagacgcgcagggggaggaactgctacagttaggacccagagggaaccatggaagccccagctcagcttctcttcctcctgctactctggctccagacgaccaccggagaacggttgtgttgacacagtttccagtcccaccctgtcttttgacctccaggatagccgggccacccgtctctgccgagggacctaagtggacgagttaattgactacttactaggcttcggtaacaacgagtacgcctcggcacggctacccgagcctacctnatgtagtcgatcggtaccttaaccggaaacggcctacgtggccactcccgagccgaggtttccaaggttccgagtggtacgggttacgtggaaagcgtaacctttcgaacnccgttaacacctagaccgaactacgaccgttagacgttacctaggacgttacttcgtatcgtaacgtttattacgttagtacgagtacgtagccgttaacgacggtacgtccgttacgttaccggttccgacggttacggggacctacgttacaggtacgtacgtacgtacggtaacggtacgtaggtacccgngtaccggtactaaccccggtagtttaccgttagttaccctttacgtacccgtttaccgtaacccccg

SEQ ID NO: 159197 - DNA, 842 bp, Homo sapiens
  misc_feature: GYAE6OF02H8H3L.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacactagtttccacgcctaccctgtctttcgtctccgaggagagcggccaccctctcctgcgacggaccaagtgagtagttattagcgtacttactacgccgttacggtaacaacgtagacggtccgtcggaccgacggtcctacccgagggcctccgtcagttacgtagtacgagttcgtaccttaccggaaaaacgggtccccacggttacggacctaacccgttccccgaacgtaccccgtaagggtttaccgacgggtaggtaccggtagggttacgggtaccggtaaggggtaaacggtaaccgttaccctttaacgttaccctaccctttccccgaacctaacttaaccgaaaacccgtacgtttaccccgaacggtaccggtacccgttacggtaaccggtttaacttttacccgtagtttaaccgtttaacgttttaaccgtttaacggttaccgttaaccgtaacggttacccaacgggttaccgttaaacgtaaccgggtccggttacccgttaccgggttaccgtttttaccgggacccgggtaacggggtacccgtaacgggtccggtagggtaacgtacgttaccgacggttaacgtacgttacggtcggtactcggacctaaccgttaccgttccgttacgttaccgtttaccgttaccctcccgtttacccg

SEQ ID NO: 159198 - DNA, 717 bp, Homo sapiens
  misc_feature: GYAE6OF02GNC99.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctccagagaccaccggagaagttgtgttgacacgtagttccgagccaccctgtctttgtcctcgagagagccgggccaccctctctgcgaggaccaatgagagtaattgcgacttacgttacgccgtcggtaacccaacgagacggtcctgggcccaagggccctccccgaggtccctccccgtactagttagtacgtgaagttcgaccgtttaacccggaaaacggggtccctacggtcggaacctcggtccccaaggtacccgtaggttaccgtaggtcgggtacgtcggggttacgggttaggacgggtaaaggcgtaaccgtttcactccttcgacctacggtacaactaccgaccgtagaccgtaccgtacgtaacgactttacgagtacgttaagtttacttactacgtacggtacgtcgaacggtacgtaacgtacggtccggtaccgtccgtttacggttaccggccggttacgggaccacgggtcgtagtacgtactacggacgtaccgaggttcggtacggtctaccggcctaaccggtcgttcgtccggtttaactttcggtaccgtttcccgtacccccg

SEQ ID NO: 159199 - DNA, 897 bp, Homo sapiens
  misc_feature: GYAE6OF02GKO17.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggtagagcgggccaccctctcctgcagggccaatggacgagtattagcgtactacttagcctggtaccaacagagcctgaccaggctcccaggctcctcatgtatgatgcttccgaaaagggtccaacgtggccacgttccccgagtacccgtaacggtttcacggttacgggctaacgggttcggggttacctagggggtaaacgtaacggaacccgttttacccgtaaccgttaccggtttaaccccgaacccgtaaacggttaaccctaaaaccaaaccgggtaccctttaacggaaccggtaacccgtagggtaaccccggtaattttaaccccgttgggtaaccgttaacggtttttaaccgttttaaccggtaaccgtttacccgttaaccgggtaacccgggtaaacgtaccggttttaaaacccgtaaccgggtttaacggggttaaccccccggtttacccgggtttaacccggttttttaacggggtacccccgggtaaaccgggggggggttacccccgttaaaacgggttaccgggttaacggggtacgttaacccggtttacgaaacgggttaacccgggtaaccggtaacgggttacgggtaaccggtaccggttacccggtaacccgtaacggtttacccgttaccggtttacccgttttaccggttacctttacccccggtttaaccccccgg

SEQ ID NO: 159200 - DNA, 877 bp, Homo sapiens
  misc_feature: GYAE6OF02GXLD9.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagacgaccgaccggagaagttgtgttggacactagtttccagcctaccctgtctttgtcctccgaggagacgccgggccaccctcgtcctggcgacgggccaagtcgaagtagttacttacggccgtaaccttacgttacggcccttacgggtaacccaaacgtacggaacgggtcccgttgggaccccgaagggtcccctaccccgtacgggtcccttacccttacgacgttacggttaacttcggtaacgttacccggtacccgttaaaccggaaaaacggggtccctaccggttaccgggacctaccgtacccccgaaggtccccgttaagggttacctaggggttccggtacgtaaggggttccgggtacgtacggggaaacgtacgttaccgttttaccgaaccgttacctaccgaccgtaaacgtacccgaaaccggtaaccgtacccgtaaggtaccgtaccgtaccggtacgtacgtttccgtacgtaacgttacggtttacttacgttacgtacgtacggtaccgtacggtacccgttaacggtacggttaccgggtacccgttaccggttacccggtttacggggacccgggttaccggggtaccgtaacggttaccggtaggaacggttacgtaccggtaacgtacggtaaccgttcggtacggtaccgttaccgaaccgttaccggtaacgttccgttaccgttacgtttaccttaccggtttacccgtaccccg

SEQ ID NO: 159201 - DNA, 521 bp, Homo sapiens
  misc_feature: GYAE6OF02I6RCF.22.9.A09.1.454.CMB.1.raw
  modified_base (350)..(350): a, c, t, g, unknown or other
  misc_feature (350)..(350): n is a, c, g, or t
tcagacatacgcgtcacgaccggtgctcgatttagcgagacgcgcagggggaggaactgctcagttaggacccagagggaaccatggaagcccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctaggtaccaacagagcctggccaggctcccaggctcctcatgtatgatgcttaccaaaagggccactggacatcccagcaggttcagtgcagtggtctggaagngactcactctcacatcaacacgcctagacgcctagacgattctagctagtttactacgtgtcagtcagctacgaagtcgcctccgtactttcggccgtaggggccaagcgtaggagagtcgagacgaacgtgtggctgacacctagtctcgtactacgtactccttacccg

SEQ ID NO: 159202 - DNA, 904 bp, Homo sapiens
  misc_feature: GYAE6OF02FVBHZ.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggcctcccagacgaccaccggagaagttgtgttacgacactagtttcccagcccacccttgttcctttgtcctccgaggagaggccgggcccaccctcctcctgcgacgggaccaaagtgagaacgttaacgttacgcgtaaccgttacgttacgtccgtacggtaaccccaagacggacggccgtacggaccgacggtcccgtaccccgacggtcccgttccctaccgtacggttgtagttacgtacgttcgtacccttaaaccggtaaaccggggaccctaccggtcggacctaccgtaccccgaacggtccgtaacgggttaccgtaggtacggtacggtagggttacgggttacggtaagggaaacgtacgttaaccgtttacctaccttaccgtacccgtaacccgacttaaacccgaaaccgtaaccgtaacccgtaccggtaaccgtacccgtaaccggtacgtaacgtttaccgttaccgttaacgtttaacgtttaaccgttaacgtccgtaaccgttaaccggtaccgtaacccggtaacggttaacccgttacgggttacccggtttaccggtttacccggttaccgttttaccggggaccccggggtaacggggtacccgtaacggttaccggttacgggaacgtaaccgttaccgtaaccgggtacgtaacgggtttcgggtaccgggtccctaaccgggtacctaacccgtacggtttcccgttaacgttttacccgtttacccgttacctttaccccggtacccgg

SEQ ID NO: 159203 - DNA, 644 bp, Homo sapiens
  misc_feature: GYAE6OF02F437W.22.9.A09.1.454.CMB.1.raw
  modified_base (262)..(262): a, c, t, g, unknown or other
  misc_feature (262)..(262): n is a, c, g, or t
  modified_base (288)..(288): a, c, t, g, unknown or other
  misc_feature (288)..(288): n is a, c, g, or t
  modified_base (398)..(398): a, c, t, g, unknown or other
  misc_feature (398)..(398): n is a, c, g, or t
  modified_base (431)..(431): a, c, t, g, unknown or other
  misc_feature (431)..(431): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtggttgacacagtttccagccaccctgtctttgtctccaggagagcgggccaccctctcctgcacgggccaatggagtagtattagcgtactactagcctggtacccccaanagagcctggccagctcccaggcctcnatgtatgatgtcttaccgaaaagggccacgtggcactcccgagcctaaggttcaggtggcgtagtgggtctagggaagacgacttcactctaccaacctactacgaaacncgtacgtaagcgtacccgtagaccgtatttcgngtacgtaggttttaacttacgtagtacgtagaccgtacgtaccgtaacctaacggtaccggtccgttacccgtacgttttaccgggacccggtaacgggggtaccaacgggccttagggataacgttcgacggtaaccggtaacgttaggtccggacgttacggaccgtaaccgtacgttaccttcggttacttctacgttcccgtaaccccg

SEQ ID NO: 159204 - DNA, 713 bp, Homo sapiens
  misc_feature: GYAE6OF02JPNG5.22.9.A09.1.454.CMB.1.raw
  modified_base (678)..(678): a, c, t, g, unknown or other
  misc_feature (678)..(678): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacactagtttccagccaccctgtctttgtctccaggagagcggcccaccctctccgtgcgagggccaagtcgagtagttattagcgtactacttagccttggtaacccaacgaggacggccgtggacccgtaggcctacccgaggccttaccgtctagtcgttactgtacgttcgaccttaccgaaaacgggtccaacgtcggcctacgtcccacgtcccgtaaggttccaggttcggaccgtaggtcgggtacgtagggaacgtacgtaccgtttcaccgttccgtacctaaccctacgtacctaaccgacgtaccgtaggtacctacccgtacggaacgttcgttctaggtacttaagtttactacgtgtacgacgtccgtaacggtccgtaaccgtaaggtccgggtaccctacggttaccgtttccgggaccggtacggggtacccgtaacgttcgttaacgggacgacgtttaccgacggttaacgtacggtcggtacgtcgtacgaccctaaccgtnttccggtacttccgtacgtaccgttcccgtacccg

SEQ ID NO: 159205 - DNA, 756 bp, Homo sapiens
  misc_feature: GYAE6OF02JX7MZ.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagcctacctgtctttgtctccaggagacgcggccaccgtctcctgcgacgggccaatggaacgtagtattacgcgtaacttacttacgaccgtacggtaacccaacgaggacggtcctcggccacggtccctacccgagggtcccttacctacgagtcgtataggctcgtaccgttaaccgaaacggtcctacggcgcctaccgtacccgtagtcccggtaaggttacgaacggtcggtacggtacgggttacgggtaccgtaagggaaacgttaacgtaccttttacaccggttactaacccctaaccgtaacttaacccgaacgtaccggacgtaacgccgtaccgtacgacgttacttccgtattcgttaagttttacgtcgacgttacgacgtacgtacggtaaccgtaacgtaccgtggttaccctacggtttacgttacccgggacggtaccgggtacgtaacggtcgtacggagttaaccacggtacgtaacggttaccggtgggtaaccggtcgtaacccgtaccgtaaccgttcgtttaccgttaccgttaccgtttccgttaacttcccccggttacccg

SEQ ID NO: 159206 - DNA, 981 bp, Homo sapiens
  misc_feature: GYAE6OF02F2KNT.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacactagttccagcccaccctgttctttgtcctccgaggagaggcgggacccaccctctcctgacacgggaccaagtcgaagtagtaattacggaccgtacttactttacgacccttacgggtaacccaaacgtaggacgggtcccgttacgggccccgaaggggtccccttaccccggaacggggtaccttccccgtacctaagttacggtttaacgtaggtaagtttaccggttaccccttaacccggtaaaaaaacgggggtcccccttaaccggtaccgggaccgttaacccgtttacccccggaaaccgtccccggttaaacgggttttaccgtaacggggtttacggggtaccgtaacggggtttacggggggttaccccggtaaaggggggttaaaacgggacccggttttaaccgtttaacccgttaacccggttttaacccgtacccgttaaaaccccgtaacgttaaaccctaaaacccgtaaccgggtaaccccgtttaaacgggtaaccggtacccggttaaacggttaacggtaaccgtttacccgttacgttaccggtttaaagttttaacctttaacctttacggtaccgttaacggtccgtaacggttacccgttaaaccggtaacggttacccgggttaacccgttacccgtttaccggttttacccgggaaccgggttacggggggtacccgaacgttcggtaacggaacgtaccgtacggtaacgacccgtaacgtcgggttacggaccgttacgacccgtcgacgttcgttccgttaccttaccgtcccgtttacccgtacccccg

SEQ ID NO: 159207 - DNA, 819 bp, Homo sapiens
  misc_feature: GYAE6OF02IDSVU.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgcctactctggctcccagagaccaccggagaagttgtgttgacacagtttccagcctaccctgttctttgtctccaggagagcggccaccctctcctgcaggccaatgagagtattagacgtaacttacttacgctaggtaccaacgagacggccgtacggccgacgggcctacccgaggtcctccctacgacttgtacgttcgatcgtaccgtttaaccggaaaacgggtacccaccgtacgggcctaacgtccccgaacggtcccgtaacgggtttacgacggttcggacggtagggttacgggttcgtaagggtaaacggtacgttaccgtttacctaaccgtccttaccgaacccttaactaaccgaaacccgtaacgtaacccgttacggaaccgtcccggttaacgtaaccgttacgtttaccgtcggttaaaccgtttaagttttaaccgttacgtttcggtaaccgtaaccggtaccgtaccgggttaacccgtaaccgggtacgggttaacccggttcccgttacccggttttaaccgggtttccggaacccggggttaccggggtaccgtaacgggttccggtaggacgttaacgtccgaacggtaacgttaaccgggtggtcggtaacggtcctaacccgttacgaccgtttacttccggtttacccttacctttacccgttcccgtaccccg

SEQ ID NO: 159208 - DNA, 897 bp, Homo sapiens
  misc_feature: GYAE6OF02JOIY7.22.9.A09.1.454.CMB.1.raw
  modified_base (307)..(307): a, c, t, g, unknown or other
  misc_feature (307)..(307): n is a, c, g, or t
tcagacatacgcgtcacgaccggtgctcgatttagcgagacgcgcagggggaggaactgctcagttaggacccagagggaaccatggaagccccagctcagcttctcttcctcctgctacttctggctcccagacgaccaccggagaagtttgtgttgacactagtttccagccaccctgttctttagtctccaggagaggcgggccaccctctcctgcacgggccaagtcgagagtattagcgacttacttagcctggtaccaacgagacggcctggccaggcctccgacggctcctctatgtacngatcgtcttaccgaaaacggcctacgtcggactacgtaccctaggtacccgtaaggttccgtaacggttacgggtaccgtaacggggtttacggggttccggttaaagggggtaaaaccggtacggttaaccggttttacccaaccggttttaccaacccgtaaaccctaaccggtttaaacccgaaacccgttaacgggttaaccccgttaagggtaacccggtacccgttaacggtaccgttaacgtttacccggttagttaccgtttaaacgggtttttaactttaaccgtacggtttaaccgacggttacccgtaacggttacccggttaaaccgttaaacgggttccggttaaccccgttttaacccgggttacgtttttacccggggacccggggtaaaccgggggtacccttaaagggttccgggttaacggtaacgggacttaacccgggtagtaaacccggtacgggtttacgggttaccggttaaccggtaccgggttaaccctaacccgggttaccgtttaccggtttaccgtttaaccccggtttaccttacccggtttacccccgtttaacccccgg

SEQ ID NO: 159209 - DNA, 565 bp, Homo sapiens
  misc_feature: GYAE6OF02GF0TB.22.9.A09.1.454.CMB.1.raw
  modified_base (367)..(367): a, c, t, g, unknown or other
  misc_feature (367)..(367): n is a, c, g, or t
tcagacatacgcgtcacgaccggtgctcgatttagcgagacgcgcagggggaggaactgctcagttaggacccagagggaaccatggaagccccagctcagcttctcgttcctcctgctactctggctcccagagaccaccggagaaagttgtgttgacacagtttccagccaccctgtctttgtctccaggagagcgggccacccgtctcctagcagggccaatgagagtattagcgactacttagcctaggtaccaacagaggcctggccaggctccaggcctcctcatgtatgatcgccttaccgaaaacggccacgtggccattcccagtcctaggttcaggtggctaggtcggtcagggaangtacttcacgtcctcgacctactacaacacgtacctagacgtcgtacgacgacttcgtacgtctaagtttactctgtcagcagtcctacgagtcgtccttcgtacgttcggcgtagggcctagcgtggacgagaccgacgacgacgtggacgtcgtacgaccaccgtactcgttgtaccttcaccgttccctaccccg

SEQ ID NO: 159210 - DNA, 749 bp, Homo sapiens
  misc_feature: GYAE6OF02GNVH6.22.9.A09.1.454.CMB.1.raw
  modified_base (143)..(143): a, c, t, g, unknown or other
  misc_feature (143)..(143): n is a, c, g, or t
tcagacatacgcgtcacgaccggtgctcgatttagcgagacgcgcagggggaggaactgctcagttaggacccagaggaaccatggaagccccagctcagcttctcttcctctgctactctggactcccagagaccaccgganaagttgtgttcgacactagttccagcccacctgtcttgactccaggacgagccggaccacccgttcgtccctaggccacgggaccctaagtgaacgtaggtatacggacgtactacgttagcctaggtacccaagcggacgcctcggcctaggccgtacccgaggccttcccgtacatacgtacgtacgtacttacgaccgttaaccgaaaacgggtccctacgtacggacctaaccgttcccggaacgacccggtaaggtttcgaacgggttcggaacgttcgggttacggtcggtacggtaaacggtacgtaccgtttacgaaccgtcccttaacggacctacgtaaccaactacggaccgttacggacgttcgtaacgtacgtacgttacgacgtacgttaacgttacgttacgtacgtacgttacgacgtcgtaaccgtaccgtacgtaccgtaccgtccggtacgtttaccggaccgtacgggaccgtacgttcggaacggacgtactaccggtacgaccggtaacgttcggaccggttactacggtaccgtaccgtaccgttcgttacgttacccttagttaccccgtacccttccccgg

SEQ ID NO: 159211 - DNA, 790 bp, Homo sapiens
  misc_feature: GYAE6OF02HMTGA.22.9.A09.1.454.CMB.1.raw
  modified_base (295)..(295): a, c, t, g, unknown or other
  misc_feature (295)..(295): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcgacgggccaagtgagagttattacgcgactacgttacgccgttggtaccaacgagaggcctggccaggcctcccgaggctccnatgtactggatcgtaccgttaccgaaaagggcccacgttggacctactacccgaaggcccgttaagggtttccaggtcggccgtaggttcgggtaccgtaggggaacgtacggttacctttacgaccttaccgttaccgaacctaacgtaacctaaaccgtaacgaccgttaacgcgtaccgtacgaacgttacgtttcgttcgtacgtttacggtttactttaacgttcgttacgtacgtacgtaaccgtaccgttaaccgtaacggtccggttaacccgttaccgggtttaacccggttttaccgggtaccccgggtaaccgggggtaacccttaacgggtaccggttaacgggaacgtaccgtaaccgtaaccgggtaacggtaaccggtttacgggtacccggtaaccggtaccggtacccgtaaccccgtttacgttacccgttaccggttttaccttaccgtttaccccgttcccggtttaacccccgg

SEQ ID NO: 159212 - DNA, 713 bp, Homo sapiens
  misc_feature: GYAE6OF02FTG07.22.9.A09.1.454.CMB.1.raw
  modified_base (188)..(188): a, c, t, g, unknown or other
  misc_feature (188)..(188): n is a, c, g, or t
  modified_base (205)..(205): a, c, t, g, unknown or other
  misc_feature (205)..(205): n is a, c, g, or t
  modified_base (258)..(258): a, c, t, g, unknown or other
  misc_feature (258)..(258): n is a, c, g, or t
  modified_base (296)..(296): a, c, t, g, unknown or other
  misc_feature (296)..(296): n is a, c, g, or t
  modified_base (326)..(326): a, c, t, g, unknown or other
  misc_feature (326)..(326): n is a, c, g, or t
  modified_base (622)..(622): a, c, t, g, unknown or other
  misc_feature (622)..(622): n is a, c, g, or t
  modified_base (696)..(696): a, c, t, g, unknown or other
  misc_feature (696)..(696): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacactagtttccagccacctgtcttgctcaganagcggccaccctctccngcacgggtcaactggacgtagtattagcgactacttagcctggtaccaagagnggtacctggcctaggcctccgaggcctccgcatgatgntgcttaccgaagggaccacgtggcatcccncgcctaggtctaggtcgcgtacggtggtactgggtaagcggttaacctcaacccttcgtaccaaacctacttaccgaaacgacggtaccttaggaaccggtaccctacggtaaccgtaacgttacgtcggttaaccttagttttaactaaccgttcggtactaacggtactacggtaacccgttaaccgtaaacgggttcccgggttaccccggttacccgggttaaacggttttttcccggggacccgggaccggggggttaaacccaagggtttaacccggaggttaaaaccgngtacccgtagggtaacccgtaacgtcgggttacgaccgttacggactacctaagttccgttaccgtacctttanccctttaaccgtccccg

SEQ ID NO: 159213 - DNA, 760 bp, Homo sapiens
  misc_feature: GYAE6OF02GMDIZ.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagacgaccaccggagaagttgtgttgacacgtatttccagccacctgtcttgtctcaggacgagcggccaccgtctccgtgccgacgggtaccaagtcggaacggtagttagttagcgtaacttacttacgccgttacggtaaccaaacgaggtacggccgtcggacccgtacggaccgtcccgtaacgggccttccccgttacgaaccgttggttatacggtacgttacggtaccgtttaacccgtaaaacgggcccctaaacgttccgggaccttaaccgtccccgtacggtaccgttacgggttctaacggttacggaccggttaaggtcggttaccgtaaggggaaagtaccggtactttacccgtacgttacctaccgtaaccgtaacttaccgaacggttaccaaccgttagaccgttcccaggtaacgtcgtttcctagtacctttacgtttaacttacgtacgttacaacgtacgtacggtaccgttaacgacggtccgtacccgtttacgtacggtttaccgacggtaccggtacctaagccgttggaactcgtaacgtacgacgttacgcggtacgcggtacacgtactacgttctagtccgtctaccgttcccgtaccg

SEQ ID NO: 159214 - DNA, 879 bp, Homo sapiens
  misc_feature: GYAE6OF02IK8NW.22.9.A09.1.454.CMB.1.raw
tcagacatacgcgtcacgaccggtgctcgatttagcgagacgcgcaggggggaggaactgctcagttaggacccagagggaaccatggaagccccagctcagcttctcttcctcctgctactctggctcccagagaccaccggagaagttgtgttgacactagttccagcccaccctgttctttgtcctccgagggagacggccggcctaccccttctccgtagccgaacgggtaccaaagttggaaggtaagttaacgttacgaccgtaacttaacgttaacggcccgttaggtactaccgaaacgaacgaacggtccgtcgggaccgacggccctaccgacggtccctccgtaccagttcgtagtagacgtccgtacccgttaaccgggaaaacggtcccgtaacgtcggtaacctacccgtacccgaacggtacccggttacggttacggtacggggtaccgggtacggttacgggttcggggttacggacgggtaaacgtaccggtttaacccttacccggtaaccttcctaaccccgtaacccggttaaactaacccggtaacgtaccgtaacccggtaacggtaccggttacccggtaacggttaaccggttacgtttaccgggttaacgttaaccggttttaacggtttttaacgttacccggtttaggttacccgtaacggtcgtaaaccggttccggtaaaacggtaccgggttcggtttacccgtttaaccggttaccggttccgggtaccgggtaacgggtaccgtacggtacggtacggtacgtaacgccggtaacggtacgacggtcggttacgcgtaccgtacgtaccgttacttccgttccgttacttcccggtacttccccgg

SEQ ID NO: 159215 - DNA, 710 bp, Homo sapiens
  misc_feature: GYAE6OF02HZZGP.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcggccacccgtctcctgcaggcaatgagagtatagcgatactagcctaggtaccaacgagacggacctggaccgaggctcccgacggccttccctacgtatacgtaagttcgtaactcggtaccgtttaaccgaaaaacgggtcctaacgtcggtaccacgaccccgtacggacccgtacggttaccgaggtcggtaccggtagggttcgggtaggtacgggtaaagggacgtacgtttacctaccgttactaccaacgtacttaccgacacgtacgtacgtacgtccgtacgtacgttacgtctgtaacgttatttacgttaacgtgttacgacgtacgacgtaccgttaaccgagttaccgcgttacccggttaacggtttccggaccggtacgggtaccgtaacgtccgaggtaagtccgtacgtaccggaacgtacggtacggtcggtacgtaccgtacccgtacgaacgttccgttacgttacccgtttactcggtttaccccttacccgg

SEQ ID NO: 159216 - DNA, 797 bp, Homo sapiens
  misc_feature: GYAE6OF02GDRZ7.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccagacgaccaccggagaagttgtgttgacacagtttccagcccacctgtctttgtctaccaggagagcggccaccctctcctcgcgacgggccaagtgagagtattagcgactacttacgtcctacggtaacccaacgagacggccgtcggccgacggcctacccgacggcctcctcatgtatgtatcgtaccttaaccgaaaacgggccctaacgtcggacctaccgtaccccgtacgacccgtacgggttacgtacggtacggacggtacgggttaccggttacgtaacggggaaaggtaaccggtaccgtttaccgtaacccgttacctaaccctaaaccctaacctaaccgaaaaccgtacccgtaaccggtacgtaccgtaccgtaacggtaacttaccgtttcgtacgttaacgtttaaccggtttacttaccgtacgttaccgacggttaccgtaaccgttaccgtaaaccgtacggtcccggtacccgtttaccggtttaaccggttcccggggtaaccggggtacgggtaacccgtaacgtccggtacggtaaacgtacgtaccgtacggtaacccgtacggttacgggtccggtaccgtacgaccctacgttaccgttcgttacccgttacggtaccctacgtttcccccgtaccccg

SEQ ID NO: 159217 - DNA, 608 bp, Homo sapiens
  misc_feature: GYAE6OF02FTZ8Z.22.9.A09.1.454.CMB.1.raw
tcagacatacgcgtcacgaccggtgctcgatttagcgagacgcgcaggggggaggaactgctcagttaggacccagagggaaccatggaagccccagctcagcttctcttcctcctgctactctggctcccagagaccaccggagaagttgtgttgacacagtttccagcccaccctgtctttgtctccaggagagcgggccaccctctcctgcagggccaatgagagtattagcgactacttagcctggtaccaacagaggcctggccaggcctcccaggctccgtcatgtactgatgcttaccaaaaggccactggcactcccagccaggttacaggtgggcaggtcgggtcgtagggaagacgtacttacactctacaaccaatacaacagacctagacgcctagacgacttctagctagtttaattacgtacgtcagcgacgtaccgtaccgtagttccggccttaccgtacgtttacggaccggtagggggaccaacggcgtaggaagacgttacgacggaacgaacgtcggtacggtaccgtacggacctaaccgtacgttccgttacggttaccgttaccgtaccgttacccttaccccgg

SEQ ID NO: 159218 - DNA, 892 bp, Homo sapiens
  misc_feature: GYAE6OF02IDVO9.22.9.A09.1.454.CMB.1.raw
  modified_base (198)..(198): a, c, t, g, unknown or other
  misc_feature (198)..(198): n is a, c, g, or t
  modified_base (218)..(218): a, c, t, g, unknown or other
  misc_feature (218)..(218): n is a, c, g, or t
tcagacatacgcgtcacgaccggtgctcgatttagcgagacgcgcagggggagaactgcgtcagttaggacccagagggaaccatggaagccccagctcagcttctcttcctcctgctactctggctcccagacgaccaccggagtaagttgtgttgacactagtttccagccacccttgttctttgtctccaggagngcgggaccacccttctccgngcgacgggcctaatcgagtagttaattagaccgtacttaacttagccgttcggtaaccaaactaggtacggtcctacggccgacgggtccctacccgagggtccttacccgttacgaacgtttcggttaacgtacggtaacttccggttaacccgttttaaaaccccgggaaaaaaccgggggtccccttaaacgggttccggaccctaaccggttaccccctaaggtccccggtaagggttttaccaacggggttccggtacggtaacgggttcgggttaccgtaagggtaaaccggtacgttaccgtttacgttaccgttaccgtacccaaccttacgaacccgtaaaccgtacgtacccggttaacgaaccggttcccgtaacggtaaccgttacgtttaccgttacgttaccgtaacgttttaacgttacgtttcggtacgttaacggtacgtacggttaaccgtaaccggttaacggtccgttaccggttaccggtttaccggtttaccggaacccgggtacgggttacccgtaacggtccggtaacggtacgtaccgtaacggaacggtaaccggttaaccggttcggttaccgggtaccttaccggaaccctaccgttacgtaccgttaccgtttacccgttaccttacccgttccccgttaacccg

SEQ ID NO: 159219 - DNA, 734 bp, Homo sapiens
  misc_feature: GYAE6OF02JZZ4L.22.9.A09.1.454.CMB.1.raw
  modified_base (275)..(275): a, c, t, g, unknown or other
  misc_feature (275)..(275): n is a, c, g, or t
  modified_base (683)..(683): a, c, t, g, unknown or other
  misc_feature (683)..(683): n is a, c, g, or t
tcagacatacgcgtcacgaccggtgctcgatttagcgagacgcgcagggggaggaactgctcagttaggacccagagggaaccatggaagccccagctcagcttctcttcctcctgctactctcggctcccagacgaccgaccggagtaagtgtgttcgacacgtagttcagccacctgtctttgctcgaggagcgacggccacctctctcgacgacggtacctaagcgagtagtatacgacgaacttactcggtccgttacggtaaccaacggngtaacggtccgtaggcctacggctaccccggacggtcttccctaacgtgtcggttaatcggaactcgggttaccctaaacggtaaaccggctaacgtacgggtacctccttaaccccgtaggaacccgtaggttttcgaacgggtttcggaaccgttagggtccggttaagtacgggaacgtacggtaccttacggacttaaccgtcctactaagtaccgaacgccgaacggtcctagggtacttacggtacgttaacgacgtttacgttaacgttacgttacgtttacgttactcggttaccgagttacgttactagttaacgtaacgtccgtacgttaccgacgttagacccggtagtaacgtaggtactaacggtaacgtaacgtacgtcgacgcgggttaaccncggttaccgaacgtgttaccgaacttcctaacgtacccctcgtacgtaacc

SEQ ID NO: 159220 - DNA, 767 bp, Homo sapiens
  misc_feature: GYAE6OF02HONOI.22.9.A09.1.454.CMB.1.raw
  modified_base (186)..(186): a, c, t, g, unknown or other
  misc_feature (186)..(186): n is a, c, g, or t
tcagacatacgcgtcacgaccggtgctcgatttagcgagacgcgcagggggaggaactgctcagttaggacccagagggaaccatggaagccccagctcagcttctcttcctctgctactctggctcccagagaccaccggagaagttgtgttgacacagttccagccacctgtctttgctcgagngagcggccacccgtctccgtgcgacggccaagtgacgagttatacgcgtaacttacgtacgccgtacggtaaccaacgaggtacgacccgtaggtcccaacggtccgttacccgaacggcccttaccctacgacttacggtaatagtaacgttgaacctttaaccggaaaaacggtccgtaacgttcggtaccaacgttaccccgacggtcccgtaacggtttacgaggtcggtaccggtagggtacggttcgtaacgggaagtacgtaacttaccgtaaccttaccgtacgaaacctaacgttaaccaaccgaacgtcccgtaaaggtacgtacccgtaggaaccgttaacgttacgtacggttaactttaacggttaagtttaccgttagtaaccgtcggtaaccgacgttaaccgtaaaccgtacggtaccggtcccgttaccgttaccgttttaccggaccgggtaccggggacctacggtaacgtaggaacgtagtacgacgtaccgtacggtcggtacgtacgtccgtaacgtacttacgcgtttacggttacctacgttactacccgttacccg

SEQ ID NO: 159221 - DNA, 788 bp, Homo sapiens
  misc_feature: GYAE6OF02I8VWV.22.9.A09.1.454.CMB.1.raw
  modified_base (718)..(718): a, c, t, g, unknown or other
  misc_feature (718)..(718): n is a, c, g, or t
tcagacatacgcgtcacgaccggtgctcgatttagcgagacgcgcagggggaggaactgctcagttaggacccagagggaccatggaagccccagctcagcttctcttcctcctgctactctggcctcccagagaccaccggagaagttgtgttgacacagtttccagccctaccctgttctttgtctcaggtagagccgggtccaccctctccgtcgcgacggaccaatgacgtagtattagacgtacttacgtagtcctacggtaccaacgaggtacgtccgtcggtccgaggccctaccgtaggcctacctacattggtatagtactcgtaaccttaccggaaaaccgggtcctacggtccggacctacggtaccctacggaccgtacggttaccgaggtcggtaccgtagggtaccggttacgtacgggtaacggtaacttaccgtttacgaccgttccttaaccgaccgttaacgtaacccaacgtaccgtaaccgtacggtacccgtacgtaccgacgttaaccgttcttacgtacgtttagtttaactccgttacgtacgtcgtaaccgtacgtaccgttaccgtaaccggtaccgtacccggtttacccgttaggttacccgggtaaccgggtaccgggtaacccgtacgggttaggtaacggtaacgttaccgtacggacggtaaccggtaacgttcggtaaccggttntaacccgggtacctaaccgttacttacgtttaccgttaccctacgtttccccgtaaccgtttaaccccgg

SEQ ID NO: 159222 - DNA, 786 bp, Homo sapiens
  misc_feature: GYAE6OF02J0E5S.22.9.A09.1.454.CMB.1.raw
tcagacatacgcgtcacgaccggtgctcgatttagcgagacgcgcagggggagaacctgctctagttaggacccagagggaaccatggaagccccagctcagcttctcttcctcctgctactcgtggctacccgagacggtacctaccggagaagttgttagttgacacgtagttccagccacctgtacttgctcgaggacgagtcgggccaccgtctcgtagctacggccaagtgacgtagttacttacgcgtacctacgttacgccttacggtaaccaacgaggtacggtccgtcggccgaacggtaccgtccgaacggtccgtacccgttaccgaagttcgtaacgttcgtactacgtaccgttaaccgaaaaaccgggccgtaacgtacggtacctaaccgtacccgacggtaccgtacggttaccgaacggtcggaccggtaggtacggtaccgtaggtaacgtacggtacgttaccaccgttctaccaactactaacgtaacgacgtaccgtaaggtacgtaccgtagtaaaccgtcgtagtacgtacttaacgtttacgttaacgtcgtaccgtagtaccgtaacgtaccgttaacgtacggtaccgttaccgttaccggtttaccggtttaccggtaccgggtaccggggtaacctcgggtaccgtaacggttacgaccgttacggacgtaaccgtacggtccggtacggtccgtaaccgtaccgttaaccgtcgttaaccgtcgttacccgtacgttacccgttccgtaacccccgg

SEQ ID NO: 159223 - DNA, 805 bp, Homo sapiens
  misc_feature: GYAE6OF02FHKOW.22.9.A09.1.454.CMB.1.raw
  modified_base (200)..(200): a, c, t, g, unknown or other
  misc_feature (200)..(200): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagacgaccaccggagaagttgtgttgacacagtctccagcccaccctgtctttgtctccgaggggaaacncgcctaccctctcctgcgagggtccaggtcagtagtcgtttaaactactacttacgccgttaggtaacccaacgaacgtaaccgtggaccaggccttacccgaggtcctcctcacttcttaagtcgattcgactaactccgttaacgacggggtcctacgtcgggactacctccccgagtcccgtaggttaccgtaggtggtacctaggggttcggtaccgttaggggaaccacggttaactttccgtaccgttcacccgtacgtaacttccggacgactaccgaccggttaacgaccgtacccgttaggtaaacgtttacgttttacggtacgtttaacggttttaacttaccgttacggttaccgtaggtactaccggttacggtaacgttcccgtaaaccccgtttcccgtaccgggttaacccggttccgggggaaccggggttaacgggtaaccgtaaggggtacgtaaccggtaataacccgggaaacgttaccggtcgggtaccggttaccggtaccgtaccgtaaccggttacttacccgggttacgttacctttaccgttaccccgttttacccgttaccccttaccgtttaccgg

SEQ ID NO: 159224 - DNA, 663 bp, Homo sapiens
  misc_feature: GYAE6OF02GSZXN.22.9.A09.1.454.CMB.1.raw
  modified_base (339)..(339): a, c, t, g, unknown or other
  misc_feature (339)..(339): n is a, c, g, or t
  modified_base (642)..(642): a, c, t, g, unknown or other
  misc_feature (642)..(642): n is a, c, g, or t
  modified_base (651)..(651): a, c, t, g, unknown or other
  misc_feature (651)..(651): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagcccaccctgtctttgtctccgaggagagcgggaccacccttctccgtgcagggccaagtgagagtatagcgtactacttagccgtaggtaccaacaggacggccgtggacccgaggcctcccgaggtccttcctctatgtatgtatcgacttaccggaaaacggcctacgngctacgtcccacgtaccgaggttcaggtcggacgaggttcgggtacgtagggaaacgacgtacttacgtaccgtactacccgaacctaacgtaaccaaaccgtacgtacccgtaggaccgtcccgtaacggacttacgtttaccgtaggtaccgtttagttttaacttacgttacgtacgtacggaccgtagtacccgtaacgtaacggtcgtcccgtaccgtttcggtttcggaccgggtacgggtccgaagcggtacgaagtctacgaggtaccgagtggacgtcacgcacgtacgtcgtnttacccgtntacctacgtccc

SEQ ID NO: 159225 - DNA, 721 bp, Homo sapiens
  misc_feature: GYAE6OF02G4PW7.22.9.A09.1.454.CMB.1.raw
  modified_base (214)..(214): a, c, t, g, unknown or other
  misc_feature (214)..(214): n is a, c, g, or t
tcagacatacgcgtcacgaccggtgctcgatttagcgagacgcgcagggggaggaactgctcagttaggacccagagggaaccatggaagccccagctcagcttctcttcctcctgctactcgtggcctcccagagaccgaccggagaagttgtgttgacactgtttccagccctaccctggtctttcgtcctccgaggagacggcgggacccnccctctccgtgcgagggcctaatggagtagtattacgacgtaccttactacggccgttacggaacccaagcggacggtcccgttggacccgagcctacccgaggtcctcctacgtagtgtatgacttcgtcccgttaaccgaaaacggccgtacgtcggtcaacgttcccccacggtccgtacggtacctaggtacgggcgtacgggttcggtacggtaggtaacggactcttctaccgtctaccaccgtactaacgactccgacgtgacgtcctacggtatacttcgttacgtacgttacggttttaacgtcgttcgtacgacgtacgaaccggtaccgttaacgtacggtccggtacccgtttccgggttacggtttaccgggacccgggtaacggggacccgtacggccggtaaaggtagcgttacccgtaggaacccgtaggttccggtcggtacgccgtacgtaccgattcggtcgttccttccttacgtcccctaccccgg

SEQ ID NO: 159226 - DNA, 918 bp, Homo sapiens
  misc_feature: GYAE6OF02FSEI2.22.9.A09.1.454.CMB.1.raw
tcagacatacgcgtcacgaccggtgctcgatttagcgagacgcgcaggggaggaactgcgtcagttaggacccagacggaaccatggaagccccagctcagcttctcttccgtccctgctactctcggctcccagagtaccaccggagaacggtttcgtgttcgaacactagtttccgagtcccaccctgttctttgtcctccgaggagagccgggcctacccgtctccgtgccgtacgggcctaaagtggaagtaggtacgttacgcgtaacttacgttagccgttacgggtacccaaacgacggaacggtcccgtaggcccgaacggtacccttaccccggtaacgggtcccttaccccggttacctaagttacggttaacgtacggtaaacgttaccgggtaaccgttttaaaccccggaaaaacggggtcccctaaccggttacggacccgttaaccgttaccccggaaacggttacccccgttaaggtttacccgttaaacggttacggggtaccgttacggggtttaccggggttaccgttaaccggggtaaacgggttaacggttacccgtttaccgttaccgttcccgtaaccgtaaccccgtaacgttacccgaaacggtaccgtaccggttaacggtaaccgtcccggttacgtaccgtacgtttaccgtagtaccgttagtttaccgttacgtcgtacgtacgtaccgaagtaccgttaacgtacggttccgtaaccgttaccgtttaccggttttacggacccggttaacgggtaccgtaaagggtccgtaacggtaacgtacgtaccgtaacggtacggtaacggtcggtaccggtacgtacggtacccgtaccgtacgttaccgttaccggttaccgttacgttacccgttcccgttaaccccg

SEQ ID NO: 159227 - DNA, 585 bp, Homo sapiens
  misc_feature: GYAE6OF02HDOYF.22.9.A09.1.454.CMB.1.raw
  modified_base (360)..(360): a, c, t, g, unknown or other
  misc_feature (360)..(360): n is a, c, g, or t
tcagacatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtcttgtctcaggagagcgggccaccctctccctgcagggcccaatcgagagtattagcgactacttagcctggtaccaacagacggcctggccagggctccccaggcctcctcactctatcggtgcatccgtacgagggccactggtactcccagccaggttccagtggcagtggtctggaacngagttcatctcaccatccagcagtcctgcacgtctgtaatagtttacgcgtagtttattactagttcgacgtcacgtaactataacgtgtaccgtccgttacgtacgtttacggaccgtacggggaccaaggccgtacggtacgtagtacgtaaaccgtaacgtagttcgggacgtttacgacgtaccctacgtccgttacggttaccttccgtacttaccccgg

SEQ ID NO: 159228 - DNA, 836 bp, Homo sapiens
  misc_feature: GYAE6OF02GDCM0.22.9.A09.1.454.CMB.1.raw
tcagacatacgcgtcacgaccggtgctcgatttagcgagacgcgcagggggaggaactgctcagttaggacccagagggaaccatggaagccccagctcagcttctcttcctcctgctactctggctcccaagacgaccgaccggagaagttgtcgttgacactagtttccagcccacctgttctttgtctccgaggacgcggccggccacccgttcgtcctcgacgacgggacctaagtcggagtagttaattacggcctacttaacgttacgaccgttacggaaccaaacgtcggaacggtccgtcgggaccgacgggtccttccccgaacggggtcccttcccgtacgtaagttcggtactacgggtacgttaccggtaccgtttaaacccgggaaaaacgggtccctaaccggtccgggacctaccgtccccgaaggtacccgttaacggttacggtacggtcgggtacgtacggggttagggttacggtagggtaaacgtaaaccggttccgttttacccgaaccgttacctaaccaacgtacgtaccgaaaccggtactaccgtacgtaccgtacctacgggacttcgttaccgacgtttttacaacggtttaaccttagttaccggacttacgggtaaccgtacggtaaccgttaaccgtaccggttaccggtacccgttccggtttaccggttaccgggtacccggggaaccgggtacctaacgggttccgtagggtaacgtacgaccggttaggaacccggtaggttcgggtcgaacgtcgtaccgtacgtcgtaccgttcgttactcgttccgtccccgttaaccg

SEQ ID NO: 159229 - DNA, 875 bp, Homo sapiens
  misc_feature: GYAE6OF02GJQPZ.22.9.A09.1.454.CMB.1.raw
  modified_base (359)..(359): a, c, t, g, unknown or other
  misc_feature (359)..(359): n is a, c, g, or t
tcagacatacgcgtcacgaccggtgctcgatttagcgagacgcgcagggggagaactgctcagttaggacccagagggaaccatggaagccccagctcagcttctcttcctcctgcttactctggctcccaggacgaccaccggagtaagttgtgttgacactgtttccagccctacccgtgttctttgtcctccgaggtagagccggcctacccgtcttcgtacgcgacgggacctaagtggtaagtacgtagttacgaccggtaacttacggttacgacccggttacggaacccgtaagtaacggacggtcccgtacgggacccgtaaggtccctaaccggccgttccttcccgtanagttacggtctacggtacttcgtaccgtttaaacccggaaacggtccgtaaccgtcggtacctaccccggaccgtaacggcccgtttaggtaccggtaggttgaccgggttaaggttccggttaggaacgggtaaacgacggttaacctttcccgaacgtttccggaccgttaacctaccgtacgtaccggtaaccgacctttaacgggaccggttctaacgggttaacgtacccgtttcgtaacgttacgtttacgttttacttaaccctagggtaaccttacgggtaccgtttaaccgggacccgttaacggtttaacccgggtttccggtaccgtttacccggtttacggttaacccgggacccgttaaacgggaccgttaccgggttcgtaaagggtcccggttaacgtaaccgggttacgacggtttaacgtaagggttcctaccggtcgtaaacccgttcgtacgtttacctttcgggttaacccttcgttaaccggttccctaacccgg

SEQ ID NO: 159230 - DNA, 869 bp, Homo sapiens
  misc_feature: GYAE6OF02JH5KA.22.9.A09.1.454.CMB.1.raw
tcagacatacgcgtcacgaccggtgctcgatttagcgagacgcgcagggggaggaactgctcgagttaggacccagagggaaccatggaagccccagctcagcttctcttcctcctgcctactctggctcccagacgacctaccggagaagttggtgttcgactacgtagtttccacgccacccgtgttcctttgtcctccgtaaggacgtacgccgggtcccacccgtccgtccgtgaccgacgggtaccaagtcgacgtagttactacgcgaaccttacgtacgccgtcggtaaccaacgtacggacggtcccgtaggcccgtaacggtccgttacccgaaccgtccgttacccgtcgtacgttacggtacttacggtaacgtccggttaccgttaacccggaaaaacgggtcccgtaccggttaccgggaaccgttaccgtacccccggtaaagggtcccccgttaaggttaacccccggtaaggggttacccgggtaccggttaggttacccggggttaacgtaaaccgggggtaacggttaaaccggttacccgtttaacgtcccgtttaccgttacccgaacctacccgtaaccgtaaaccggtaccgtacccgttaacggtaccggtacccgtaacggtacggttaaccgttccggtacgtaacgttacgtttaactcggttacgtaccgagttaccgacgtaccgtacgtacggtcgttacccgtaggtttaccgttacggtacccgggtaggtaccgagtaccggtaggtaccgaagtccgagtaaccggaggtcgttaacggccgtaacgccgtaacgtcgttaccgttaccggtacctttacgaccgttacctcccgg

SEQ ID NO: 159231 - DNA, 440 bp, Homo sapiens
  misc_feature: GYAE6OF01C13BS.17.37.D04.1.454.CMB.1.raw
  modified_base (435)..(440): a, c, t, g, unknown or other
  misc_feature (435)..(440): n is a, c, g, or t
tcagcgtagactagcacgaccggtgctcgatttagtagcatactgttgggtttgggctcaactctcttgtccaccctggtgtgggtctcacgtattgatactgatggcattaccacatcctacgcggactccgtgcagggccgattcaccatctccagagacaacgccaagaacacgctgtatctgcaaatgaacagtctgagagccgaggacacggctgtgtactactgtgcaagagtttcccccggcagctcgcccggtaacttctggggccagggaacccaggtcaccgtctcctcagcctccaccaagggcccatcggtcttccccctggcaccctcctccaagagcacctctgggggcacagcggccctgggctgcctggtcaaggctacttccctagtctacgctgagcgggctggcaaggcgcatagnnnnnn

SEQ ID NO: 159232 - DNA, 439 bp, Homo sapiens
  misc_feature: GYAE6OF01B9XA2.17.37.D04.1.454.CMB.1.raw
  modified_base (249)..(249): a, c, t, g, unknown or other
  misc_feature (249)..(249): n is a, c, g, or t
  modified_base (435)..(439): a, c, t, g, unknown or other
  misc_feature (435)..(439): n is a, c, g, or t
tcagcgtagactagcacgaccggtgctcgatttagtagcatactgttgggtttgggctcaactctcttgtccaccctggtgtgggtctcacgtattgatactgatggcattaccacatcctacgcggactccgtgcagggccgattcaccatctccagagacaacgccaagaacacgctgtatctgcaaatgaacagtctgagagccgaggacacggctgtgtactactgtgcaagagtttcccccggnagctcgcccggtaacttctggggccaggggacccaggtcaccgtctcctcagcctccaccaaggcccatcggtcttccccctggcaccctcctccaagagcacctctgggggcacagcggccctgggctgcctggtcaaggactacttccctagtctacgctgagcgggctggcaaggcgcatagnnnnn

SEQ ID NO: 159233 - DNA, 443 bp, Homo sapiens
  misc_feature: GYAE6OF01EH1MO.17.37.D04.1.454.CMB.1.raw
  modified_base (436)..(443): a, c, t, g, unknown or other
  misc_feature (436)..(443): n is a, c, g, or t
tcagcgtagactagcacgaccggtgctcgatttagtagcatactgttgggtttgggctcaactctcttgtccaccctggtgtgggtctcacgtattgatactgatggcattaccacatcctacgcggactccgtgcagggccgattcaccatctccagagacaacgccaagaacacgctgtatctgcaaatgaacagtctgagagccgaggacacggctgtgtactactgtgcaagagtttcccccggcagctcgcccggtaacttctggggccagggaacccaggtcaccgtctcctcagcctccaccaagggcccatcggtcttccccctggcaccctcctccaagagcacctctgggggcacagcggccctgggctgcctggtcaaggactacttccctagtctacgctgagcgggctggcaaggcgcatagnnnnnnnn

SEQ ID NO: 159234 - DNA, 449 bp, Homo sapiens
  misc_feature: GYAE6OF01D65KO.17.37.D04.1.454.CMB.1.raw
  modified_base (249)..(249): a, c, t, g, unknown or other
  misc_feature (249)..(249): n is a, c, g, or t
  modified_base (441)..(449): a, c, t, g, unknown or other
  misc_feature (441)..(449): n is a, c, g, or t
tcagcgtagactagcacgaccggtgctcgatttagtagcatactgttgggtttgggctcaactctcttgtccaccctggtgtgggtctcacgtattgatactgatggcattaccacatcctacgcggactccgtgcagggccgattcaccatctccagagacaacgccaagaacacgctgtatctgcaaatgaacagtctgagagccgaggacacggctgtgtactactgtgcaagagtttcccccggnagctcgcccggtaacttctggggccaggggaacccaggtcaccgtctcctcacgcctccaccaaggcccatcggtcttccccctggccaccctcctccaagacgcacctcgtgggggcacacgcggccctgggctgcctggtcaaggactacttccctagtctacgctgagcgggctggcaaggcgcatagnnnnnnnnn

SEQ ID NO: 159235 - DNA, 597 bp, Homo sapiens
  misc_feature: GYAE6OF01DIBL1.17.37.D04.1.454.CMB.1.raw
  modified_base (292)..(292): a, c, t, g, unknown or other
  misc_feature (292)..(292): n is a, c, g, or t
  modified_base (395)..(395): a, c, t, g, unknown or other
  misc_feature (395)..(395): n is a, c, g, or t
  modified_base (420)..(420): a, c, t, g, unknown or other
  misc_feature (420)..(420): n is a, c, g, or t
tcagcgtagactagcacgaccggtgctcgatttagtagcatactgttgggtttgggggccccagccctgggattcccagctgtttctgcttgctgatcaggactgcacacagagaactcaccatggagtttgggctgagctgggttttccttgttgctattttaaaaggtgtccagtgtgcggtgcagctggtggagtccgggggaggtttagttcagcctggggggtccctgagactctcctgtgcggcctctggattcaccttcagtagctactggatgcactgggtccncaagcgtccaggggaaggggctggtatggggtctcgacgtattgatactgatggcattccacatccacgcggactccgtgcgagggccattcacatctccagngaacaacgacaagaacacgctgtanctagacaaatcgaaacagtctggaacgacggaccggaagggtaccgaacgggtcttgtcgttaacctcgtagtgaccgaaacgggtcccggtttccccccgggactaccggcccgttcccggtaccccgggttaacttcccgggttcggggacccgtacggggaaccccgtaacggg

SEQ ID NO: 159236 - DNA, 460 bp, Homo sapiens
  misc_feature: GYAE6OF01EAECV.17.37.D04.1.454.CMB.1.raw
  modified_base (446)..(446): a, c, t, g, unknown or other
  misc_feature (446)..(446): n is a, c, g, or t
  modified_base (452)..(460): a, c, t, g, unknown or other
  misc_feature (452)..(460): n is a, c, g, or t
tcagcgtagactagcacgaccggtgctcgatttagtagcatactgttgggtttgggctcaactctcttgtccaccctggtgtgggtctcacgtattgatactgatggcattaccacatcctacgcggactccgtgcagggccgattcaccatctccagagacaacgccaagaacacgctgtatctgcaaatgaacagtctgagagccgaggacacggctgtgtactactgtgcaagagtttccccggcagctcgcccggtaacttctggggccagggacccaggtcaccgtctcctcagcctccaccaggcccatcggtcttcccctggcaccctcctccaagagcacctcgtggggcacgagccggcccgtggggcctcggccgttcggtcaacgggaccttactttccccgtagtcctacgctaggagcgggtctggcaaggcncatagnnnnnnnnn

SEQ ID NO: 159237 - DNA, 574 bp, Homo sapiens
  misc_feature: GYAE6OF01BMLA7.17.37.D04.1.454.CMB.1.raw
  modified_base (254)..(254): a, c, t, g, unknown or other
  misc_feature (254)..(254): n is a, c, g, or t
  modified_base (301)..(301): a, c, t, g, unknown or other
  misc_feature (301)..(301): n is a, c, g, or t
  modified_base (341)..(341): a, c, t, g, unknown or other
  misc_feature (341)..(341): n is a, c, g, or t
  modified_base (529)..(529): a, c, t, g, unknown or other
  misc_feature (529)..(529): n is a, c, g, or t
  modified_base (539)..(539): a, c, t, g, unknown or other
  misc_feature (539)..(539): n is a, c, g, or t
  modified_base (543)..(543): a, c, t, g, unknown or other
  misc_feature (543)..(543): n is a, c, g, or t
  modified_base (548)..(549): a, c, t, g, unknown or other
  misc_feature (548)..(549): n is a, c, g, or t
  modified_base (553)..(553): a, c, t, g, unknown or other
  misc_feature (553)..(553): n is a, c, g, or t
  modified_base (556)..(569): a, c, t, g, unknown or other
  misc_feature (556)..(569): n is a, c, g, or t
  modified_base (571)..(571): a, c, t, g, unknown or other
  misc_feature (571)..(571): n is a, c, g, or t
  modified_base (573)..(573): a, c, t, g, unknown or other
  misc_feature (573)..(573): n is a, c, g, or t
tcagcgtagactagcacgaccggtgctcgatttagtagcatactgttgggtttgggactcaacctctcttgtccaccctggtgtgggtctcacgtattgatactgatggcattaccacatcctacgcggactccgtgcagggccgattcaccatctccagagacaacgccaaagaacacgctgtatctgacaaatgaacagtctgagagccgaggacacggctgtgtactactgtgacaagtacgttccccggnagctcgaccggtaacttcgtgggcaacggaacccaggtccaccgtcnctcacgcctccgacgaacggccagtccggtccttccccgnggacctccctcctaccgaacgacgccaaccgtcgtacggggacaacgacggccgtacccgtcgggaccttcgccgttacggacctaaacgggtacccttaacccgttcccgtaagttacctaccggtacgtacgggaccggcggggtccgtacggggaacctaacggggcgtacgaacgtagcgacgnacgctagacngagncgacnnctcnacnnnnnnnnnnnnnngngng

SEQ ID NO: 159238 - DNA, 598 bp, Homo sapiens
  misc_feature: GYAE6OF01CB0SY.17.37.D04.1.454.CMB.1.raw
  modified_base (539)..(539): a, c, t, g, unknown or other
  misc_feature (539)..(539): n is a, c, g, or t
tcagcgtagactagcacgaccggtgctcgatttagtagcatactgttgggtttgggggagccccagccctgggattcccagctgtttctgcttgctgatcaggactgcacacagagaactcaccatggagtttgggctgagctgggttttccttgttgctattttaaaaggtgtccagtgtgcggtgcagctggtggagtccggggaggtttagtcagccgtgggggtccctgagactctcctgtgcggcctcgtggattccacctttcagtagctactggatgcacgtgggtccgccaagcctccgaggggaaggggctgggtggtgggtctcgacgttattgatactgatggctattaccacatccacgcggactcgtgcgacgggcctattccacctatcctccgagaacgaaccaaccgaccaaacgaaccacgctagtactcgtagacaaatcgaacagtactgacggacgaccggaagggaccacggtcgtgtacgtactacgtgtacgacgtaacggtacgtttcccccggnaccggtcctacccggtcccggttaacttccgggaccggggcccgtaacgggtaaccccg

SEQ ID NO: 159239 - DNA, 528 bp, Homo sapiens
  misc_feature: GYAE6OF01ALBNP.17.37.D04.1.454.CMB.1.raw
  modified_base (491)..(491): a, c, t, g, unknown or other
  misc_feature (491)..(491): n is a, c, g, or t
  modified_base (496)..(498): a, c, t, g, unknown or other
  misc_feature (496)..(498): n is a, c, g, or t
  modified_base (505)..(521): a, c, t, g, unknown or other
  misc_feature (505)..(521): n is a, c, g, or t
  modified_base (523)..(528): a, c, t, g, unknown or other
  misc_feature (523)..(528): n is a, c, g, or t
tcagcgtagactagcacgaccggtgctcgatttagtagcatactgttgggtttgggctcaactctcttgtccaccctggtgtgggtctcacgtattgatactgatggcattaccacatcctacgcggactccgtgcagggccgattcaccatctccagagacaacgccaagaacacgctgtatctgcaaatgaacagtctgagagccgaggacacggctgtgtactactgtgcaagagtttccccggagctcgccggtacttctgggccaggaacccaggtcaccgtctcctcagcctccaccaagggcccagtccggtcttccccctggccacccctcctccaacgacgccaccctcgtcgggggccacgacggccggcccgtggggcctcggcccttgggtaccaacgggaccttaccttccccttagtccgttaaccgccgtcgaacggccggggaccttgggaccgaaagggccgacgacgttaagncagcnnncgctgcnnnnnnnnnnnnnnnnncnnnnnn

SEQ ID NO: 159240 - DNA, 527 bp, Homo sapiens
  misc_feature: GYAE6OF01EPNUA.17.37.D04.1.454.CMB.1.raw
  modified_base (251)..(251): a, c, t, g, unknown or other
  misc_feature (251)..(251): n is a, c, g, or t
  modified_base (508)..(510): a, c, t, g, unknown or other
  misc_feature (508)..(510): n is a, c, g, or t
  modified_base (512)..(527): a, c, t, g, unknown or other
  misc_feature (512)..(527): n is a, c, g, or t
tcagcgtagactagcacgaccggtgctcgatttagtagcatactgttgggtttgggctcaactctcttgtccaccctggtgtgggtctcacgtattgatactgatggcattaccacatcctacgcggactccgtgcagggccgattcaccatctccagagacaacgccaagaacacgctgtatctgcaaatgaacagtctgagagccgaggacacggctgtgtactactgtgcaagtacgtttcccccggnagctccgcccggtaacttcgtcgggccagggaacccaggtcaccgtctcctcacgccctccaccgacgggcccactccggtcccttcccccgtcggccctacccctccctaccaacgacgccacccgtcggtcgggggccacgacggccggcccgtgggcctcgccgtcggtaccgaacgggtaccttaccgttccccgttacggttcctacgtcgtaggacggccgggcgtcgggacgaacgggccgacgagtagnnngnnnnnnnnnnnnnnnn

SEQ ID NO: 159241 - DNA, 620 bp, Homo sapiens
  misc_feature: GYAE6OF01BHRUA.17.37.D04.1.454.CMB.1.raw
  modified_base (229)..(229): a, c, t, g, unknown or other
  misc_feature (229)..(229): n is a, c, g, or t
  modified_base (232)..(232): a, c, t, g, unknown or other
  misc_feature (232)..(232): n is a, c, g, or t
  modified_base (250)..(250): a, c, t, g, unknown or other
  misc_feature (250)..(250): n is a, c, g, or t
  modified_base (579)..(579): a, c, t, g, unknown or other
  misc_feature (579)..(579): n is a, c, g, or t
  modified_base (591)..(620): a, c, t, g, unknown or other
  misc_feature (591)..(620): n is a, c, g, or t
tcagcgtagactagcacgaccggtgctcgatttagtagcatactgttgggtttggggctcaactcgtcttgtccacccctggtgtgggtctcacgtattgatactgatggcattaccacatcctacgcggactccgtgcagggccgattcaccatctcagagacaacgcaagacacgctgtatctgcaaatgaacagtctgagagcgaggacacggctgtcgtactacngtnacgagtacgttccccggnacgccgtcgtacccggtaacttcgtcggggtacccgaaggaacccgtaggtccaacccgttccgtcccgtcgaacggccccttacccgaacccggaaaccgggtcccctaacggttccggttccccgtttccccccggtcggaccccttacccccttccccgtaaccgaacgaccggtaccctaccgtccggtacgggggtaccaccgtagggccccgtaccggtcgggacccgtgtcccggttaggttaccgaaagtacctttaccgtttccccgtaagtacctcggtactaggtaccgcgggtctacgggacgaacggtcgaacgtntaacggctagcnnnnnnnnnnnnnnnnnnnnnnnnnnnnnn

SEQ ID NO: 159242 - DNA, 662 bp, Homo sapiens
  misc_feature: GYAE6OF01B6R2G.17.37.D04.1.454.CMB.1.raw
  modified_base (265)..(265): a, c, t, g, unknown or other
  misc_feature (265)..(265): n is a, c, g, or t
  modified_base (379)..(379): a, c, t, g, unknown or other
  misc_feature (379)..(379): n is a, c, g, or t
  modified_base (563)..(563): a, c, t, g, unknown or other
  misc_feature (563)..(563): n is a, c, g, or t
  modified_base (604)..(604): a, c, t, g, unknown or other
  misc_feature (604)..(604): n is a, c, g, or t
  modified_base (612)..(612): a, c, t, g, unknown or other
  misc_feature (612)..(612): n is a, c, g, or t
tcagcgtagactagcacgaccggtgctcgatttagtagcatactgttgggtttgggcgtcaactctcttgtccaccctggtgtgggtctcacgtattgatactgaatggcattaccacatcctacgcggactccgtgcgagggccgattcaccatctccagagacaacgccaagaacacgctgtatctgacaaagtgaacagtctggagacgccgaggacacggtctgtacgtactacgtgtcgacgtaaggtacgttccccganacgtcctaccggaccgttaacgttcgtacggggccgaacggaacccaggtcctaccgtcacccgttacgacgtccctccaacgaacggccctaacgttcggtacccttccccgngtacccgaccctaccgtaccaacgtcgaccgtaccgtacgcggggtaccacggtacggcccggtccgtacggctacggacccgttacggtaccgaacgtacccttaccgttacccgtacgttaccgtaacgtcgtacggacggtcgggtacctaggaccgagccgtagaccgtggactggtacncgactagcgagtacgtcgcgtacgactacgtcgtaacgttntaaccgtntacgttcgacgtacgtacgacgtagtaccggataccgtacgtgccgtacg

SEQ ID NO: 159243 - DNA, 788 bp, Homo sapiens
  misc_feature: GYAE6OF01DKPEG.17.37.D04.1.454.CMB.1.raw
  modified_base (710)..(710): a, c, t, g, unknown or other
  misc_feature (710)..(710): n is a, c, g, or t
tcagcgtagactagcacgaccggtgctcgatttagtagcatactgttgggtttgggggccccagccctgggattcccagctgtttctgcttgctgatcaggactgcacacagagaactcaccatggagtttggctgagcttgggttttccttgttgcttaattttaaaaggtgtcagtgtgcggtgcagcgtggtggaggtccggggtagtttagttcagccggtgggggtccctgacgaccttcgtccgtgtcggccggtcctcgttggtactttcctaccgttacgaagtacgtacgtacgtggtaatcggacctaccgttcgggtccccaccgaacgccgtaccgggagggggaacgggtcgttagggtacgttcggtccttaccgtaggttagttagtaacttacgtgtacgttacggacttaacttacccaacgtaccgttacccgtaaccggccggtaaccgtccggtacgaccggtacgggtacccgttaacttaccaaccctacgtaccgtaccgaaacgaaccgaaaccgaaacccgaaccgaaaccgaaaccgtaccgtagttaccgttaactacgtaacgaacctaaagttacgaacgttacggttacgaggaacggaccggtacccggaggtaccgacggtacgttgttaccgtaacgttcgtcgacgtaaccgtaccggttccccggttaccccggngtaacccggtcccggtaacccggttacccggttaccgttaccgggtacggggaacccgtacgggaaccccgtaaccgg

SEQ ID NO: 159244 - DNA, 784 bp, Homo sapiens
  misc_feature: GYAE6OF01E2ZIB.17.37.D04.1.454.CMB.1.raw
  modified_base (198)..(198): a, c, t, g, unknown or other
  misc_feature (198)..(198): n is a, c, g, or t
tcagcgtagactagcacgaccggtgctcgatttagtagcatactgttgggtttggggccccagccctgggattcccagctgtttctgcttgctgatcaggactgcacacagagaactcaccatggtagtttgggctgagtcgttgggttttccttgttgtacttaagttttaaaaggtgtccgagtgtgcggtgcagngtgggtggacgggtccgggggtagtttagttcgacggccggttcgggggtccctggacgtaccttctccgtggtcgccggtcctcgtcggtacttccacgttcagttacgacttacgtggatcgcgtacgtcgggtcccgaccaacgtccgtaccggagggggtaacggggtcgttggggtcggttcgggtccgttaccgtacggttagttagtaacgttaccgtaggtacgtacggtacctaaccttaacccacgtacgtacccgtacggcccggtaacgtccggtcgacggtaccgggtacccgtacttacccaccgtatcccgtaccgaacggaacgaaaccgaaccgaccgtaaaacgaaccgtacgtacgttacgtacgtaccgtaagaacttaaacgagtaaaccgtgttacggtaacgaacggtaaccgacggtacggtaaccggtacggtcgttacgttacggttaaccacggtttacgacgtaacgtaccgggttaccccgtttcccgaaccggtccgtaccgtacccggttaccccgttaggttcccggacggacccgtaacggacccgttaccgg

SEQ ID NO: 159245 - DNA, 871 bp, Homo sapiens
  misc_feature: GYAE6OF01CCLJK.17.37.D04.1.454.CMB.1.raw
tcagcgtagactagcacgaccggtgctcgatttagtagcatactgttgggtttgggggccccagccctgggattcccagctgtttctgcttgctgatcaggactgcacacagagaactcaccatggagtttgggctgagtcttgggttttccttgttgcttaattttaaaaggtgtccagtgtgcggtgcagcgtgggtggaggtccgggggtaggtttagttcgaggccggtcgggggtccctggacgtacttccgttccgttggtcggccggtccgtcgttaggtacttccgtaccgtttcgaagttacgccttaacgtggtacgttcgccgtaccggttcgggtaccccgaccgtaacggtccgtaccggaaggggggtacgggtcgttgggtcggtcgggttcctacgtacggttagttggtaacgttacgtaggtacgttacggtacctaacctttaacccaacgtaaccgtttaccccggttaacccgggtaccgggttaccccgttcccgggtacggtacccggtaccgggggtaccctaacgtttaccccaaaccgtcgttaccctaccgaacgggtaaacaaaccccgaacgaacccctaaaaggaccgtaaccgtcgttatacgttacaggtaactaaagtcgaacgtacgttacgacggaaggaccgaccggacgggaacccgtcggtacttaggttaccgttaacgttacggttcgtaccggtaaccgttaaccgggttttacccccggttccccggaacgtcccggttaccccggttaccccggttaaaccccgggtttacggtttcccccggggaacgggtaacccgggtaaccccggggtacccgttaaccccggg

SEQ ID NO: 159246 - DNA, 788 bp, Homo sapiens
  misc_feature: GYAE6OF01C4Z0N.17.37.D04.1.454.CMB.1.raw
  modified_base (613)..(613): a, c, t, g, unknown or other
  misc_feature (613)..(613): n is a, c, g, or t
tcagcgtagactagcacgaccggtgctcgatttagtagcatactgttgggtttgggggccccagccctgggattcccagctgtttctgcttgctgatcaggactgcacacagagaactcaccatggagtttggctgagtcgtggtttcttgtagctatttaaaggtgtcagtgtgcggtgcagcgtgggtcggacggttccggggtaggtttacgtcgacgggtcccggtcggggggtccctaggacgtaccgttccgttcccgtcggtacggcccggtccttcgtaggtaactttccgaccgttagacggttacgccttacggtcggtatccgtcgtaccggtcggtccgaccctaagccgttacgggaaggggacgggtcgttagggtcggtcgggtacctacgacggtttattaggacttacgtagtagtccggattaacgtacctacgtcgttacccgtacgggccgtaacggtcccgtacggaccggtaccgggaccttaactttcgaccttcgtaccttacgaccgaaacggacgaaaccctacggaacccgaaaacggtccgacgttccgttagtacgttcaaccggaaataaccggtgtaacccnggttacggacggaacggacgttccggggaacgttacccgcgggttactttacgacggttacctagggtaccgtagaaacccggttccgtttaccccggacccgacggtaccgtacccccggttcccgggaaaccccgtttacggaccgggtaaccgggcgtacccgtaaaccggg

SEQ ID NO: 159247 - DNA, 565 bp, Homo sapiens
  misc_feature: GYAE6OF01BI5K1.17.37.D04.1.454.CMB.1.raw
  modified_base (200)..(200): a, c, t, g, unknown or other
  misc_feature (200)..(200): n is a, c, g, or t
  modified_base (256)..(256): a, c, t, g, unknown or other
  misc_feature (256)..(256): n is a, c, g, or t
  modified_base (538)..(565): a, c, t, g, unknown or other
  misc_feature (538)..(565): n is a, c, g, or t
tcagcgtagactagcacgaccggtgctcgatttagtagcatactgttgggtttgggctcaactctcttgtccaccctggtgtgggtctcacgtattgatactgatggcattaccacatcctacgcggactccgtgcagggccattcaccatctccagagacaacgccaagaacacgctgtatctgacaaatgaacagtcngagacgccgaggacacggctgtagtactactgtcgacgaaggtccggttccccggnacgccgtccggtacccggttaacttcggtcggggaccgaacggggaacccacggtccgtaccgtcctcctccgacgccctaccgaccgaacggccctacgtccgtccctccccgcgcctacccctcaccaagccgacctaccgtcggtacggggccacgacggccggccgtcggtctcgtaccgtcggtacgaacggtaccttacccgttacctacggtaccgtcgtaccggtcggaccggcggggtacgtcgggtaaccacgggtaccgcgtaaagtcgannnnnnnnnnnnnnnnnnnnnnnnnnnn

SEQ ID NO: 159248 - DNA, 548 bp, Homo sapiens
  misc_feature: GYAE6OF01DL2Q4.17.37.D04.1.454.CMB.1.raw
  modified_base (250)..(250): a, c, t, g, unknown or other
  misc_feature (250)..(250): n is a, c, g, or t
  modified_base (518)..(518): a, c, t, g, unknown or other
  misc_feature (518)..(518): n is a, c, g, or t
  modified_base (520)..(548): a, c, t, g, unknown or other
  misc_feature (520)..(548): n is a, c, g, or t
tcagcgtagactagcacgaccggtgctcgatttagtagcatactgttgggtttgggctcaactctcttgtccaccctggtgtgggtctcacgtattgatactgatggcattaccacatcctacgcggactccgtgcagggccgattcaccatctccagagacaacgccaagaacacgctgtatctgcaaatgaacagtctgagagccgaggacacggctgtgtactactgtgcaagacgtttcccccggnagctcgcccggtaacttcgtgggccagggaacccaggtcaccgtcctcctcacgcctccaccaacgggcccactccggtccttccccctcggcccacccctcctccaacgacgccaccgtcgtcgggggccacgacgcccgggcccgtcggggccgtcgcccgtgggtacctaagggtaccttaccgtttcccctagttccgtaaccgccgttcggaacggccggggtccgtacggggacctaaacggggccgtacgaacgttacggncnnnnnnnnnnnnnnnnnnnnnnnnnnnnn

SEQ ID NO: 159249 - DNA, 676 bp, Homo sapiens
  misc_feature: GYAE6OF02JFWFB.17.37.D04.1.454.CMB.1.raw
  modified_base (282)..(282): a, c, t, g, unknown or other
  misc_feature (282)..(282): n is a, c, g, or t
  modified_base (482)..(482): a, c, t, g, unknown or other
  misc_feature (482)..(482): n is a, c, g, or t
  modified_base (497)..(497): a, c, t, g, unknown or other
  misc_feature (497)..(497): n is a, c, g, or t
  modified_base (505)..(505): a, c, t, g, unknown or other
  misc_feature (505)..(505): n is a, c, g, or t
tcagcgtagactagcacgaccggtgctcgatttagtagcatactgttgggtttgggggagcccagccctgggattcccagctgtttctgcttgctgatcaggactgcacacagagaactcaccatggagtttgggctgagcgttgggttttccttgttgcttaattttaaaaggtgtccagtgtgcggtgcagctgggtggaggtccgggggtaggtttagtcaggccgtgggggtccctgagtactctccgtgtcgcggcctcgtggtacttccacctttnagtacgcttacgttggatgcctacggtcgggtcccaccgaagcccgtccggaaagggggaggggtcgtgggtggttgggtctacgtaacgttagttagaattacgtgtagtggactacttaccactactccgtacgcgtactccggtacgacgacggcctactcactactctacgagacgaaccaaccgacgaacgaacncgctcgtaatcgtanactaaagngaacctgtacgagtacggacgaccgaaggaaccgtacgtacgtgttaaccgtacgttagtcgtaacggtaccgtaaaccggttaccccggtttcccggactaccggtacccgttacggtaccccggttaaccggttccgggaacggggtacccggaacccgggttaacccg

SEQ ID NO: 159250 - DNA, 754 bp, Homo sapiens
  misc_feature: GYAE6OF02GVGAF.17.37.D04.1.454.CMB.1.raw
  modified_base (297)..(297): a, c, t, g, unknown or other
  misc_feature (297)..(297): n is a, c, g, or t
tcagcgtagactagcacgaccggtgctcgatttagtagcatactgttgggtttgggggcccccagccctgggattcccagctgtttctgcttgctgatcaggactgcacacagagaactcaccatggagtttgggctgagctgggttttccttgttgctattttaaaaggtgtccagtgtgcggtgcagctggtggaggtccgggggaggtttagttcagccgtggggggtccctgagactctctgtgcgcctcgtggattcaccttcagtagctacgtggatgcacgtcgggtccnccaagcctccgagggggaacgggcgtggtacgtgggtctccgtacgtattgaatactgatcggactacttaaccactactaccgtaccgtacggtacctccggtcgccggaacggggaccctactttacccgaaccctacgtacctacccaacggaacggaaaccaaaccggacccaaaaggaaccaacggtcgttacggtactaccgtacgaacctaaagtcgaaactaggttccgtaggaacggaaccgggaccggtaacggggaaccgtccgggttcgttacgggtaccgtttaaccgttaacgttgggtaccgtaacggtaaccgggttaacccggttttaccccccgggagtacccgggttacccgttacccggggttacccccgggtttaaccgtttccgggggtacccggggggtacccgtaaacccgggggtaaccccgttaaccgggg

SEQ ID NO: 159251 - DNA, 571 bp, Homo sapiens
  misc_feature: GYAE6OF02INMIQ.17.37.D04.1.454.CMB.1.raw
  modified_base (250)..(250): a, c, t, g, unknown or other
  misc_feature (250)..(250): n is a, c, g, or t
  modified_base (542)..(543): a, c, t, g, unknown or other
  misc_feature (542)..(543): n is a, c, g, or t
  modified_base (545)..(571): a, c, t, g, unknown or other
  misc_feature (545)..(571): n is a, c, g, or t
tcagcgtagactagcacgaccggtgctcgatttagtagcatactgttgggtttgggctcaactctcttgtccaccctggtgtgggtctcacgtattgatactgatggcattaccacatcctacgcggactccgtgcagggccgattcaccatctccagagacaacgccaagaacacgctgtatctgcaaatgaacagtctgagagccgaggacacggctgtgtactactgtgcaagacgtttcccccggnagcgtcgcccggtaacttcgtgggccacgggaccaggtcaccgtctcctcacgccctccaccgaacgggccccacgtccggttcccttcccccgtcggccctacccccttccctacccgaaacgaccggacctaccccgtcggtcggggggacccaaccggacggcccgggtcccgtggggcctcggtcccgttaggtaccgaacggtacctttacccgtttacccgttaacgttccgtaaccgtccgtcggacgggccgggtcgtacgggacgaacgggcgacgagtagcnncnnnnnnnnnnnnnnnnnnnnnnnnnnn

SEQ ID NO: 159252 - DNA, 585 bp, Homo sapiens
  misc_feature: GYAE6OF02F119U.17.37.D04.1.454.CMB.1.raw
  modified_base (254)..(254): a, c, t, g, unknown or other
  misc_feature (254)..(254): n is a, c, g, or t
  modified_base (551)..(552): a, c, t, g, unknown or other
  misc_feature (551)..(552): n is a, c, g, or t
  modified_base (555)..(555): a, c, t, g, unknown or other
  misc_feature (555)..(555): n is a, c, g, or t
  modified_base (557)..(557): a, c, t, g, unknown or other
  misc_feature (557)..(557): n is a, c, g, or t
  modified_base (559)..(564): a, c, t, g, unknown or other
  misc_feature (559)..(564): n is a, c, g, or t
  modified_base (566)..(585): a, c, t, g, unknown or other
  misc_feature (566)..(585): n is a, c, g, or t
tcagcgtagactagcacgaccggtgctcgatttagtagcatactgttgggtttgggctcaactctcttgtccaccctggtgtgggtctcacgtattgatactgatggcattaccacatcctacgcggactccgtgcagggccgattcaccatctccagagacaacgccaagaacacgctgtatctgcaaatgaacagtctgagagccgaggacacggctgtgtactactgtgacaacggtacgtttcccccggnacgtcgtccggccccggttaacgttccggtcgggggacccgaacggggaaccccgacggtccgacccgtctccctacgacgtccctaccgaacccgaacgggcccctacgttccggtcccttcccccgtcggccctaccccctcctaccgaacgacgaccctaccgtcggcggggccacgtacggccggtcccgtgggcctcggcccgtcggtaccgaacggtaccttacccgttcccgtacgtcctaccggtcgtacggacggtccgggcgtacggacgacgggccgtacagtagnncgncncnnnnnnannnnnnnnnnnnnnnnnnnn

SEQ ID NO: 159253 - DNA, 228 bp, Homo sapiens
  misc_feature: GYAE6OF01BLRSH.48.14.B03.1.454.CMB.1.raw
tcagagtatacatacacgaccggtgctcgattagtgtgagtagttccgcggaccggccgtcttcgggccgaggacactggttatcgtctcttcagcctccaccaaggccactcggtcttccctcggcgccctgctccaggagcacctccgagagcacagcggccctgggctgcctggtcaaaggactacttcctctctcgactctgagcgggctggcaaggcgcatag

SEQ ID NO: 159254 - DNA, 253 bp, Homo sapiens
  misc_feature: GYAE6OF01AFI8H.48.14.B03.1.454.CMB.1.raw
  modified_base (234)..(253): a, c, t, g, unknown or other
  misc_feature (234)..(253): n is a, c, g, or t
tcagagtatacatacacgaccggtgctcgatttagtgtgagtagttccggcgggaccggccgtcttcggggccagggaacactggttatcgtctcttcagcctccaccaaggcccatcggtcttcccctggcgccctgctccaggagcacctccgagagcacagcggccctgggctgcctggtcaaggactacttcctatgtatactctgagcgggctggcgaaggcgcatagnnnnnnnnnnnnnnnnnnnn

SEQ ID NO: 159255 - DNA, 237 bp, Homo sapiens
  misc_feature: GYAE6OF01EVKRJ.48.14.B03.1.454.CMB.1.raw
  modified_base (233)..(237): a, c, t, g, unknown or other
  misc_feature (233)..(237): n is a, c, g, or t
tcagagtatacatacacgaccggtgctcgatttagtgtgagtagttccgcgggaccggccgtcttcggggccagggaacactggttatcgtctcttcagcctccaccaagggcccatcggtcttcccctggcgccctgctccaggagcacctccgagagcacagcggccctgggctgcctggtcaaggactacttcctctctcgactctgagcgggctggcaaggcgcatagnnnnn

SEQ ID NO: 159256 - DNA, 235 bp, Homo sapiens
  misc_feature: GYAE6OF01EPAKH.48.14.B03.1.454.CMB.1.raw
  modified_base (234)..(235): a, c, t, g, unknown or other
  misc_feature (234)..(235): n is a, c, g, or t
tcagagtatacatacacgaccggtgctcgatttagtgtgagtagttccgcggggaccggccgtcttcggggccagggaacactggttatcgtctcttcagcctccaccaagggcccatcggtcttcccctggcgccctgctccaggagcacctccgagagcacagcggccctgggctgcctggtcaaggactacttcctctctcgactctgagcgggctggcaaggcgcatagnn

SEQ ID NO: 159257 - DNA, 236 bp, Homo sapiens
  misc_feature: GYAE6OF01CKGSL.48.14.B03.1.454.CMB.1.raw
  modified_base (233)..(236): a, c, t, g, unknown or other
  misc_feature (233)..(236): n is a, c, g, or t
tcagagtatacatacacgaccggtgctcgatttagtgtgagtagttccgcgggaccggccgtcttcggggccagggaacactggttatcgtctcttcagcctccaccaagggcccatcggtcttcccctggcgccctgctccaggagcacctccgagagcacagcggccctgggctgcctggtcaaggactacttcctatgtatactctgagcgggctggcaaggcgcatagnnnn

SEQ ID NO: 159258 - DNA, 276 bp, Homo sapiens
  misc_feature: GYAE6OF01AN63K.48.14.B03.1.454.CMB.1.raw
  modified_base (247)..(276): a, c, t, g, unknown or other
  misc_feature (247)..(276): n is a, c, g, or t
tcagagtatacatacacgaccggtgctcgatttagtgtgagtagttccgcggggaccggccgtcttcggggccagggaacactggttatcgtctcttcagcctccaccaagggcccatcggtcttcccctggcgccctgctccaggagcacctccgagagcacgagcggccctggggcctggccctggtccaaaggcctacgttcctcgtctcgactcgtggaggcgggctggacaagggcgcatgnnnnnnnnnnnnnnnnnnnnnnnnnnnnnn

SEQ ID NO: 159259 - DNA, 133 bp, Homo sapiens
  misc_feature: GYAE6OF01A89D0.48.14.B03.1.454.CMB.1.raw
tcagagtatacatacacgaccggtgctcgatttagtgtgagtagttccgcgggcacgaccggtgctcgatttagagctcacgtattgggtttgggggtttttaggtatctgagcgggctggcaaggcgcatag

SEQ ID NO: 159260 - DNA, 239 bp, Homo sapiens
  misc_feature: GYAE6OF01DMEBC.48.14.B03.1.454.CMB.1.raw
  modified_base (235)..(239): a, c, t, g, unknown or other
  misc_feature (235)..(239): n is a, c, g, or t
tcagagtatacatacacgaccggtgctcgatttagtgtgagtagttccgcggggaccggccgtcttcgggggccagggaacactggttatcgtctcttcagcctccaccaagggcccatcggtcttcccctggcgccctgctccaggagcacctccgagagcacagcggccctgggctgcctggtcaaggactacttcctatgtatactctgagcgggctggcaaggcgcatagnnnnn

SEQ ID NO: 159261 - DNA, 235 bp, Homo sapiens
  misc_feature: GYAE6OF01EOM1Z.48.14.B03.1.454.CMB.1.raw
  modified_base (234)..(235): a, c, t, g, unknown or other
  misc_feature (234)..(235): n is a, c, g, or t
tcagagtatacatacacgaccggtgctcgatttagtgtgagtagttccgcgggaccggccgtcttcgggggccagggaacactggttatcgtctcttcagcctccaccaagggcccatcggtcttcccctggcgccctgctccaggagcacctccgagagcacagcggccctgggctgcctggtcaaggactacttcctatgtatactctgagcgggctggcaaggcgcatagnn

SEQ ID NO: 159262 - DNA, 237 bp, Homo sapiens
  misc_feature: GYAE6OF01C7XPP.48.14.B03.1.454.CMB.1.raw
  modified_base (235)..(237): a, c, t, g, unknown or other
  misc_feature (235)..(237): n is a, c, g, or t
tcagagtatacatacacgaccggtgctcgatttagtgtgagtagttccgcggggaccggccgtcttcgggggccagggaacactggttatcgtctcttcagcctccaccaagggcccatcggtcttcccctggcgccctgctccaggagcacctccgagagcacagcggccctgggctgcctggtcaaggactacttcctatgtatactctgagcgggctggcaaggcgcatagnnn

SEQ ID NO: 159263 - DNA, 242 bp, Homo sapiens
  misc_feature: GYAE6OF01ELZ8G.48.14.B03.1.454.CMB.1.raw
  modified_base (236)..(242): a, c, t, g, unknown or other
  misc_feature (236)..(242): n is a, c, g, or t
tcagagtatacatacacgaccggtgctcgatttagtgtgagtagttccgcggggaccggccgtcttcgggggccagggaacactggttatcgtctcttcagcctccaccaagggcccatcggtcttcccctggcgcccctgctccaggagcacctccgagagcacagcggccctgggctgcctggtcaaggactacttcctctctcgactctgagcgggctggcaaggcgcatagnnnnnnn

SEQ ID NO: 159264 - DNA, 157 bp, Homo sapiens
  misc_feature: GYAE6OF01A8UD2.48.14.B03.1.454.CMB.1.raw
  modified_base (155)..(157): a, c, t, g, unknown or other
  misc_feature (155)..(157): n is a, c, g, or t
tcagagtatacatacacgaccggtgctcgatttagtgtgagtagttccgcgggcacgaccggtgctcgatttagtgtgagtagttccgcgggcacgaccggtgctcgatttagtcacgcgagaaagggagaggcgggctggacaaggcgcatagnnn

SEQ ID NO: 159265 - DNA, 241 bp, Homo sapiens
  misc_feature: GYAE6OF01AM59C.48.14.B03.1.454.CMB.1.raw
  modified_base (236)..(241): a, c, t, g, unknown or other
  misc_feature (236)..(241): n is a, c, g, or t
tcagagtatacatacacgaccggtgctcgatttagtgtgagtagttccgcggggaccggccgtcttcgggggccagggaacactggttatcgtctcttcagcctccaccaagggcccatcggtcttccccctggcgccctgctccaggagcacctccgagagcacagcggccctgggctgcctggtcaaggactacttcctatgtatactctgagcgggctggcaaggcgcatagnnnnnn

SEQ ID NO: 159266 - DNA, 145 bp, Homo sapiens
  misc_feature: GYAE6OF01A88PT.48.14.B03.1.454.CMB.1.raw
  modified_base (145)..(145): a, c, t, g, unknown or other
  misc_feature (145)..(145): n is a, c, g, or t
tcagagtatacatacacgaccggtgctcgatttagtgtgagtagttccgcgggtagttccgcgggcacgaccggtgctcgatttagagctcacgtattgggtttggggtttttaggtatctgagcgggctggcaaggcgcatagn

SEQ ID NO: 159267 - DNA, 110 bp, Homo sapiens
  misc_feature: GYAE6OF01DNUHH.48.14.B03.1.454.CMB.1.raw
  modified_base (109)..(110): a, c, t, g, unknown or other
  misc_feature (109)..(110): n is a, c, g, or t
tcagagtatacatacacgaccggtgctcgatttagtgtgagtagttccgcgggcacgaccggtgctcgatttagtgtgagtagctgagcgggctggcaaggcgcatagnn

SEQ ID NO: 159268 - DNA, 149 bp, Homo sapiens
  misc_feature: GYAE6OF01CB3FK.48.14.B03.1.454.CMB.1.raw
  modified_base (131)..(149): a, c, t, g, unknown or other
  misc_feature (131)..(149): n is a, c, g, or t
tcagagtatacatacacgaccggtgctcgatttagtgtgagtagttccgcgggcacgaccggtgctcgatttagtgtgagtagttcccgcgtagacggccggtcgtcggaacgaacggccgactaagtagnnnnnnnnnnnnnnnnnnn

SEQ ID NO: 159269 - DNA, 237 bp, Homo sapiens
  misc_feature: GYAE6OF01AHPRF.48.14.B03.1.454.CMB.1.raw
  modified_base (227)..(227): a, c, t, g, unknown or other
  misc_feature (227)..(227): n is a, c, g, or t
  modified_base (233)..(237): a, c, t, g, unknown or other
  misc_feature (233)..(237): n is a, c, g, or t
tcagagtatacatacacgaccggtgctcgatttagtgtgagtagttccgcggggaccggccgtcttcgggggccagggaacactggttatcgtctcttcagcctccaccaagggcccatcggtcttcccctggcgccctgctccaggagcacctccgagagcacagcggccctgggctgcctggtcaagtctacttccatgtatactctgagcgggctggcaaggcncatagnnnnn

SEQ ID NO: 159270 - DNA, 296 bp, Homo sapiens
  misc_feature: GYAE6OF01EWC29.48.14.B03.1.454.CMB.1.raw
  modified_base (235)..(235): a, c, t, g, unknown or other
  misc_feature (235)..(235): n is a, c, g, or t
  modified_base (246)..(296): a, c, t, g, unknown or other
  misc_feature (246)..(296): n is a, c, g, or t
tcagagtatacatacacgaccggtgctcgattttagtgtgagtagttccgcggggaccggccgtcttcgggggccagggaacactggttatcgtctcttcagcctccaccaaggcccatcggtcttccccctggcgccctgctccaggagcacctccgagagcacagcggccctggggctgcctggtcaggctacttcctaattatacgtctggacgcggggctggcaaacgggngtccaataggnnnnnnnnnnnnnnnnnnnnnnnnnnnnnnnnnnnnnnnnnnnnnnnnnnn

SEQ ID NO: 159271 - DNA, 242 bp, Homo sapiens
  misc_feature: GYAE6OF01EIP7X.48.14.B03.1.454.CMB.1.raw
  modified_base (235)..(242): a, c, t, g, unknown or other
  misc_feature (235)..(242): n is a, c, g, or t
tcagagtatacatacacgaccggtgctcgatttagtgtgagtagttccgcgggaccggccgtcttcgggggccagggaacactggttatcgtctcttcagcctccaccaagggcccatcggtcttccccctggcgccctgctccaggagcacctccgagagcacagcggccctgggctgcctggtcaaggactacttcctatgtatactctgagcgggctggcaaggcgcatagnnnnnnnn

SEQ ID NO: 159272 - DNA, 277 bp, Homo sapiens
  misc_feature: GYAE6OF01C56Z6.48.14.B03.1.454.CMB.1.raw
  modified_base (254)..(277): a, c, t, g, unknown or other
  misc_feature (254)..(277): n is a, c, g, or t
tcagagtatacatacacgaccggtgctcgatttagtgtgagtagttccgcggggaccggccgtcgttcgggggccagggaacactggttatcgtctcttcagcctccaccgaagggcccatccggtccttccccctggccgcccctgctccaggagcacctccgagacgcacaggccggccctgggctgcctggtcaaggacttacttcctctctcgactcgtggaggcgggctagggacaaggcgacaagtgnnnnnnnnnnnnnnnnnnnnnnnn

SEQ ID NO: 159273 - DNA, 237 bp, Homo sapiens
  misc_feature: GYAE6OF02H3WD9.48.14.B03.1.454.CMB.1.raw
  modified_base (236)..(237): a, c, t, g, unknown or other
  misc_feature (236)..(237): n is a, c, g, or t
tcagagtatacatacacgaccggtgctcgatttagtgtgagtagttccgcggggaccggccgtcttcgggggccagggaacactggttatcgtctcttcagcctccaccaagggcccatcggtcttccccctggcgccctgctccaggagcacctccgagagcacagcggccctgggctgcctggtcaaggactacttcctatgtatactctgagcgggctggcaaggcgcatagnn

SEQ ID NO: 159274 - DNA, 136 bp, Homo sapiens
  misc_feature: GYAE6OF02HODGW.48.14.B03.1.454.CMB.1.raw
  modified_base (128)..(136): a, c, t, g, unknown or other
  misc_feature (128)..(136): n is a, c, g, or t
tcagagtatacatacacgaccggtgctcgatttagtgtgagtagttccgcgggctggcaaggcgcatagctgcctggtcaaggactacttcccacgagagtactgagcgggctggcaaggcgcatagnnnnnnnnn

SEQ ID NO: 159275 - DNA, 235 bp, Homo sapiens
  misc_feature: GYAE6OF02HBZTH.48.14.B03.1.454.CMB.1.raw
  modified_base (235)..(235): a, c, t, g, unknown or other
  misc_feature (235)..(235): n is a, c, g, or t
tcagagtatacatacacgaccggtgctcgatttagtgtgagtagttccgcggggaccggccgtcttcggggccagggaacactggttatcgtctcttcagcctccaccaagggcccatcggtcttccccctggcgccctgctccaggagcacctccgagagcacagcggccctgggctgcctggtcaaggactacttcctatgtatactctgagcgggctggcaaggcgcatagn

SEQ ID NO: 159276 - DNA, 238 bp, Homo sapiens
  misc_feature: GYAE6OF02G29VG.48.14.B03.1.454.CMB.1.raw
  modified_base (235)..(238): a, c, t, g, unknown or other
  misc_feature (235)..(238): n is a, c, g, or t
tcagagtatacatacacgaccggtgctcgatttagtgtgagtagttccgcggggaccggccgtcttcggggccagggaacactggttatcgtctcttcagcctccaccaagggcccatcggtcttccccctggcgccctgctccaggagcacctccgagagcacagcggccctgggctgcctggtcaaggactacttcctatgtatactctgagcgggctggcaaggcgcatagnnnn

SEQ ID NO: 159277 - DNA, 237 bp, Homo sapiens
  misc_feature: GYAE6OF02GKBFF.48.14.B03.1.454.CMB.1.raw
  modified_base (236)..(237): a, c, t, g, unknown or other
  misc_feature (236)..(237): n is a, c, g, or t
tcagagtatacatacacgaccggtgctcgatttagtgtgagtagttccgcggggaccggccgtcttcgggggccagggaacactggttatcgtctcttcagcctccaccaagggcccatcggtcttccccctggcgccctgctccaggagcacctccgagagcacagcggccctgggctgcctggtcaaggactacttcctctctcgactctgagcgggctggcaaggcgcatagnn

SEQ ID NO: 159278 - DNA, 240 bp, Homo sapiens
  misc_feature: GYAE6OF02F9T76.48.14.B03.1.454.CMB.1.raw
  modified_base (236)..(240): a, c, t, g, unknown or other
  misc_feature (236)..(240): n is a, c, g, or t
tcagagtatacatacacgaccggtgctcgatttagtgtgagtagttccgcggggaccggccgtcttcgggggccagggaacactggttatcgtctcttcagcctccaccaagggcccatcggtcttccccctggcgccctgctccaggagcacctccgagagcacagcggccctgggctgcctggtcaaggactacttcctatgtatactctgagcgggctggcaaggcgcatagnnnnn

SEQ ID NO: 159279 - DNA, 159 bp, Homo sapiens
  misc_feature: GYAE6OF02HP85Y.48.14.B03.1.454.CMB.1.raw
  modified_base (128)..(128): a, c, t, g, unknown or other
  misc_feature (128)..(128): n is a, c, g, or t
  modified_base (142)..(142): a, c, t, g, unknown or other
  misc_feature (142)..(142): n is a, c, g, or t
  modified_base (149)..(159): a, c, t, g, unknown or other
  misc_feature (149)..(159): n is a, c, g, or t
tcagagtatacatacacgaccggtgctcgatttagtgtgagtagttccgcgggcacgaccggtgctcgatttagtgtgagtagttccgcgggcacgaccggtgctcgatttagtgtgagtagttccgngggcgtgcgaaggngcatagnnnnnnnnnnn

SEQ ID NO: 159280 - DNA, 238 bp, Homo sapiens
  misc_feature: GYAE6OF02HI5YM.48.14.B03.1.454.CMB.1.raw
  modified_base (236)..(238): a, c, t, g, unknown or other
  misc_feature (236)..(238): n is a, c, g, or t
tcagagtatacatacacgaccggtgctcgatttagtgtgagtagttccgcggggaccggccgtcttcgggggccagggaacactggttatcgtctcttcagcctccaccaagggcccatcggtcttccccctggcgccctgctccaggagcacctccgagagcacagcggccctgggctgcctggtcaaggactacttcctatgtatactctgagcgggctggcaaggcgcatagnnn

SEQ ID NO: 159281 - DNA, 242 bp, Homo sapiens
  misc_feature: GYAE6OF02GNBEU.48.14.B03.1.454.CMB.1.raw
  modified_base (236)..(242): a, c, t, g, unknown or other
  misc_feature (236)..(242): n is a, c, g, or t
tcagagtatacatacacgaccggtgctcgatttagtgtgagtagttccgcggggaccggccgtcttcgggggccagggaacactggttatcgtctcttcagcctccaccaagggcccatcggtcttccccctggcgccctgctccaggagcacctccgagagcacagcggccctgggctgcctggtcaaggactacttcctatgtatactctgagcgggctggcaaggcgcatagnnnnnnn

SEQ ID NO: 159282 - DNA, 245 bp, Homo sapiens
  misc_feature: GYAE6OF02HCX0Z.48.14.B03.1.454.CMB.1.raw
  modified_base (237)..(245): a, c, t, g, unknown or other
  misc_feature (237)..(245): n is a, c, g, or t
tcagagtatacatacacgaccggtgctcgatttagtgtgagtagttccgcggggaccggccgtcttcgggggccagggaacactggttatcgtctcttcagcctccaccaagggcccatcggtcttccccctggcgccctgctccaggagcacctccgagagcacagcggccctgggctgcctggtcaaggactacttcctatgtatactctgagcgggctggacaaggcgcatagnnnnnnnnn

SEQ ID NO: 159283 - DNA, 244 bp, Homo sapiens
  misc_feature: GYAE6OF02FRBJU.48.14.B03.1.454.CMB.1.raw
  modified_base (237)..(244): a, c, t, g, unknown or other
  misc_feature (237)..(244): n is a, c, g, or t
tcagagtatacatacacgaccggtgctcgatttagtgtgagtagttccgcggggaccggccgtcttcgggggccagggaacactggttatcgtctcttcagcctccaccaagggcccatcggtcttccccctggcgccctgctccaggagcacctccgagagcacagcggccctgggctgcctggtcaaggactacttcctatgtatactctgagcgggctggcaaggcgacatagnnnnnnnn

SEQ ID NO: 159284 - DNA, 304 bp, Homo sapiens
  misc_feature: GYAE6OF02HDYV9.48.14.B03.1.454.CMB.1.raw
  modified_base (299)..(304): a, c, t, g, unknown or other
  misc_feature (299)..(304): n is a, c, g, or t
tcagagtatacatacacgaccggtgctcgatttagtgtgagtagttccgcgggagtagttccgcgggcacgaccggtgctcgatttagatcgtctgtgttgggtttggggggtgtggtggtctccactcccgccttgacgaggctgattactactgtcagtcttttgataacaacaatcacgtggtcttcggcggagggaccagcctgaccgtcctaggtcagcccaaggctgccccctggtcactctgttcccaccctcctctatgtatactctgagcgggctggcaaggcgcatagnnnnnn

SEQ ID NO: 159285 - DNA, 151 bp, Homo sapiens
  misc_feature: GYAE6OF01AXW8D.29.26.C04.1.454.CMB.1.raw
  modified_base (150)..(151): a, c, t, g, unknown or other
  misc_feature (150)..(151): n is a, c, g, or t
tcagatagagtactcacgaccggtgctcgatttagtctagcgactttgggttggaaggtcagcgtcctaggtcagcccaaggccaacccactgtcactctgttcccacctcctctactgctagtctgagcgggctggcaaggcgcatagnn

SEQ ID NO: 159286 - DNA, 151 bp, Homo sapiens
  misc_feature: GYAE6OF01AHNHU.29.26.C04.1.454.CMB.1.raw
  modified_base (150)..(151): a, c, t, g, unknown or other
  misc_feature (150)..(151): n is a, c, g, or t
tcagatagagtactcacgaccggtgctcgatttagtctagcgactttgggtttgggaaggtcagcgtcctaggtcagcccaaggccaacccactgtcactctgttcccctcctctactgctagtctgagcgggctggcaaggcgcatagnn

SEQ ID NO: 159287 - DNA, 153 bp, Homo sapiens
  misc_feature: GYAE6OF01BGBHV.29.26.C04.1.454.CMB.1.raw
  modified_base (153)..(153): a, c, t, g, unknown or other
  misc_feature (153)..(153): n is a, c, g, or t
tcagatagagtactcacgaccggtgctcgatttagtctagcgactttgggtttgggaaggtcagcgtcctaggtcagcccaaggccaacccactgtcactctgttcccaccctcctctactgctagtctgagcgggctggcaaggcgcatagn

SEQ ID NO: 159288 - DNA, 153 bp, Homo sapiens; identical to SEQ ID NO: 159287
  misc_feature: GYAE6OF01A7BB5.29.26.C04.1.454.CMB.1.raw
  modified_base (153)..(153): a, c, t, g, unknown or other
  misc_feature (153)..(153): n is a, c, g, or t

SEQ ID NO: 159289 - DNA, 153 bp, Homo sapiens; identical to SEQ ID NO: 159287
  misc_feature: GYAE6OF01A9LQ4.29.26.C04.1.454.CMB.1.raw
  modified_base (153)..(153): a, c, t, g, unknown or other
  misc_feature (153)..(153): n is a, c, g, or t

SEQ ID NO: 159290 - DNA, 151 bp, Homo sapiens
  misc_feature: GYAE6OF01CJBPJ.29.26.C04.1.454.CMB.1.raw
  modified_base (151)..(151): a, c, t, g, unknown or other
  misc_feature (151)..(151): n is a, c, g, or t
tcagatagagtactcacgaccggtgctcgatttagtctagcgactttgggtttggaaggtcagcgtcctaggtcagcccaaggccaacccactgtcactctgttcccacctcctctactgctagtctgagcgggctggcaaggcgcatagn

SEQ ID NO: 159291 - DNA, 153 bp, Homo sapiens
  misc_feature: GYAE6OF01EAJ2P.29.26.C04.1.454.CMB.1.raw
  modified_base (152)..(153): a, c, t, g, unknown or other
  misc_feature (152)..(153): n is a, c, g, or t
tcagatagagtactcacgaccggtgctcgatttagtctagcgactttgggtttgggaaggtcagcgtcctaggtcagcccaaggccaacccactgtcactctgttcccacctcctctactgctagtctgagcgggctggcaaggcgcatagnn

SEQ ID NO: 159292 - DNA, 153 bp, Homo sapiens
  misc_feature: GYAE6OF01C2FAA.29.26.C04.1.454.CMB.1.raw
  modified_base (153)..(153): a, c, t, g, unknown or other
  misc_feature (153)..(153): n is a, c, g, or t
tcagatagagtactcacgaccggtgctcgatttagtctagcgactttgggtttgggaaggtcagcgtcctaggtcagcccaaggccaaccccactgtcactctgttcccgcctcctctactgctagtctgagcgggctggcaaggcgcatagn

SEQ ID NO: 159293 - DNA, 153 bp, Homo sapiens
  misc_feature: GYAE6OF01DWCTO.29.26.C04.1.454.CMB.1.raw
  modified_base (152)..(153): a, c, t, g, unknown or other
  misc_feature (152)..(153): n is a, c, g, or t
tcagatagagtactcacgaccggtgctcgatttagtctagcgactttgggtttgggaaggtcagcgtcctaggtcagcccaaggccaacccactgtcactctgttcccgccctccttgtcgagcgtctgagcgggctggcaaggcgcatagnn

SEQ ID NO: 159294 - DNA, 154 bp, Homo sapiens
  misc_feature: GYAE6OF01AFIIS.29.26.C04.1.454.CMB.1.raw
  modified_base (154)..(154): a, c, t, g, unknown or other
  misc_feature (154)..(154): n is a, c, g, or t
tcagatagagtactcacgaccggtgctcgatttagtctagcgactttgggtttgggaaggtcagcgtcctaggtcagcccaaggccaaccccactgtcactctgttcccaccctcctctactgctagtctgagcgggctggcaaggcgcatagn

SEQ ID NO: 159295 - DNA, 155 bp, Homo sapiens
  misc_feature: GYAE6OF01A4MN6.29.26.C04.1.454.CMB.1.raw
  modified_base (154)..(155): a, c, t, g, unknown or other
  misc_feature (154)..(155): n is a, c, g, or t
tcagatagagtactcacgaccggtgctcgatttagtctagcgactttgggtttgggaaggtcagcgtcctaggtcagcccaaggccaaccccactgtcactctgttcccaccctcctctactgctagtctgagcgggctggcaaggcgcatagnn

SEQ ID NO: 159296 - DNA, 153 bp, Homo sapiens
  misc_feature: GYAE6OF01DFYWN.29.26.C04.1.454.CMB.1.raw
  modified_base (153)..(153): a, c, t, g, unknown or other
  misc_feature (153)..(153): n is a, c, g, or t
tcagatagagtactcacgaccggtgctcgatttagtctagcgactttgggtttgggaaggtcagcgtcctaggtcagcccaaggccaacccactgtcactctgttcccgccctcctctactgctagtctgagcgggctggcaaggcgcatagn

SEQ ID NO: 159297 - DNA, 154 bp, Homo sapiens; identical to SEQ ID NO: 159294
  misc_feature: GYAE6OF01C6SFS.29.26.C04.1.454.CMB.1.raw
  modified_base (154)..(154): a, c, t, g, unknown or other
  misc_feature (154)..(154): n is a, c, g, or t

SEQ ID NO: 159298 - DNA, 151 bp, Homo sapiens
  misc_feature: GYAE6OF01EVD81.29.26.C04.1.454.CMB.1.raw
  modified_base (151)..(151): a, c, t, g, unknown or other
  misc_feature (151)..(151): n is a, c, g, or t
tcagatagagtactcacgaccggtgctcgatttagtctagcgactttgggttgggaaggtcagcgtcctaggtcagcccaaggccaacccactgtcactctgttcccacctcctctactgctagtctgagcgggctggcaaggcgcatagn

SEQ ID NO: 159299 - DNA, 212 bp, Homo sapiens
  misc_feature: GYAE6OF01BYKOL.29.26.C04.1.454.CMB.1.raw
  modified_base (160)..(212): a, c, t, g, unknown or other
  misc_feature (160)..(212): n is a, c, g, or t
tcagatagagtactcacgaccggtgctcgatttagtctagcgactttgggtttgggtaagggtcagcgtcctaggtcagccccaaggccaaccccactgtcacctctgttcccgcctcctctactgcctagtctgagcgggctggcaaggccgcatagannnnnnnnnnnnnnnnnnnnnnnnnnnnnnnnnnnnnnnnnnnnnnnnnnnnn

SEQ ID NO: 159300 - DNA, 154 bp, Homo sapiens
  misc_feature: GYAE6OF01EC9VV.29.26.C04.1.454.CMB.1.raw
  modified_base (153)..(154): a, c, t, g, unknown or other
  misc_feature (153)..(154): n is a, c, g, or t
tcagatagagtactcacgaccggtgctcgatttagtctagcgactttgggtttgggaaggtcagcgtcctaggtcagcccaaggccaacccactgtcactctgttcccaccctcctctatacgatcgctgagcgggctggcaaggcgcatagnn

SEQ ID NO: 159301 - DNA, 152 bp, Homo sapiens
  misc_feature: GYAE6OF01EOJXQ.29.26.C04.1.454.CMB.1.raw
  modified_base (152)..(152): a, c, t, g, unknown or other
  misc_feature (152)..(152): n is a, c, g, or t
tcagatagagtactcacgaccggtgctcgatttagtctagcgactttgggtttgggaaggtcagcgtcctaggtcagcccaaggccaacccactgtcactctgttcccgcctcctctatacgatcgctgagcgggctggcaaggcgcatagn

SEQ ID NO: 159302 - DNA, 152 bp, Homo sapiens
  misc_feature: GYAE6OF01C7ZJ1.29.26.C04.1.454.CMB.1.raw
  modified_base (152)..(152): a, c, t, g, unknown or other
  misc_feature (152)..(152): n is a, c, g, or t
tcagatagagtactcacgaccggtgctcgatttagtctagcgactttgggtttgggaaggtcagcgtcctaggtcagcccaaggccaacccactgtcactctgttcccacctcctctactgctagtctgagcgggctggcaaggcgcatagn

SEQ ID NO: 159303 - DNA, 154 bp, Homo sapiens; identical to SEQ ID NO: 159294
  misc_feature: GYAE6OF01EGGMV.29.26.C04.1.454.CMB.1.raw
  modified_base (154)..(154): a, c, t, g, unknown or other
  misc_feature (154)..(154): n is a, c, g, or t

SEQ ID NO: 159304 - DNA, 154 bp, Homo sapiens; identical to SEQ ID NO: 159294
  misc_feature: GYAE6OF01EUVOZ.29.26.C04.1.454.CMB.1.raw
  modified_base (154)..(154): a, c, t, g, unknown or other
  misc_feature (154)..(154): n is a, c, g, or t

SEQ ID NO: 159305 - DNA, 154 bp, Homo sapiens; identical to SEQ ID NO: 159294
  misc_feature: GYAE6OF01BB6PS.29.26.C04.1.454.CMB.1.raw
  modified_base (154)..(154): a, c, t, g, unknown or other
  misc_feature (154)..(154): n is a, c, g, or t

SEQ ID NO: 159306 - DNA, 154 bp, Homo sapiens; identical to SEQ ID NO: 159294
  misc_feature: GYAE6OF01APOQ0.29.26.C04.1.454.CMB.1.raw
  modified_base (154)..(154): a, c, t, g, unknown or other
  misc_feature (154)..(154): n is a, c, g, or t

SEQ ID NO: 159307 - DNA, 162 bp, Homo sapiens
  misc_feature: GYAE6OF01EMC7E.29.26.C04.1.454.CMB.1.raw
  modified_base (133)..(133): a, c, t, g, unknown or other
  misc_feature (133)..(133): n is a, c, g, or t
  modified_base (154)..(162): a, c, t, g, unknown or other
  misc_feature (154)..(162): n is a, c, g, or t
tcagatagagtactcacgaccggtgctcgatttagtctagcgactttgggtttgggaaggtcagcgtcctaggtcagcccaaggccaaccccactgtcactctgttcccacctcctctactggctagtctgancgggctggcaaggcgcatagnnnnnnnnn

SEQ ID NO: 159308 - DNA, 173 bp, Homo sapiens
  misc_feature: GYAE6OF01AFC65.29.26.C04.1.454.CMB.1.raw
  modified_base (157)..(173): a, c, t, g, unknown or other
  misc_feature (157)..(173): n is a, c, g, or t
tcagatagagtactcacgaccggtgctcgatttagtctagcgactttgggtttgggtaagggtcagcgtcctaggtcagcccaaggccaaccccactgtcactctgttccccaccctcctctactgctagtctgagcgggctggcaaggcgcatagnnnnnnnnnnnnnnnnn

SEQ ID NO: 159309 - DNA, 178 bp, Homo sapiens
  misc_feature: GYAE6OF01BKP9V.29.26.C04.1.454.CMB.1.raw
  modified_base (153)..(155): a, c, t, g, unknown or other
  misc_feature (153)..(155): n is a, c, g, or t
  modified_base (157)..(178): a, c, t, g, unknown or other
  misc_feature (157)..(178): n is a, c, g, or t
tcagatagagtactcacgaccggtgctcgatttagtctagcgactttgggtttgggaaggtcagcgtcctaggtcagcccaaggccaacccactgtcactctgttcccgcctcctctactgctagtctgagcgggctggcaaggcgctatagnnntnnnnnnnnnnnnnnnnnnnnnn

SEQ ID NO: 159310 - DNA, 164 bp, Homo sapiens
  misc_feature: GYAE6OF01CVLSD.29.26.C04.1.454.CMB.1.raw
  modified_base (153)..(164): a, c, t, g, unknown or other
  misc_feature (153)..(164): n is a, c, g, or t
tcagatagagtactcacgaccggtgctcgatttagtctagcgactttgggtttgggaaggtcagcgtcctaggtcagcccaaggccaaccccactgtcactctgttcccacctcctctgtcgagcgtctgagcgggctggcaaggcgcatagnnnnnnnnnnnn

SEQ ID NO: 159311 - DNA, 155 bp, Homo sapiens; identical to SEQ ID NO: 159295
  misc_feature: GYAE6OF01EMUCX.29.26.C04.1.454.CMB.1.raw
  modified_base (154)..(155): a, c, t, g, unknown or other
  misc_feature (154)..(155): n is a, c, g, or t

SEQ ID NO: 159312 - DNA, 154 bp, Homo sapiens; identical to SEQ ID NO: 159294
  misc_feature: GYAE6OF01EV3JB.29.26.C04.1.454.CMB.1.raw
  modified_base (154)..(154): a, c, t, g, unknown or other
  misc_feature (154)..(154): n is a, c, g, or t

SEQ ID NO: 159313 - DNA, 156 bp, Homo sapiens
  misc_feature: GYAE6OF01BDQ7Z.29.26.C04.1.454.CMB.1.raw
  modified_base (152)..(156): a, c, t, g, unknown or other
  misc_feature (152)..(156): n is a, c, g, or t
tcagatagagtactcacgaccggtgctcgatttagtctagcgactttgggtttgggaaggtcagcgtcctaggtcagcccaaggccaacccactgtcactctgttcccacctcctctatacgatcgctgagcgggctggcaaggcgcatagnnnnn

SEQ ID NO: 159314 - DNA, 153 bp, Homo sapiens; identical to SEQ ID NO: 159287
  misc_feature: GYAE6OF01A09VD.29.26.C04.1.454.CMB.1.raw
  modified_base (153)..(153): a, c, t, g, unknown or other
  misc_feature (153)..(153): n is a, c, g, or t

SEQ ID NO: 159315 - DNA, 154 bp, Homo sapiens
  misc_feature: GYAE6OF01DCWDO.29.26.C04.1.454.CMB.1.raw
  modified_base (154)..(154): a, c, t, g, unknown or other
  misc_feature (154)..(154): n is a, c, g, or t
tcagatagagtactcacgaccggtgctcgatttagtctagcgactttgggtttgggaaggtcagcgtcctaggtcagcccaaggccaaccccactgtcactctgttcccgccctcctctactgctagtctgagcgggctggcaaggcgcatagn

SEQ ID NO: 159316 - DNA, 154 bp, Homo sapiens; identical to SEQ ID NO: 159294
  misc_feature: GYAE6OF01BXVFH.29.26.C04.1.454.CMB.1.raw
  modified_base (154)..(154): a, c, t, g, unknown or other
  misc_feature (154)..(154): n is a, c, g, or t

SEQ ID NO: 159317 - DNA, 154 bp, Homo sapiens; identical to SEQ ID NO: 159294
  misc_feature: GYAE6OF01EFLFK.29.26.C04.1.454.CMB.1.raw
  modified_base (154)..(154): a, c, t, g, unknown or other
  misc_feature (154)..(154): n is a, c, g, or t

SEQ ID NO: 159318 - DNA, 154 bp, Homo sapiens
  misc_feature: GYAE6OF01ER8J8.29.26.C04.1.454.CMB.1.raw
  modified_base (153)..(154): a, c, t, g, unknown or other
  misc_feature (153)..(154): n is a, c, g, or t
tcagatagagtactcacgaccggtgctcgatttagtctagcgactttgggtttgggaaggtcagcgtcctaggtcagcccaaggccaacccactgtcactctgttcccaccctcctctactgctagtctgagcgggctggcaaggcgcatagnn

SEQ ID NO: 159319 - DNA, 154 bp, Homo sapiens; identical to SEQ ID NO: 159294
  misc_feature: GYAE6OF01BFLA7.29.26.C04.1.454.CMB.1.raw
  modified_base (154)..(154): a, c, t, g, unknown or other
  misc_feature (154)..(154): n is a, c, g, or t

SEQ ID NO: 159320 - DNA, 154 bp, Homo sapiens
  misc_feature: GYAE6OF01DMEAU.29.26.C04.1.454.CMB.1.raw
  modified_base (154)..(154): a, c, t, g, unknown or other
  misc_feature (154)..(154): n is a, c, g, or t
tcagatagagtactcacgaccggtgctcgatttagtctagcgactttgggtttgggaaggtcagcgtcctaggtcagcccaaggccaaccccactgtcactctgttcccgccctcctctatacgatcgctgagcgggctggcaaggcgcatagn

SEQ ID NO: 159321 - DNA, 155 bp, Homo sapiens
  misc_feature: GYAE6OF01BUD37.29.26.C04.1.454.CMB.1.raw
  modified_base (153)..(155): a, c, t, g, unknown or other
  misc_feature (153)..(155): n is a, c, g, or t
tcagatagagtactcacgaccggtgctcgatttagtctagcgactttgggtttgggaaggtcagcgtcctaggtcagcccaaggccaaccccactgtcactctgttcccgccctcctctactgctagtcgagcgggctggcaaggcgcatagnnn

SEQ ID NO: 159322 - DNA, 163 bp, Homo sapiens
  misc_feature: GYAE6OF01B1ARZ.29.26.C04.1.454.CMB.1.raw
  modified_base (154)..(163): a, c, t, g, unknown or other
  misc_feature (154)..(163): n is a, c, g, or t
tcagatagagtactcacgaccggtgctcgatttagtctagcgactttgggtttgggaaggtcagcgtcctaggtcgagcccaaggccaaccccactgtcactctgttcccgcctcctctactgctagtctgagcgggctggcaaggcgcatagnnnnnnnnnn

SEQ ID NO: 159323 - DNA, 154 bp, Homo sapiens; identical to SEQ ID NO: 159294
  misc_feature: GYAE6OF01BZOXY.29.26.C04.1.454.CMB.1.raw
  modified_base (154)..(154): a, c, t, g, unknown or other
  misc_feature (154)..(154): n is a, c, g, or t

SEQ ID NO: 159324 - DNA, 153 bp, Homo sapiens; identical to SEQ ID NO: 159287
  misc_feature: GYAE6OF01BMPTX.29.26.C04.1.454.CMB.1.raw
  modified_base (153)..(153): a, c, t, g, unknown or other
  misc_feature (153)..(153): n is a, c, g, or t

SEQ ID NO: 159325 - DNA, 153 bp, Homo sapiens
  misc_feature: GYAE6OF01D02ZS.29.26.C04.1.454.CMB.1.raw
  modified_base (152)..(153): a, c, t, g, unknown or other
  misc_feature (152)..(153): n is a, c, g, or t
tcagatagagtactcacgaccggtgctcgatttagtctagcgactttgggtttgggaaggtcagcgtcctaggtcagcccaaggccaacccactgtcactctgttcccgcctcctctactgctagtctgagcgggctggcaaggcgcatagnn

SEQ ID NO: 159326 - DNA, 153 bp, Homo sapiens; identical to SEQ ID NO: 159287
  misc_feature: GYAE6OF01BEP79.29.26.C04.1.454.CMB.1.raw
  modified_base (153)..(153): a, c, t, g, unknown or other
  misc_feature (153)..(153): n is a, c, g, or t

SEQ ID NO: 159327 - DNA, 154 bp, Homo sapiens; identical to SEQ ID NO: 159294
  misc_feature: GYAE6OF01BZYHB.29.26.C04.1.454.CMB.1.raw
  modified_base (154)..(154): a, c, t, g, unknown or other
  misc_feature (154)..(154): n is a, c, g, or t

SEQ ID NO: 159328 - DNA, 154 bp, Homo sapiens; identical to SEQ ID NO: 159294
  misc_feature: GYAE6OF01CGW7H.29.26.C04.1.454.CMB.1.raw
  modified_base (154)..(154): a, c, t, g, unknown or other
  misc_feature (154)..(154): n is a, c, g, or t

SEQ ID NO: 159329 - DNA, 187 bp, Homo sapiens
  misc_feature: GYAE6OF01B2OXO.29.26.C04.1.454.CMB.1.raw
  modified_base (155)..(155): a, c, t, g, unknown or other
  misc_feature (155)..(155): n is a, c, g, or t
  modified_base (157)..(187): a, c, t, g, unknown or other
  misc_feature (157)..(187): n is a, c, g, or t
tcagatagagtactcacgaccggtgctcgatttagtctagcgactttgggtttgggaaggtcagcgtcctaggtcagcccaaggccaaccccactgtcactctgttcccgccctcctctgtcgagcgtctgagcgggctggctaaggcgcatagncnnnnnnnnnnnnnnnnnnnnnnnnnnnnnnn

SEQ ID NO: 159330 - DNA, 153 bp, Homo sapiens
  misc_feature: GYAE6OF01A9SB9.29.26.C04.1.454.CMB.1.raw
  modified_base (153)..(153): a, c, t, g, unknown or other
  misc_feature (153)..(153): n is a, c, g, or t
tcagatagagtactcacgaccggtgctcgatttagtctagcgactttgggtttgggaaggtcagcgtcctaggtcagcccaaggccaacccactgtcactctgttcccaccctcctctgtcgagcgtctgagcgggctggcaaggcgcatagn

SEQ ID NO: 159331 - DNA, 155 bp, Homo sapiens; identical to SEQ ID NO: 159295
  misc_feature: GYAE6OF01ECGZ5.29.26.C04.1.454.CMB.1.raw
  modified_base (154)..(155): a, c, t, g, unknown or other
  misc_feature (154)..(155): n is a, c, g, or t

SEQ ID NO: 159332 - DNA, 155 bp, Homo sapiens
  misc_feature: GYAE6OF01EIBDP.29.26.C04.1.454.CMB.1.raw
  modified_base (155)..(155): a, c, t, g, unknown or other
  misc_feature (155)..(155): n is a, c, g, or t
tcagatagagtactcacgaccggtgctcgatttagtctagcgactttgggtttgggaagggtcagcgtcctaggtcagcccaaggccaaccccactgtcactctgttcccgccctcctctactgctagtctgagcgggctggcaaggcgcatagn

SEQ ID NO: 159333 - DNA, 156 bp, Homo sapiens
  misc_feature: GYAE6OF01B2FMJ.29.26.C04.1.454.CMB.1.raw
  modified_base (154)..(156): a, c, t, g, unknown or other
  misc_feature (154)..(156): n is a, c, g, or t
tcagatagagtactcacgaccggtgctcgatttagtctagcgactttgggtttgggaaggtcagcgtcctaggtcagcccaaggccaaccccactgtcactctgttcccgccctcctctactgctagtctgagcgggctggcaaggcgcatagnnn

SEQ ID NO: 159334 - DNA, 153 bp, Homo sapiens; identical to SEQ ID NO: 159291
  misc_feature: GYAE6OF01EXHC7.29.26.C04.1.454.CMB.1.raw
  modified_base (152)..(153): a, c, t, g, unknown or other
  misc_feature (152)..(153): n is a, c, g, or t

SEQ ID NO: 159335 - DNA, 155 bp, Homo sapiens
  misc_feature: GYAE6OF01EIZCS.29.26.C04.1.454.CMB.1.raw
  modified_base (154)..(155): a, c, t, g, unknown or other
  misc_feature (154)..(155): n is a, c, g, or t
tcagatagagtactcacgaccggtgctcgatttagtctagcgactttgggtttgggaaggtcagcgtcctaggtcagcccaaggccaaccccactgtcactctgttcccgccctcctctactgctagtctgagcgggctggcaaggcgcatagnn

SEQ ID NO: 159336 - DNA, 154 bp, Homo sapiens; identical to SEQ ID NO: 159315
  misc_feature: GYAE6OF01DJLJT.29.26.C04.1.454.CMB.1.raw
  modified_base (154)..(154): a, c, t, g, unknown or other
  misc_feature (154)..(154): n is a, c, g, or t

SEQ ID NO: 159337 - DNA, 155 bp, Homo sapiens
  misc_feature: GYAE6OF01C8EAR.29.26.C04.1.454.CMB.1.raw
  modified_base (153)..(155): a, c, t, g, unknown or other
  misc_feature (153)..(155): n is a, c, g, or t
tcagatagagtactcacgaccggtgctcgatttagtctagcgactttgggtttgggaaggtcagcgtcctaggtcagcccaaggccaaccccactgtcactctgttcccacctcctctatacgatcgctgagcgggctggcaaggcgcatagnnn

SEQ ID NO: 159338 - DNA, 154 bp, Homo sapiens; identical to SEQ ID NO: 159294
  misc_feature: GYAE6OF01DJZC0.29.26.C04.1.454.CMB.1.raw
  modified_base (154)..(154): a, c, t, g, unknown or other
  misc_feature (154)..(154): n is a, c, g, or t

SEQ ID NO: 159339 - DNA, 173 bp, Homo sapiens
  misc_feature: GYAE6OF01B5UWB.29.26.C04.1.454.CMB.1.raw
  modified_base (154)..(173): a, c, t, g, unknown or other
  misc_feature (154)..(173): n is a, c, g, or t
tcagatagagtactcacgaccggtgctcgatttagtctagcgactttgggtttgggaaggtcagcgtcctaggtcagcccaaggccaaccccactgtcactctgttcccaccctcctctgtcgagcgtctgagcgggctggcaaggcgcatagnnnnnnnnnnnnnnnnnnnn

SEQ ID NO: 159340 - DNA, 154 bp, Homo sapiens; identical to SEQ ID NO: 159294
  misc_feature: GYAE6OF01CBNWY.29.26.C04.1.454.CMB.1.raw
  modified_base (154)..(154): a, c, t, g, unknown or other
  misc_feature (154)..(154): n is a, c, g, or t

SEQ ID NO: 159341 - DNA, 154 bp, Homo sapiens; identical to SEQ ID NO: 159318
  misc_feature: GYAE6OF01EZE8Y.29.26.C04.1.454.CMB.1.raw
  modified_base (153)..(154): a, c, t, g, unknown or other
  misc_feature (153)..(154): n is a, c, g, or t

SEQ ID NO: 159342 - DNA, 154 bp, Homo sapiens; identical to SEQ ID NO: 159320
  misc_feature: GYAE6OF01EDNF7.29.26.C04.1.454.CMB.1.raw
  modified_base (154)..(154): a, c, t, g, unknown or other
  misc_feature (154)..(154): n is a, c, g, or t

SEQ ID NO: 159343 - DNA, 154 bp, Homo sapiens; identical to SEQ ID NO: 159315
  misc_feature: GYAE6OF01CYZ2I.29.26.C04.1.454.CMB.1.raw
  modified_base (154)..(154): a, c, t, g, unknown or other
  misc_feature (154)..(154): n is a, c, g, or t

SEQ ID NO: 159344 - DNA, 154 bp, Homo sapiens; identical to SEQ ID NO: 159294
  misc_feature: GYAE6OF01DZIZ2.29.26.C04.1.454.CMB.1.raw
  modified_base (154)..(154): a, c, t, g, unknown or other
  misc_feature (154)..(154): n is a, c, g, or t

SEQ ID NO: 159345 - DNA, 154 bp, Homo sapiens; identical to SEQ ID NO: 159294
  misc_feature: GYAE6OF01DKVMW.29.26.C04.1.454.CMB.1.raw
  modified_base (154)..(154): a, c, t, g, unknown or other
  misc_feature (154)..(154): n is a, c, g, or t

SEQ ID NO: 159346 - DNA, 154 bp, Homo sapiens; identical to SEQ ID NO: 159294
  misc_feature: GYAE6OF01EE1JA.29.26.C04.1.454.CMB.1.raw
  modified_base (154)..(154): a, c, t, g, unknown or other
  misc_feature (154)..(154): n is a, c, g, or t

SEQ ID NO: 159347 - DNA, 191 bp, Homo sapiens
  misc_feature: GYAE6OF01B06TM.29.26.C04.1.454.CMB.1.raw
  modified_base (143)..(143): a, c, t, g, unknown or other
  misc_feature (143)..(143): n is a, c, g, or t
  modified_base (149)..(191): a, c, t, g, unknown or other
  misc_feature (149)..(191): n is a, c, g, or t
tcagatagagtactcacgaccggtgctcgatttagtctagcgactttgggtttggaagtcagcgtcctaggtcagcccaaggccaacccactgtcactctgttcccacctcctctactgctagtctgagcggctggcaaggcncatagnnnnnnnnnnnnnnnnnnnnnnnnnnnnnnnnnnnnnnnnnnn

SEQ ID NO: 159348 - DNA, 166 bp, Homo sapiens
  misc_feature: GYAE6OF01CDX5S.29.26.C04.1.454.CMB.1.raw
  modified_base (154)..(166): a, c, t, g, unknown or other
  misc_feature (154)..(166): n is a, c, g, or t
tcagatagagtactcacgaccggtgctcgatttagtctagcgactttgggtttgggaaggtcagcgtcctaggtcagcccaaggcccaacccactgtcactctgttcccaccctcctctactgctagtctgagcgggctggcaaggcgcatagnnnnnnnnnnnnn

SEQ ID NO: 159349 - DNA, 154 bp, Homo sapiens; identical to SEQ ID NO: 159294
  misc_feature: GYAE6OF01A1V8N.29.26.C04.1.454.CMB.1.raw
  modified_base (154)..(154): a, c, t, g, unknown or other
  misc_feature (154)..(154): n is a, c, g, or t

SEQ ID NO: 159350 - DNA, 154 bp, Homo sapiens; identical to SEQ ID NO: 159294
  misc_feature: GYAE6OF01EJ51Q.29.26.C04.1.454.CMB.1.raw
  modified_base (154)..(154): a, c, t, g, unknown or other
  misc_feature (154)..(154): n is a, c, g, or t

SEQ ID NO: 159351 - DNA, 154 bp, Homo sapiens; identical to SEQ ID NO: 159294
  misc_feature: GYAE6OF01AULCF.29.26.C04.1.454.CMB.1.raw
  modified_base (154)..(154): a, c, t, g, unknown or other
  misc_feature (154)..(154): n is a, c, g, or t

SEQ ID NO: 159352 - DNA, 153 bp, Homo sapiens; identical to SEQ ID NO: 159325
  misc_feature: GYAE6OF01EN6XU.29.26.C04.1.454.CMB.1.raw
  modified_base (152)..(153): a, c, t, g, unknown or other
  misc_feature (152)..(153): n is a, c, g, or t

SEQ ID NO: 159353 - DNA, 155 bp, Homo sapiens; identical to SEQ ID NO: 159295
  misc_feature: GYAE6OF01BMXDL.29.26.C04.1.454.CMB.1.raw
  modified_base (154)..(155): a, c, t, g, unknown or other
  misc_feature (154)..(155): n is a, c, g, or t

SEQ ID NO: 159354 - DNA, 169 bp, Homo sapiens
  misc_feature: GYAE6OF01DR0KU.29.26.C04.1.454.CMB.1.raw
  modified_base (154)..(169): a, c, t, g, unknown or other
  misc_feature (154)..(169): n is a, c, g, or t
tcagatagagtactcacgaccggtgctcgatttagtctagcgactttgggtttgggaagggtcagcgtcctaggtcagcccaaggccaacccactgtcactctgttcccacctcctctatacgatcgctgagcgggctgggcaaggcgcatagnnnnnnnnnnnnnnnn

SEQ ID NO: 159355 - DNA, 204 bp, Homo sapiens
  misc_feature: GYAE6OF01A8XRZ.29.26.C04.1.454.CMB.1.raw
  modified_base (149)..(204): a, c, t, g, unknown or other
  misc_feature (149)..(204): n is a, c, g, or t
tcagatagagtactcacgaccggtgctcgatttagtctagcgactttgggttggaaggtcagcgtcctaggtcagcccaaggccaacccactgtcactctgttcccacctcctctactgctagtctgagcggctggcaaggcgcatagnnnnnnnnnnnnnnnnnnnnnnnnnnnnnnnnnnnnnnnnnnnnnnnnnnnnnnnn

SEQ ID NO: 159356 - DNA, 152 bp, Homo sapiens
  misc_feature: GYAE6OF01AP30M.29.26.C04.1.454.CMB.1.raw
  modified_base (151)..(152): a, c, t, g, unknown or other
  misc_feature (151)..(152): n is a, c, g, or t
tcagatagagtactcacgaccggtgctcgatttagtctagcgactttgggtttgggaaggtcagcgtcctaggtcagcccaaggccaaccccactgtcactctgttcccgccctctactgctagtctgagcgggctggcaaggcgcatagnn

SEQ ID NO: 159357 - DNA, 154 bp, Homo sapiens; identical to SEQ ID NO: 159294
  misc_feature: GYAE6OF01D66E2.29.26.C04.1.454.CMB.1.raw
  modified_base (154)..(154): a, c, t, g, unknown or other
  misc_feature (154)..(154): n is a, c, g, or t

SEQ ID NO: 159358 - DNA, 153 bp, Homo sapiens; identical to SEQ ID NO: 159287
  misc_feature: GYAE6OF01CLQQQ.29.26.C04.1.454.CMB.1.raw
  modified_base (153)..(153): a, c, t, g, unknown or other
  misc_feature (153)..(153): n is a, c, g, or t

SEQ ID NO: 159359 - DNA, 153 bp, Homo sapiens; identical to SEQ ID NO: 159287
  misc_feature: GYAE6OF01C2RWU.29.26.C04.1.454.CMB.1.raw
  modified_base (153)..(153): a, c, t, g, unknown or other
  misc_feature (153)..(153): n is a, c, g, or t

SEQ ID NO: 159360 - DNA, 155 bp, Homo sapiens; identical to SEQ ID NO: 159295
  misc_feature: GYAE6OF01D64CR.29.26.C04.1.454.CMB.1.raw
  modified_base (154)..(155): a, c, t, g, unknown or other
  misc_feature (154)..(155): n is a, c, g, or t

SEQ ID NO: 159361 - DNA, 154 bp, Homo sapiens; identical to SEQ ID NO: 159294
  misc_feature: GYAE6OF01B4782.29.26.C04.1.454.CMB.1.raw
  modified_base (154)..(154): a, c, t, g, unknown or other
  misc_feature (154)..(154): n is a, c, g, or t

SEQ ID NO: 159362 - DNA, 157 bp, Homo sapiens
  misc_feature: GYAE6OF01ETGQ1.29.26.C04.1.454.CMB.1.raw
  modified_base (154)..(157): a, c, t, g, unknown or other
  misc_feature (154)..(157): n is a, c, g, or t
tcagatagagtactcacgaccggtgctcgatttagtctagcgactttgggtttgggaaggtcagcgtcctaggtcagcccaaggccaaccccactgtcactctgttcccaccctcctccgtgtctgatctgagcgggctggcaaggcgcatagnnnn

SEQ ID NO: 159363 - DNA, 153 bp, Homo sapiens
  misc_feature: GYAE6OF01B98E4.29.26.C04.1.454.CMB.1.raw
tcagatagagtactcacgaccggtgctcgatttagtctagcgactttgggtttgggaaggtcagcgtcctaggtcagcccaaggccaaccccactgtcactctgttcccaccctcctctactgctagtctgagcgggctggcaaggcgcatag

SEQ ID NO: 159364 - DNA, 214 bp, Homo sapiens
  misc_feature: GYAE6OF01D21ZZ.29.26.C04.1.454.CMB.1.raw
  modified_base (152)..(214): a, c, t, g, unknown or other
  misc_feature (152)..(214): n is a, c, g, or t
tcagatagagtactcacgaccggtgctcgatttagtctagcgactttgggtttgggaaggtcagcgtcctaggtcagcccaaggccaacccactgtcactctgttcccacctcctctactgctagtctgagcgggctggcaaggcgcatagnnnnnnnnnnnnnnnnnnnnnnnnnnnnnnnnnnnnnnnnnnnnnnnnnnnnnnnnnnnnnnn

SEQ ID NO: 159365 - DNA, 204 bp, Homo sapiens
  misc_feature: GYAE6OF01ARNJK.29.26.C04.1.454.CMB.1.raw
  modified_base (151)..(204): a, c, t, g, unknown or other
  misc_feature (151)..(204): n is a, c, g, or t
tcagatagagtactcacgaccggtgctcgatttagtctagcgactttgggtttggaaggtcagcgtcctaggtcagcccaaggccaaccccactgtcactctgttcccgcctcctctactgctagtctgagcggctggcaaggcgcatagnnnnnnnnnnnnnnnnnnnnnnnnnnnnnnnnnnnnnnnnnnnnnnnnnnnnnn

SEQ ID NO: 159366 - DNA, 155 bp, Homo sapiens; identical to SEQ ID NO: 159295
  misc_feature: GYAE6OF01ADIG3.29.26.C04.1.454.CMB.1.raw
  modified_base (154)..(155): a, c, t, g, unknown or other
  misc_feature (154)..(155): n is a, c, g, or t

SEQ ID NO: 159367 - DNA, 154 bp, Homo sapiens; identical to SEQ ID NO: 159294
  misc_feature: GYAE6OF01EA3UD.29.26.C04.1.454.CMB.1.raw
  modified_base (154)..(154): a, c, t, g, unknown or other
  misc_feature (154)..(154): n is a, c, g, or t

SEQ ID NO: 159368 - DNA, 173 bp, Homo sapiens
  misc_feature: GYAE6OF01ERU6F.29.26.C04.1.454.CMB.1.raw
  modified_base (156)..(173): a, c, t, g, unknown or other
  misc_feature (156)..(173): n is a, c, g, or t
tcagatagagtactcacgaccggtgctcgatttagtctagcgactttgggtttgggaagggtcgagcgtcctaggtcagcccaaggccaaccccactgtcactctgttcccgccctcctctactgctagtctgagcgggctggcaaggcgcatagnnnnnnnnnnnnnnnnnn

SEQ ID NO: 159369 - DNA, 154 bp, Homo sapiens; identical to SEQ ID NO: 159315
  misc_feature: GYAE6OF01CFKAK.29.26.C04.1.454.CMB.1.raw
  modified_base (154)..(154): a, c, t, g, unknown or other
  misc_feature (154)..(154): n is a, c, g, or t

SEQ ID NO: 159370 - DNA, 154 bp, Homo sapiens; identical to SEQ ID NO: 159294
  misc_feature: GYAE6OF01E4NQP.29.26.C04.1.454.CMB.1.raw
  modified_base (154)..(154): a, c, t, g, unknown or other
  misc_feature (154)..(154): n is a, c, g, or t

SEQ ID NO: 159371 - DNA, 160 bp, Homo sapiens
  misc_feature: GYAE6OF01BHFOL.29.26.C04.1.454.CMB.1.raw
  modified_base (153)..(160): a, c, t, g, unknown or other
  misc_feature (153)..(160): n is a, c, g, or t
tcagatagagtactcacgaccggtgctcgatttagtctagcgactttgggtttgggaaggtcagcgtcctaggtcagcccaaggccaacccactgtcactctgttcccaccctcctctatacgatcgctgagcgggctggcaaggcgcatagnnnnnnnn

SEQ ID NO: 159372 - DNA, 172 bp, Homo sapiens
  misc_feature: GYAE6OF01EFOT1.29.26.C04.1.454.CMB.1.raw
  modified_base (153)..(172): a, c, t, g, unknown or other
  misc_feature (153)..(172): n is a, c, g, or t
tcagatagagtactcacgaccggtgctcgatttagtctagcgactttgggtttgggaaggtcagcgtcctaggtcagcccaaggccaaccccactgtcactctgttcccacctcctctactgctagtctgagcgggctggcaaggcgcatagnnnnnnnnnnnnnnnnnnnn

SEQ ID NO: 159373 - DNA, 154 bp, Homo sapiens; identical to SEQ ID NO: 159294
  misc_feature: GYAE6OF01A2S78.29.26.C04.1.454.CMB.1.raw
  modified_base (154)..(154): a, c, t, g, unknown or other
  misc_feature (154)..(154): n is a, c, g, or t

SEQ ID NO: 159374 - DNA, 154 bp, Homo sapiens; identical to SEQ ID NO: 159294
  misc_feature: GYAE6OF01AN1PQ.29.26.C04.1.454.CMB.1.raw
  modified_base (154)..(154): a, c, t, g, unknown or other
  misc_feature (154)..(154): n is a, c, g, or t

SEQ ID NO: 159375 - DNA, 155 bp, Homo sapiens; identical to SEQ ID NO: 159295
  misc_feature: GYAE6OF01EXTWJ.29.26.C04.1.454.CMB.1.raw
  modified_base (154)..(155): a, c, t, g, unknown or other
  misc_feature (154)..(155): n is a, c, g, or t

SEQ ID NO: 159376 - DNA, 154 bp, Homo sapiens
  misc_feature: GYAE6OF01E1CQ2.29.26.C04.1.454.CMB.1.raw
  modified_base (154)..(154): a, c, t, g, unknown or other
  misc_feature (154)..(154): n is a, c, g, or t
tcagatagagtactcacgaccggtgctcgatttagtctagcgactttgggtttgggaaggtcagcgtcctaggtcagcccaaggccaaccccactgtcactctgttcccaccctcctctatgtatactctgagcgggctggcaaggcgcatagn

SEQ ID NO: 159377 - DNA, 155 bp, Homo sapiens; identical to SEQ ID NO: 159295
  misc_feature: GYAE6OF01DT8Q8.29.26.C04.1.454.CMB.1.raw
  modified_base (154)..(155): a, c, t, g, unknown or other
  misc_feature (154)..(155): n is a, c, g, or t

SEQ ID NO: 159378 - DNA, 156 bp, Homo sapiens
  misc_feature: GYAE6OF01AMMIZ.29.26.C04.1.454.CMB.1.raw
  modified_base (154)..(156): a, c, t, g, unknown or other
  misc_feature (154)..(156): n is a, c, g, or t
tcagatagagtactcacgaccggtgctcgatttagtctagcgactttgggtttgggaaggtcagcgtcctaggtcagcccaaggccaaccccactgtcactctgttcccaccctcctctactgctagtctgagcgggctggcaaggcgcatagnnn

SEQ ID NO: 159379 - DNA, 205 bp, Homo sapiens
  misc_feature: GYAE6OF01B38ZY.29.26.C04.1.454.CMB.1.raw
  modified_base (150)..(205): a, c, t, g, unknown or other
  misc_feature (150)..(205): n is a, c, g, or t
tcagatagagtactcacgaccggtgctcgatttagtctagcgactttgggtttgggaaggtcagcgtcctaggtcagcccaaggccaacccatgtcactctgttcccacctcctctactgctagtctgagcggctggcaaggcgcatagnnnnnnnnnnnnnnnnnnnnnnnnnnnnnnnnnnnnnnnnnnnnnnnnnnnnnnnn

SEQ ID NO: 159380 - DNA, 154 bp, Homo sapiens; identical to SEQ ID NO: 159294
  misc_feature: GYAE6OF01CP4LJ.29.26.C04.1.454.CMB.1.raw
  modified_base (154)..(154): a, c, t, g, unknown or other
  misc_feature (154)..(154): n is a, c, g, or t

SEQ ID NO: 159381 - DNA, 185 bp, Homo sapiens
  misc_feature: GYAE6OF01EZHX8.29.26.C04.1.454.CMB.1.raw
  modified_base (156)..(185): a, c, t, g, unknown or other
  misc_feature (156)..(185): n is a, c, g, or t
tcagatagagtactcacgaccggtgctcgatttagtctagcgactttgggtttggggaaggtcagcgtcctaggtcagcccaaggccaaccccactgtcgactctgttcccgcctcctctactgctagtcctgagcgggctggcaaggcgcatagnnnnnnnnnnnnnnnnnnnnnnnnnnnnnn

SEQ ID NO: 159382 - DNA, 153 bp, Homo sapiens
  misc_feature: GYAE6OF01CKSO5.29.26.C04.1.454.CMB.1.raw
  modified_base (153)..(153): a, c, t, g, unknown or other
  misc_feature (153)..(153): n is a, c, g, or t
tcagatagagtactcacgaccggtgctcgatttagtctagcgactttgggtttgggaaggtcagcgtcctaggtcagcccaaggccaaccccactgtcactctgttcccacctcctctactgctagtctgagcgggctggcaaggcgcatagn

SEQ ID NO: 159383 - DNA, 155 bp, Homo sapiens; identical to SEQ ID NO: 159295
  misc_feature: GYAE6OF01EN0IW.29.26.C04.1.454.CMB.1.raw
  modified_base (154)..(155): a, c, t, g, unknown or other
  misc_feature (154)..(155): n is a, c, g, or t

SEQ ID NO: 159384 - DNA, 155 bp, Homo sapiens
  misc_feature: GYAE6OF01DMBF3.29.26.C04.1.454.CMB.1.raw
  modified_base (152)..(155): a, c, t, g, unknown or other
  misc_feature (152)..(155): n is a, c, g, or t
tcagatagagtactcacgaccggtgctcgatttagtctagcgactttgggtttgggaaggtcagcgtcctaggtcagcccaaggccaacccactgtcactctgttcccacctcctctactgctagtctgagcgggctggcaaggcgcatagnnnn

SEQ ID NO: 159385 - DNA, 155 bp, Homo sapiens; identical to SEQ ID NO: 159295
  misc_feature: GYAE6OF01BBDC7.29.26.C04.1.454.CMB.1.raw
  modified_base (154)..(155): a, c, t, g, unknown or other
  misc_feature (154)..(155): n is a, c, g, or t

SEQ ID NO: 159386 - DNA, 154 bp, Homo sapiens; identical to SEQ ID NO: 159294
  misc_feature: GYAE6OF01CALZI.29.26.C04.1.454.CMB.1.raw
  modified_base (154)..(154): a, c, t, g, unknown or other
  misc_feature (154)..(154): n is a, c, g, or t

SEQ ID NO: 159387 - DNA, 154 bp, Homo sapiens; identical to SEQ ID NO: 159294
  misc_feature: GYAE6OF01ESYBM.29.26.C04.1.454.CMB.1.raw
  modified_base (154)..(154): a, c, t, g, unknown or other
  misc_feature (154)..(154): n is a, c, g, or t

SEQ ID NO: 159388 - DNA, 153 bp, Homo sapiens
  misc_feature: GYAE6OF01DDK7I.29.26.C04.1.454.CMB.1.raw
tcagatagagtactcacgaccggtgctcgatttagtctagcgactttgggtttgggaaggtcagcgtcctaggtcagcccaaggccaaccccactgtcactctgttcccgccctcctctatgtatactctgagcgggctggcaaggcgcatag

SEQ ID NO: 159389 - DNA, 154 bp, Homo sapiens
  misc_feature: GYAE6OF01DKDGL.29.26.C04.1.454.CMB.1.raw
  modified_base (153)..(154): a, c, t, g, unknown or other
  misc_feature (153)..(154): n is a, c, g, or t
tcagatagagtactcacgaccggtgctcgatttagtctagcgactttgggtttgggaaggtcagcgtcctaggtcagcccaaggccaaccccactgtcactctgttcccgccctccttgtcgagcgtctgagcgggctggcaaggcgcatagnn

SEQ ID NO: 159390 - DNA, 154 bp, Homo sapiens; identical to SEQ ID NO: 159315
  misc_feature: GYAE6OF01EHRNJ.29.26.C04.1.454.CMB.1.raw
  modified_base (154)..(154): a, c, t, g, unknown or other
  misc_feature (154)..(154): n is a, c, g, or t

SEQ ID NO: 159391 - DNA, 177 bp, Homo sapiens
  misc_feature: GYAE6OF01DF0ZE.29.26.C04.1.454.CMB.1.raw
  modified_base (136)..(136): a, c, t, g, unknown or other
  misc_feature (136)..(136): n is a, c, g, or t
  modified_base (153)..(177): a, c, t, g, unknown or other
  misc_feature (153)..(177): n is a, c, g, or t
tcagatagagtactcacgaccggtgctcgatttagtctagcgactttgggtttgggaaggtcagcgtcctaggtcagcccaaggccaacccactgtcaatctgttcccgcctcctctactgctagtctgagcgggntggcaaggcgcattagnnnnnnnnnnnnnnnnnnnnnnnnn

SEQ ID NO: 159392 - DNA, 154 bp, Homo sapiens; identical to SEQ ID NO: 159320
  misc_feature: GYAE6OF01C05RH.29.26.C04.1.454.CMB.1.raw
  modified_base (154)..(154): a, c, t, g, unknown or other
  misc_feature (154)..(154): n is a, c, g, or t

SEQ ID NO: 159393 - DNA, 155 bp, Homo sapiens; identical to SEQ ID NO: 159295
  misc_feature: GYAE6OF01DGJBY.29.26.C04.1.454.CMB.1.raw
  modified_base (154)..(155): a, c, t, g, unknown or other
  misc_feature (154)..(155): n is a, c, g, or t

SEQ ID NO: 159394 - DNA, 155 bp, Homo sapiens
  misc_feature: GYAE6OF01EWMNT.29.26.C04.1.454.CMB.1.raw
  modified_base (153)..(155): a, c, t, g, unknown or other
  misc_feature (153)..(155): n is a, c, g, or t
tcagatagagtactcacgaccggtgctcgatttagtctagcgactttgggtttgggaaggtcagcgtcctaggtcagcccaaggccaaccccactgtcactctgttcccgccctccttgtcgagcgtctgagcgggctggcaaggcgcatagnnn

SEQ ID NO: 159395 - DNA, 157 bp, Homo sapiens
  misc_feature: GYAE6OF01DCAXQ.29.26.C04.1.454.CMB.1.raw
  modified_base (154)..(157): a, c, t, g, unknown or other
  misc_feature (154)..(157): n is a, c, g, or t
tcagatagagtactcacgaccggtgctcgatttagtctagcgactttgggtttgggaaggtcagcgtcctaggtcagcccaaggccaaccccactgtcactctgttcccaccctcctctactgctagtctgagcgggctggcaaggcgcatagnnnn

SEQ ID NO: 159396 - DNA, 155 bp, Homo sapiens; identical to SEQ ID NO: 159335
  misc_feature: GYAE6OF01ED184.29.26.C04.1.454.CMB.1.raw
  modified_base (154)..(155): a, c, t, g, unknown or other
  misc_feature (154)..(155): n is a, c, g, or t

SEQ ID NO: 159397 - DNA, 154 bp, Homo sapiens; identical to SEQ ID NO: 159294
  misc_feature: GYAE6OF01E0HRG.29.26.C04.1.454.CMB.1.raw
  modified_base (154)..(154): a, c, t, g, unknown or other
  misc_feature (154)..(154): n is a, c, g, or t

SEQ ID NO: 159398 - DNA, 155 bp, Homo sapiens; identical to SEQ ID NO: 159295
  misc_feature: GYAE6OF01D6AK4.29.26.C04.1.454.CMB.1.raw
  modified_base (154)..(155): a, c, t, g, unknown or other
  misc_feature (154)..(155): n is a, c, g, or t

SEQ ID NO: 159399 - DNA, 156 bp, Homo sapiens; identical to SEQ ID NO: 159378
  misc_feature: GYAE6OF01AGH5J.29.26.C04.1.454.CMB.1.raw
  modified_base (154)..(156): a, c, t, g, unknown or other
  misc_feature (154)..(156): n is a, c, g, or t

SEQ ID NO: 159400 - DNA, 154 bp, Homo sapiens; identical to SEQ ID NO: 159315
  misc_feature: GYAE6OF01DTFUH.29.26.C04.1.454.CMB.1.raw
  modified_base (154)..(154): a, c, t, g, unknown or other
  misc_feature (154)..(154): n is a, c, g, or t

SEQ ID NO: 159401 - DNA, 156 bp, Homo sapiens
  misc_feature: GYAE6OF01CT3R0.29.26.C04.1.454.CMB.1.raw
  modified_base (154)..(156): a, c, t, g, unknown or other
  misc_feature (154)..(156): n is a, c, g, or t
tcagatagagtactcacgaccggtgctcgatttagtctagcgactttgggtttgggaaggtcagcgtcctaggtcagcccaaggccaaccccactgtcactctgttcccgccctcctctgtcgagcgtctgagcgggctggcaaggcgcatagnnn

SEQ ID NO: 159402 - DNA, 161 bp, Homo sapiens
  misc_feature: GYAE6OF01DB25P.29.26.C04.1.454.CMB.1.raw
  modified_base (153)..(161): a, c, t, g, unknown or other
  misc_feature (153)..(161): n is a, c, g, or t
tcagatagagtactcacgaccggtgctcgatttagtctagcgactttgggtttgggaaggtcagcgtcctaggtcagcccaaggccaacccactgtcactctgttcccgccctcctctactgctagtctgagcgggctggcaaggcgcatagnnnnnnnnn

SEQ ID NO: 159403 - DNA, 154 bp, Homo sapiens
  misc_feature: GYAE6OF01A36WQ.29.26.C04.1.454.CMB.1.raw
  modified_base (154)..(154): a, c, t, g, unknown or other
  misc_feature (154)..(154): n is a, c, g, or t
tcagatagagtactcacgaccggtgctcgatttagtctagcgactttgggtttgggaaggtcagcgtcctaggtcagcccaaggccaaccccactgtcactctgttcccgccctcctctgtcgagcgtctgagcgggctggcaaggcgcatagn

SEQ ID NO: 159404 - DNA, 155 bp, Homo sapiens
  misc_feature: GYAE6OF01BCGP6.29.26.C04.1.454.CMB.1.raw
  modified_base (154)..(155): a, c, t, g, unknown or other
  misc_feature (154)..(155): n is a, c, g, or t
tcagatagagtactcacgaccggtgctcgatttagtctagcgactttgggtttgggaaggtcagcgtcctaggtcagcccaaggccaaccccactgtcactctgttcccgccctcctctatacgatcgctgagcgggctggcaaggcgcatagnn

SEQ ID NO: 159405 - DNA, 154 bp, Homo sapiens; identical to SEQ ID NO: 159294
  misc_feature: GYAE6OF01CU1J2.29.26.C04.1.454.CMB.1.raw
  modified_base (154)..(154): a, c, t, g, unknown or other
  misc_feature (154)..(154): n is a, c, g, or t

SEQ ID NO: 159406 - DNA, 159 bp, Homo sapiens
  misc_feature: GYAE6OF01D2AVI.29.26.C04.1.454.CMB.1.raw
  modified_base (154)..(159): a, c, t, g, unknown or other
  misc_feature (154)..(159): n is a, c, g, or t
tcagatagagtactcacgaccggtgctcgatttagtctagcgactttgggtttgggaaggtcagcgtcctaggtcagcccaaggccaaccccactgtcactctgttcccaccctcctctactgctagtctgagcgggctggcaaggcgcatagnnnnnn

SEQ ID NO: 159407 - DNA, 163 bp, Homo sapiens
  misc_feature: GYAE6OF01A2OTP.29.26.C04.1.454.CMB.1.raw
  modified_base (154)..(163): a, c, t, g, unknown or other
  misc_feature (154)..(163): n is a, c, g, or t
tcagatagagtactcacgaccggtgctcgatttagtctagcgactttgggtttgggaaggtcagcgtcctaggtcagcccaaggccaaccccactgtcactctgttcccaccctcctctactgctagtctgagcgggctggcaaggcgcatagnnnnnnnnnn

SEQ ID NO: 159408 - DNA, 155 bp, Homo sapiens; identical to SEQ ID NO: 159295
  misc_feature: GYAE6OF01BGYOM.29.26.C04.1.454.CMB.1.raw
  modified_base (154)..(155): a, c, t, g, unknown or other
  misc_feature (154)..(155): n is a, c, g, or t

SEQ ID NO: 159409 - DNA, 161 bp, Homo sapiens
  misc_feature: GYAE6OF01C1JLU.29.26.C04.1.454.CMB.1.raw
  modified_base (153)..(161): a, c, t, g, unknown or other
  misc_feature (153)..(161): n is a, c, g, or t
tcagatagagtactcacgaccggtgctcgatttagtctagcgactttgggtttgggaaggtcagcgtcctaggtcagcccaaggccaaccccactgtcactctgttcccgcctcctctactgctagtctgagcgggctggcaaggcgcatagnnnnnnnnn

SEQ ID NO: 159410 - DNA, 193 bp, Homo sapiens
  misc_feature: GYAE6OF01BIRSL.29.26.C04.1.454.CMB.1.raw
  modified_base (153)..(193): a, c, t, g, unknown or other
  misc_feature (153)..(193): n is a, c, g, or t
tcagatagagtactcacgaccggtgctcgatttagtctagcgactttgggtttgggaggtcagcgtcctaggtccagcccaaggccaaccccatgtcactctgttcccgccctcctctactcgctagtctgagcggctggcaaggcgcatagnnnnnnnnnnnnnnnnnnnnnnnnnnnnnnnnnnnnnnnnn

SEQ ID NO: 159411 - DNA, 154 bp, Homo sapiens; identical to SEQ ID NO: 159294
  misc_feature: GYAE6OF01BRZIV.29.26.C04.1.454.CMB.1.raw
  modified_base (154)..(154): a, c, t, g, unknown or other
  misc_feature (154)..(154): n is a, c, g, or t

SEQ ID NO: 159412 - DNA, 157 bp, Homo sapiens; identical to SEQ ID NO: 159395
  misc_feature: GYAE6OF01C8JNK.29.26.C04.1.454.CMB.1.raw
  modified_base (154)..(157): a, c, t, g, unknown or other
  misc_feature (154)..(157): n is a, c, g, or t

SEQ ID NO: 159413 - DNA, 154 bp, Homo sapiens; identical to SEQ ID NO: 159294
  misc_feature: GYAE6OF01DARDK.29.26.C04.1.454.CMB.1.raw
  modified_base (154)..(154): a, c, t, g, unknown or other
  misc_feature (154)..(154): n is a, c, g, or t

SEQ ID NO: 159414 - DNA, 157 bp, Homo sapiens; identical to SEQ ID NO: 159395
  misc_feature: GYAE6OF01EGFTA.29.26.C04.1.454.CMB.1.raw
  modified_base (154)..(157): a, c, t, g, unknown or other
  misc_feature (154)..(157): n is a, c, g, or t

SEQ ID NO: 159415 - DNA, 154 bp, Homo sapiens; identical to SEQ ID NO: 159376
  misc_feature: GYAE6OF01DLEO7.29.26.C04.1.454.CMB.1.raw
  modified_base (154)..(154): a, c, t, g, unknown or other
  misc_feature (154)..(154): n is a, c, g, or t

SEQ ID NO: 159416 - DNA, 154 bp, Homo sapiens
  misc_feature: GYAE6OF01C7NAD.29.26.C04.1.454.CMB.1.raw
  modified_base (153)..(154): a, c, t, g, unknown or other
  misc_feature (153)..(154): n is a, c, g, or t
tcagatagagtactcacgaccggtgctcgatttagtctagcgactttgggtttgggaaggtcagcgtcctaggtcagcccaaggccaaccccactgtcactctgttcccacctcctctactgctagtctgagcgggctggcaaggcgcatagnn

SEQ ID NO: 159417 - DNA, 157 bp, Homo sapiens; identical to SEQ ID NO: 159395
  misc_feature: GYAE6OF01B7408.29.26.C04.1.454.CMB.1.raw
  modified_base (154)..(157): a, c, t, g, unknown or other
  misc_feature (154)..(157): n is a, c, g, or t

SEQ ID NO: 159418 - DNA, 155 bp, Homo sapiens; identical to SEQ ID NO: 159295
  misc_feature: GYAE6OF01BBT75.29.26.C04.1.454.CMB.1.raw
  modified_base (154)..(155): a, c, t, g, unknown or other
  misc_feature (154)..(155): n is a, c, g, or t

SEQ ID NO: 159419 - DNA, 155 bp, Homo sapiens
  misc_feature: GYAE6OF01D79OJ.29.26.C04.1.454.CMB.1.raw
  modified_base (153)..(155): a, c, t, g, unknown or other
  misc_feature (153)..(155): n is a, c, g, or t
tcagatagagtactcacgaccggtgctcgatttagtctagcgactttgggtttgggaaggtcagcgtcctaggtcagcccaaggccaaccccactgtcactctgttcccgcctcctctactgctagtctgagcgggctggcaaggcgcatagnnn

SEQ ID NO: 159420 - DNA, 153 bp, Homo sapiens; identical to SEQ ID NO: 159382
  misc_feature: GYAE6OF01ADU7T.29.26.C04.1.454.CMB.1.raw
  modified_base (153)..(153): a, c, t, g, unknown or other
  misc_feature (153)..(153): n is a, c, g, or t

SEQ ID NO: 159421 - DNA, 155 bp, Homo sapiens
  misc_feature: GYAE6OF01E3SEI.29.26.C04.1.454.CMB.1.raw
  modified_base (154)..(155): a, c, t, g, unknown or other
  misc_feature (154)..(155): n is a, c, g, or t
tcagatagagtactcacgaccggtgctcgatttagtctagcgactttgggtttgggaaggtcagcgtcctaggtcagcccaaggccaaccccactgtcactctgttcccaccctcctctatgtatactctgagcgggctggcaaggcgcatagnn

SEQ ID NO: 159422 - DNA, 154 bp, Homo sapiens; identical to SEQ ID NO: 159315
  misc_feature: GYAE6OF01EXKZ9.29.26.C04.1.454.CMB.1.raw
  modified_base (154)..(154): a, c, t, g, unknown or other
  misc_feature (154)..(154): n is a, c, g, or t

SEQ ID NO: 159423 - DNA, 154 bp, Homo sapiens; identical to SEQ ID NO: 159294
  misc_feature: GYAE6OF01EGDWI.29.26.C04.1.454.CMB.1.raw
  modified_base (154)..(154): a, c, t, g, unknown or other
  misc_feature (154)..(154): n is a, c, g, or t

SEQ ID NO: 159424 - DNA, 190 bp, Homo sapiens
  misc_feature: GYAE6OF01DZTVK.29.26.C04.1.454.CMB.1.raw
  modified_base (131)..(131): a, c, t, g, unknown or other
  misc_feature (131)..(131): n is a, c, g, or t
  modified_base (152)..(190): a, c, t, g, unknown or other
  misc_feature (152)..(190): n is a, c, g, or t
tcagatagagtactcacgaccggtgctcgatttagtctagcgactttgggtttgggaggtcagcgtcctaggtcagcccaaggccaaccccactgtcactctgttcccgccctcctctactgctagtctgngcggctggcaaggcgcatagnnnnnnnnnnnnnnnnnnnnnnnnnnnnnnnnnnnnnnn

SEQ ID NO: 159425 - DNA, 153 bp, Homo sapiens; identical to SEQ ID NO: 159292
  misc_feature: GYAE6OF01D8TYF.29.26.C04.1.454.CMB.1.raw
  modified_base (153)..(153): a, c, t, g, unknown or other
  misc_feature (153)..(153): n is a, c, g, or t

SEQ ID NO: 159426 - DNA, 155 bp, Homo sapiens; identical to SEQ ID NO: 159295
  misc_feature: GYAE6OF01C11O4.29.26.C04.1.454.CMB.1.raw
  modified_base (154)..(155): a, c, t, g, unknown or other
  misc_feature (154)..(155): n is a, c, g, or t

SEQ ID NO: 159427 - DNA, 154 bp, Homo sapiens; identical to SEQ ID NO: 159416
  misc_feature: GYAE6OF01DI49H.29.26.C04.1.454.CMB.1.raw
  modified_base (153)..(154): a, c, t, g, unknown or other
  misc_feature (153)..(154): n is a, c, g, or t

SEQ ID NO: 159428 - DNA, 154 bp, Homo sapiens; identical to SEQ ID NO: 159294
  misc_feature: GYAE6OF01BXAI8.29.26.C04.1.454.CMB.1.raw
  modified_base (154)..(154): a, c, t, g, unknown or other
  misc_feature (154)..(154): n is a, c, g, or t

SEQ ID NO: 159429 - DNA, 154 bp, Homo sapiens; identical to SEQ ID NO: 159294
  misc_feature: GYAE6OF01CEJ59.29.26.C04.1.454.CMB.1.raw
  modified_base (154)..(154): a, c, t, g, unknown or other
  misc_feature (154)..(154): n is a, c, g, or t

SEQ ID NO: 159430 - DNA, 165 bp, Homo sapiens
  misc_feature: GYAE6OF01CUTZ3.29.26.C04.1.454.CMB.1.raw
  modified_base (145)..(145): a, c, t, g, unknown or other
  misc_feature (145)..(145): n is a, c, g, or t
  modified_base (150)..(165): a, c, t, g, unknown or other
  misc_feature (150)..(165): n is a, c, g, or t
tcagatagagtactcacgaccggtgctcgatttagtctagcgactttgggtttgggaaggtcagcgtcctaggtcagcccaaggccaacccatgtcactctgtcccacctcctctactgctagtctgagcgggctggcaagggcncatgnnnnnnnnnnnnnnnn

SEQ ID NO: 159431 - DNA, 156 bp, Homo sapiens
  misc_feature: GYAE6OF01CH67Z.29.26.C04.1.454.CMB.1.raw
  modified_base (153)..(156): a, c, t, g, unknown or other
  misc_feature (153)..(156): n is a, c, g, or t
tcagatagagtactcacgaccggtgctcgatttagtctagcgactttgggtttgggaaggtcagcgtcctaggtcagcccaaggccaaccccactgtcactctgttcccacctcctctactgctagtctgagcgggctggcaaggcgcatagnnnn

SEQ ID NO: 159432 - DNA, 154 bp, Homo sapiens; identical to SEQ ID NO: 159294
  misc_feature: GYAE6OF01EMY1O.29.26.C04.1.454.CMB.1.raw
  modified_base (154)..(154): a, c, t, g, unknown or other
  misc_feature (154)..(154): n is a, c, g, or t

SEQ ID NO: 159433 - DNA, 153 bp, Homo sapiens; identical to SEQ ID NO: 159382
  misc_feature: GYAE6OF01DINVK.29.26.C04.1.454.CMB.1.raw
  modified_base (153)..(153): a, c, t, g, unknown or other
  misc_feature (153)..(153): n is a, c, g, or t

SEQ ID NO: 159434 - DNA, 156 bp, Homo sapiens; identical to SEQ ID NO: 159378
  misc_feature: GYAE6OF01DSWZP.29.26.C04.1.454.CMB.1.raw
  modified_base (154)..(156): a, c, t, g, unknown or other
  misc_feature (154)..(156): n is a, c, g, or t

SEQ ID NO: 159435 - DNA, 154 bp, Homo sapiens; identical to SEQ ID NO: 159294
  misc_feature: GYAE6OF01BOPD6.29.26.C04.1.454.CMB.1.raw
  modified_base (154)..(154): a, c, t, g, unknown or other
  misc_feature (154)..(154): n is a, c, g, or t

SEQ ID NO: 159436 - DNA, 155 bp, Homo sapiens
  misc_feature: GYAE6OF01E116U.29.26.C04.1.454.CMB.1.raw
  modified_base (153)..(155): a, c, t, g, unknown or other
  misc_feature (153)..(155): n is a, c, g, or t
tcagatagagtactcacgaccggtgctcgatttagtctagcgactttgggtttgggaaggtcagcgtcctaggtcagcccaaggccaaccccactgtcactctgttcccacctcctctactgctagtctgagcgggctggcaaggcgcatagnnn

SEQ ID NO: 159437 - DNA, 154 bp, Homo sapiens; identical to SEQ ID NO: 159315
  misc_feature: GYAE6OF01A8EHU.29.26.C04.1.454.CMB.1.raw
  modified_base (154)..(154): a, c, t, g, unknown or other
  misc_feature (154)..(154): n is a, c, g, or t

SEQ ID NO: 159438 - DNA, 154 bp, Homo sapiens; identical to SEQ ID NO: 159294
  misc_feature: GYAE6OF01EQMZ1.29.26.C04.1.454.CMB.1.raw
  modified_base (154)..(154): a, c, t, g, unknown or other
  misc_feature (154)..(154): n is a, c, g, or t

SEQ ID NO: 159439 - DNA, 155 bp, Homo sapiens
  misc_feature: GYAE6OF01A95BV.29.26.C04.1.454.CMB.1.raw
  modified_base (154)..(155): a, c, t, g, unknown or other
  misc_feature (154)..(155): n is a, c, g, or t
tcagatagagtactcacgaccggtgctcgatttagtctagcgactttgggtttgggaaggtcagcgtcctaggtcagcccaaggccaaccccactgtcactctgttcccgccctcctctgtcgagcgtctgagcgggctggcaaggcgcatagnn

SEQ ID NO: 159440 - DNA, 200 bp, Homo sapiens
  misc_feature: GYAE6OF01BCFO1.29.26.C04.1.454.CMB.1.raw
  modified_base (154)..(154): a, c, t, g, unknown or other
  misc_feature (154)..(154): n is a, c, g, or t
  modified_base (156)..(200): a, c, t, g, unknown or other
  misc_feature (156)..(200): n is a, c, g, or t
tcagatagagtactcacgaccggtgctcgatttagtctagcgactttgggtttgggaaggtcagcgtcctaggtcagcccaaggccaacccactgtcactctgttcccgcctcctctactgcttagtctgagcgggctgggcaaggcgcatagngnnnnnnnnnnnnnnnnnnnnnnnnnnnnnnnnnnnnnnnnnnnnn

SEQ ID NO: 159441 - DNA, 155 bp, Homo sapiens; identical to SEQ ID NO: 159295
  misc_feature: GYAE6OF01D88B9.29.26.C04.1.454.CMB.1.raw
  modified_base (154)..(155): a, c, t, g, unknown or other
  misc_feature (154)..(155): n is a, c, g, or t

SEQ ID NO: 159442 - DNA, 158 bp, Homo sapiens
  misc_feature: GYAE6OF01BF01E.29.26.C04.1.454.CMB.1.raw
  modified_base (154)..(158): a, c, t, g, unknown or other
  misc_feature (154)..(158): n is a, c, g, or t
tcagatagagtactcacgaccggtgctcgatttagtctagcgactttgggtttgggaaggtcagcgtcctaggtcagcccaaggccaaccccactgtcactctgttcccaccctcctctactgctagtctgagcgggctggcaaggcgcatagnnnnn

SEQ ID NO: 159443 - DNA, 157 bp, Homo sapiens; identical to SEQ ID NO: 159395
  misc_feature: GYAE6OF01A6PRL.29.26.C04.1.454.CMB.1.raw
  modified_base (154)..(157): a, c, t, g, unknown or other
  misc_feature (154)..(157): n is a, c, g, or t

SEQ ID NO: 159444 - DNA, 162 bp, Homo sapiens
  misc_feature: GYAE6OF01BNWRM.29.26.C04.1.454.CMB.1.raw
  modified_base (153)..(162): a, c, t, g, unknown or other
  misc_feature (153)..(162): n is a, c, g, or t
tcagatagagtactcacgaccggtgctcgatttagtctagcgactttgggtttgggaaggtcagcgtcctaggtcagcccaaggccaaccccatgtcactctgttccccacctcctctatacgatcgctgagcgggctggcaaggcgcatagnnnnnnnnnn

SEQ ID NO: 159445 - DNA, 156 bp, Homo sapiens; identical to SEQ ID NO: 159378
  misc_feature: GYAE6OF01ETSR4.29.26.C04.1.454.CMB.1.raw
  modified_base (154)..(156): a, c, t, g, unknown or other
  misc_feature (154)..(156): n is a, c, g, or t

SEQ ID NO: 159446 - DNA, 157 bp, Homo sapiens; identical to SEQ ID NO: 159395
  misc_feature: GYAE6OF01BH3KJ.29.26.C04.1.454.CMB.1.raw
  modified_base (154)..(157): a, c, t, g, unknown or other
  misc_feature (154)..(157): n is a, c, g, or t

SEQ ID NO: 159447 - DNA, 177 bp, Homo sapiens
  misc_feature: GYAE6OF01A4B8E.29.26.C04.1.454.CMB.1.raw
  modified_base (153)..(177): a, c, t, g, unknown or other
  misc_feature (153)..(177): n is a, c, g, or t
tcagatagagtactcacgaccggtgctcgatttagtctagcgactttgggtttgggaaggtcagcgtcctaggtcagcccaaggccaaccccactgtcactctgttcccaccctcctctactgctagtctgagcggctggcaaggcgcatagnnnnnnnnnnnnnnnnnnnnnnnnn

SEQ ID NO: 159448 - DNA, 178 bp, Homo sapiens
  misc_feature: GYAE6OF01CI99Q.29.26.C04.1.454.CMB.1.raw
  modified_base (154)..(178): a, c, t, g, unknown or other
  misc_feature (154)..(178): n is a, c, g, or t
tcagatagagtactcacgaccggtgctcgatttagtctagcgactttgggtttgggaaggtcgagcgtcctaggtcagcccaaggccaaccccactgtcactctgttcccgcctcctctactgctagtctgagcgggctggcaaggcgcatagnnnnnnnnnnnnnnnnnnnnnnnnn

SEQ ID NO: 159449 - DNA, 184 bp, Homo sapiens
  misc_feature: GYAE6OF01E31IE.29.26.C04.1.454.CMB.1.raw
  modified_base (158)..(184): a, c, t, g, unknown or other
  misc_feature (158)..(184): n is a, c, g, or t
tcagatagagtactcacgaccggtgctcgatttagtctagcgactttgggtttgggaagggtcagcgtcctaggtcagcccaaggccaaccccatgtcactctggttccccgccctcctctactgcgtagtctgagcgggctggcaaggccgcatagnnnnnnnnnnnnnnnnnnnnnnnnnnn

SEQ ID NO: 159450 - DNA, 156 bp, Homo sapiens; identical to SEQ ID NO: 159378
  misc_feature: GYAE6OF01BLLI4.29.26.C04.1.454.CMB.1.raw
  modified_base (154)..(156): a, c, t, g, unknown or other
  misc_feature (154)..(156): n is a, c, g, or t

SEQ ID NO: 159451 - DNA, 156 bp, Homo sapiens; identical to SEQ ID NO: 159431
  misc_feature: GYAE6OF01CXLIH.29.26.C04.1.454.CMB.1.raw
  modified_base (153)..(156): a, c, t, g, unknown or other
  misc_feature (153)..(156): n is a, c, g, or t

SEQ ID NO: 159452 - DNA, 155 bp, Homo sapiens; identical to SEQ ID NO: 159295
  misc_feature: GYAE6OF01D2IOD.29.26.C04.1.454.CMB.1.raw
  modified_base (154)..(155): a, c, t, g, unknown or other
  misc_feature (154)..(155): n is a, c, g, or t

SEQ ID NO: 159453 - DNA, 154 bp, Homo sapiens; identical to SEQ ID NO: 159315
  misc_feature: GYAE6OF01C8B9B.29.26.C04.1.454.CMB.1.raw
  modified_base (154)..(154): a, c, t, g, unknown or other
  misc_feature (154)..(154): n is a, c, g, or t

SEQ ID NO: 159454 - DNA, 201 bp, Homo sapiens
  misc_feature: GYAE6OF01EV3L6.29.26.C04.1.454.CMB.1.raw
  modified_base (160)..(201): a, c, t, g, unknown or other
  misc_feature (160)..(201): n is a, c, g, or t
tcagatagagtactcacgaccggtgctcgatttagtctagcgactttgggttgggaaggtcagcgtcctaggtcagcccaaggccaaccccacgtgtcactcctgttcccgccctcctcctatacgatccgcctgagcgggtctgggcaaggcgcatagnnnnnnnnnnnnnnnnnnnnnnnnnnnnnnnnnnnnnnnnnn

SEQ ID NO: 159455 - DNA, 179 bp, Homo sapiens
  misc_feature: GYAE6OF01DU9HX.29.26.C04.1.454.CMB.1.raw
  modified_base (159)..(179): a, c, t, g, unknown or other
  misc_feature (159)..(179): n is a, c, g, or t
tcagatagagtactcacgaccggtgctcgatttagtctagcgactttgggtttgggaagggtcagcgtcctaggtcagcccaaggccaaaccccactggtcactctacgttcccaccctcctctactgctagtctgagcgggctggcaaggcgcatagnnnnnnnnnnnnnnnnnnnnn

SEQ ID NO: 159456 - DNA, 155 bp, Homo sapiens; identical to SEQ ID NO: 159295
  misc_feature: GYAE6OF01EPX8W.29.26.C04.1.454.CMB.1.raw
  modified_base (154)..(155): a, c, t, g, unknown or other
  misc_feature (154)..(155): n is a, c, g, or t

SEQ ID NO: 159457 - DNA, 160 bp, Homo sapiens
  misc_feature: GYAE6OF01C4XIV.29.26.C04.1.454.CMB.1.raw
  modified_base (153)..(160): a, c, t, g, unknown or other
  misc_feature (153)..(160): n is a, c, g, or t
tcagatagagtactcacgaccggtgctcgatttagtctagcgactttgggtttgggaaggtcagcgtcctaggtcagcccaaggccaaccccactgtcactctgttcccacctcctctactgctagtctgagcgggctggcaaggcgcatagnnnnnnnn

SEQ ID NO: 159458 - DNA, 174 bp, Homo sapiens
  misc_feature: GYAE6OF01B8M86.29.26.C04.1.454.CMB.1.raw
  modified_base (152)..(174): a, c, t, g, unknown or other
  misc_feature (152)..(174): n is a, c, g, or t
tcagatagagtactcacgaccggtgctcgatttagtctagcgactttgggtttgggaaggtcagcgtcctaggtcagcccaaggccaacccactgtcactctgttcccaccctcctctactgctagtctgagcggctggcaaggcgcatagnnnnnnnnnnnnnnnnnnnnnnn

SEQ ID NO: 159459 - DNA, 156 bp, Homo sapiens; identical to SEQ ID NO: 159333
  misc_feature: GYAE6OF01B5W81.29.26.C04.1.454.CMB.1.raw
  modified_base (154)..(156): a, c, t, g, unknown or other
  misc_feature (154)..(156): n is a, c, g, or t

SEQ ID NO: 159460 - DNA, 154 bp, Homo sapiens; identical to SEQ ID NO: 159294
  misc_feature: GYAE6OF01DSUK9.29.26.C04.1.454.CMB.1.raw
  modified_base (154)..(154): a, c, t, g, unknown or other
  misc_feature (154)..(154): n is a, c, g, or t

SEQ ID NO: 159461 - DNA, 156 bp, Homo sapiens; identical to SEQ ID NO: 159378
  misc_feature: GYAE6OF01BWU1F.29.26.C04.1.454.CMB.1.raw
  modified_base (154)..(156): a, c, t, g, unknown or other
  misc_feature (154)..(156): n is a, c, g, or t

SEQ ID NO: 159462 - DNA, 157 bp, Homo sapiens; identical to SEQ ID NO: 159395
  misc_feature: GYAE6OF01D8E7M.29.26.C04.1.454.CMB.1.raw
  modified_base (154)..(157): a, c, t, g, unknown or other
  misc_feature (154)..(157): n is a, c, g, or t

SEQ ID NO: 159463 - DNA, 153 bp, Homo sapiens; identical to SEQ ID NO: 159382
  misc_feature: GYAE6OF01DUKE5.29.26.C04.1.454.CMB.1.raw
  modified_base (153)..(153): a, c, t, g, unknown or other
  misc_feature (153)..(153): n is a, c, g, or t

SEQ ID NO: 159464 - DNA, 155 bp, Homo sapiens; identical to SEQ ID NO: 159419
  misc_feature: GYAE6OF01BKBUM.29.26.C04.1.454.CMB.1.raw
  modified_base (153)..(155): a, c, t, g, unknown or other
  misc_feature (153)..(155): n is a, c, g, or t

SEQ ID NO: 159465 - DNA, 154 bp, Homo sapiens; identical to SEQ ID NO: 159294
  misc_feature: GYAE6OF01ELJ79.29.26.C04.1.454.CMB.1.raw
  modified_base (154)..(154): a, c, t, g, unknown or other
  misc_feature (154)..(154): n is a, c, g, or t

SEQ ID NO: 159466 - DNA, 155 bp, Homo sapiens; identical to SEQ ID NO: 159295
  misc_feature: GYAE6OF01CC8RZ.29.26.C04.1.454.CMB.1.raw
  modified_base (154)..(155): a, c, t, g, unknown or other
  misc_feature (154)..(155): n is a, c, g, or t

SEQ ID NO: 159467 - DNA, 154 bp, Homo sapiens; identical to SEQ ID NO: 159315
  misc_feature: GYAE6OF01B9WFV.29.26.C04.1.454.CMB.1.raw
  modified_base (154)..(154): a, c, t, g, unknown or other
  misc_feature (154)..(154): n is a, c, g, or t

SEQ ID NO: 159468 - DNA, 156 bp, Homo sapiens; identical to SEQ ID NO: 159378
  misc_feature: GYAE6OF01CYSV9.29.26.C04.1.454.CMB.1.raw
  modified_base (154)..(156): a, c, t, g, unknown or other
  misc_feature (154)..(156): n is a, c, g, or t

SEQ ID NO: 159469 - DNA, 158 bp, Homo sapiens; identical to SEQ ID NO: 159442
  misc_feature: GYAE6OF01BV6Q8.29.26.C04.1.454.CMB.1.raw
  modified_base (154)..(158): a, c, t, g, unknown or other
  misc_feature (154)..(158): n is a, c, g, or t

SEQ ID NO: 159470 - DNA, 198 bp, Homo sapiens
  misc_feature: GYAE6OF01EJ5W9.29.26.C04.1.454.CMB.1.raw
  modified_base (147)..(147): a, c, t, g, unknown or other
  misc_feature (147)..(147): n is a, c, g, or t
  modified_base (153)..(161): a, c, t, g, unknown or other
  misc_feature (153)..(161): n is a, c, g, or t
  modified_base (164)..(198): a, c, t, g, unknown or other
  misc_feature (164)..(198): n is a, c, g, or t
tcagatagagtactcacgaccggtgctcgatttagtctagcgactttgggtttggggaaggtcagcgtcctaggtcagcccaaggccaacccactgtcactctgttcccgcctctctactgctacgtctgagcgggctggcaaggcncatagnnnnnnnnncgnnnnnnnnnnnnnnnnnnnnnnnnnnnnnnnnnnn

SEQ ID NO: 159471 - DNA, 158 bp, Homo sapiens
  misc_feature: GYAE6OF01BOCAV.29.26.C04.1.454.CMB.1.raw
  modified_base (153)..(158): a, c, t, g, unknown or other
  misc_feature (153)..(158): n is a, c, g, or t
tcagatagagtactcacgaccggtgctcgatttagtctagcgactttgggtttgggaaggtcagcgtcctaggtcagcccaaggccaaccccactgtcactctgttcccacctcctctactgctagtctgagcgggctggcaaggcgcatagnnnnnn

SEQ ID NO: 159472 - DNA, 159 bp, Homo sapiens; identical to SEQ ID NO: 159406
  misc_feature: GYAE6OF01AY393.29.26.C04.1.454.CMB.1.raw
  modified_base (154)..(159): a, c, t, g, unknown or other
  misc_feature (154)..(159): n is a, c, g, or t

SEQ ID NO: 159473 - DNA, 157 bp, Homo sapiens; identical to SEQ ID NO: 159395
  misc_feature: GYAE6OF01BNKQ2.29.26.C04.1.454.CMB.1.raw
  modified_base (154)..(157): a, c, t, g, unknown or other
  misc_feature (154)..(157): n is a, c, g, or t

SEQ ID NO: 159474 - DNA, 154 bp, Homo sapiens; identical to SEQ ID NO: 159294
  misc_feature: GYAE6OF01AWN35.29.26.C04.1.454.CMB.1.raw
  modified_base (154)..(154): a, c, t, g, unknown or other
  misc_feature (154)..(154): n is a, c, g, or t

SEQ ID NO: 159475 - DNA, 170 bp, Homo sapiens
  misc_feature: GYAE6OF01CCHWS.29.26.C04.1.454.CMB.1.raw
  modified_base (161)..(163): a, c, t, g, unknown or other
  misc_feature (161)..(163): n is a, c, g, or t
  modified_base (166)..(170): a, c, t, g, unknown or other
  misc_feature (166)..(170): n is a, c, g, or t
tcagatagagtactcacgaccggtgctcgatttagtctagcgactttgggtttgggtaagggtcagcgtcctaggtcacgcccgaaggccaacccgactgtcactctgttcccgccctccgtctactgctagtctgagtcgggctggcaaggcgcataggnnnagnnnnn

SEQ ID NO: 159476 - DNA, 158 bp, Homo sapiens; identical to SEQ ID NO: 159442
  misc_feature: GYAE6OF01AMGN4.29.26.C04.1.454.CMB.1.raw
  modified_base (154)..(158): a, c, t, g, unknown or other
  misc_feature (154)..(158): n is a, c, g, or t

SEQ ID NO: 159477 - DNA, 158 bp, Homo sapiens; identical to SEQ ID NO: 159442
  misc_feature: GYAE6OF01CHKS4.29.26.C04.1.454.CMB.1.raw
  modified_base (154)..(158): a, c, t, g, unknown or other
  misc_feature (154)..(158): n is a, c, g, or t

SEQ ID NO: 159478 - DNA, 158 bp, Homo sapiens; identical to SEQ ID NO: 159471
  misc_feature: GYAE6OF01B88H1.29.26.C04.1.454.CMB.1.raw
  modified_base (153)..(158): a, c, t, g, unknown or other
  misc_feature (153)..(158): n is a, c, g, or t

SEQ ID NO: 159479 - DNA, 161 bp, Homo sapiens
  misc_feature: GYAE6OF01AXDA4.29.26.C04.1.454.CMB.1.raw
  modified_base (154)..(161): a, c, t, g, unknown or other
  misc_feature (154)..(161): n is a, c, g, or t
tcagatagagtactcacgaccggtgctcgatttagtctagcgactttgggtttgggaaggtcagcgtcctaggtcagcccaaggccaaccccactgtcactctgttcccaccctcctctactgctagtctgagcgggctggcaaggcgcatagnnnnnnnn

SEQ ID NO: 159480 - DNA, 158 bp, Homo sapiens
  misc_feature: GYAE6OF01E1HLF.29.26.C04.1.454.CMB.1.raw
  modified_base (155)..(158): a, c, t, g, unknown or other
  misc_feature (155)..(158): n is a, c, g, or t
tcagatagagtactcacgaccggtgctcgatttagtctagcgactttgggtttgggaaggtcagcgtcctaggtcagcccaaggccaaccccactgtcactctgttcccaccctcctctactgctagtctgagcgggctgggcaaggcgcatagnnnn

SEQ ID NO: 159481 - DNA, 154 bp, Homo sapiens; identical to SEQ ID NO: 159294
  misc_feature: GYAE6OF01E3F7I.29.26.C04.1.454.CMB.1.raw
  modified_base (154)..(154): a, c, t, g, unknown or other
  misc_feature (154)..(154): n is a, c, g, or t

SEQ ID NO: 159482 - DNA, 158 bp, Homo sapiens; identical to SEQ ID NO: 159442
  misc_feature: GYAE6OF01BW35V.29.26.C04.1.454.CMB.1.raw
  modified_base (154)..(158): a, c, t, g, unknown or other
  misc_feature (154)..(158): n is a, c, g, or t

SEQ ID NO: 159483 - DNA, 180 bp, Homo sapiens
  misc_feature: GYAE6OF01CEQ8V.29.26.C04.1.454.CMB.1.raw
  modified_base (155)..(180): a, c, t, g, unknown or other
  misc_feature (155)..(180): n is a, c, g, or t
tcagatagagtactcacgaccggtgctcgatttagtctagcgactttgggtttgggaaggtcagcggtcctaggtcagcccaaggccaaccccactgtcactctgttcccgccctcctctatacgatcgctgagcgggctggcaaggcgcatagnnnnnnnnnnnnnnnnnnnnnnnnnn

SEQ ID NO: 159484 - DNA, 157 bp, Homo sapiens
  misc_feature: GYAE6OF01DVVMA.29.26.C04.1.454.CMB.1.raw
  modified_base (148)..(148): a, c, t, g, unknown or other
  misc_feature (148)..(148): n is a, c, g, or t
  modified_base (154)..(157): a, c, t, g, unknown or other
  misc_feature (154)..(157): n is a, c, g, or t
tcagatagagtactcacgaccggtgctcgatttagtctagcgactttgggtttgggaaggtcagcgtcctaggtcagcccaaggccaaccccactgtcactctgttccccacctcctctactgctagtctgagcgggctggcaaggcncatagnnnn

SEQ ID NO: 159485 - DNA, 154 bp, Homo sapiens; identical to SEQ ID NO: 159315
  misc_feature: GYAE6OF01APJEX.29.26.C04.1.454.CMB.1.raw
  modified_base (154)..(154): a, c, t, g, unknown or other
  misc_feature (154)..(154): n is a, c, g, or t

SEQ ID NO: 159486 - DNA, 158 bp, Homo sapiens
  misc_feature: GYAE6OF01CSY53.29.26.C04.1.454.CMB.1.raw
  modified_base (155)..(158): a, c, t, g, unknown or other
  misc_feature (155)..(158): n is a, c, g, or t
tcagatagagtactcacgaccggtgctcgatttagtctagcgactttgggtttgggaaggtcagcgtcctaggtcagcccaaggccaaccccactgtcactctgttccccaccctcctctactgctagtctgagcgggctggcaaggcgcatagnnnn

SEQ ID NO: 159487 - DNA, 155 bp, Homo sapiens; identical to SEQ ID NO: 159335
  misc_feature: GYAE6OF01BQQOE.29.26.C04.1.454.CMB.1.raw
  modified_base (154)..(155): a, c, t, g, unknown or other
  misc_feature (154)..(155): n is a, c, g, or t

SEQ ID NO: 159488 - DNA, 155 bp, Homo sapiens
  misc_feature: GYAE6OF01EL4U7.29.26.C04.1.454.CMB.1.raw
  modified_base (155)..(155): a, c, t, g, unknown or other
  misc_feature (155)..(155): n is a, c, g, or t
tcagatagagtactcacgaccggtgctcgatttagtctagcgactttgggtttgggaaggtcagcgtcctaggtcagcccaaggccaaccccactgtcactctgttccccaccctcctctactgctagtctgagcgggctggcaaggcgcatagn

SEQ ID NO: 159489 - DNA, 158 bp, Homo sapiens
  misc_feature: GYAE6OF01C7A6E.29.26.C04.1.454.CMB.1.raw
  modified_base (155)..(158): a, c, t, g, unknown or other
  misc_feature (155)..(158): n is a, c, g, or t
tcagatagagtactcacgaccggtgctcgatttagtctagcgactttgggtttgggaaggtcagcgtcctaggtcagcccaaggccaaccccactgtcactctgttcccaccctcctctactgctagtctgagcgggctggcaagggcgcatagnnnn

SEQ ID NO: 159490 - DNA, 155 bp, Homo sapiens; identical to SEQ ID NO: 159295
  misc_feature: GYAE6OF01BZ7EH.29.26.C04.1.454.CMB.1.raw
  modified_base (154)..(155): a, c, t, g, unknown or other
  misc_feature (154)..(155): n is a, c, g, or t

SEQ ID NO: 159491 - DNA, 156 bp, Homo sapiens; identical to SEQ ID NO: 159378
  misc_feature: GYAE6OF01EDNQN.29.26.C04.1.454.CMB.1.raw
  modified_base (154)..(156): a, c, t, g, unknown or other
  misc_feature (154)..(156): n is a, c, g, or t

SEQ ID NO: 159492 - DNA, 158 bp, Homo sapiens; identical to SEQ ID NO: 159442
  misc_feature: GYAE6OF01BJX40.29.26.C04.1.454.CMB.1.raw
  modified_base (154)..(158): a, c, t, g, unknown or other
  misc_feature (154)..(158): n is a, c, g, or t

SEQ ID NO: 159493 - DNA, 172 bp, Homo sapiens
  misc_feature: GYAE6OF01CCOVW.29.26.C04.1.454.CMB.1.raw
  modified_base (154)..(172): a, c, t, g, unknown or other
  misc_feature (154)..(172): n is a, c, g, or t
tcagatagagtactcacgaccggtgctcgatttagtctagcgactttgggtttgggaaggtcagcgtcctaggtcagcccaaggccaaccccactgtcactctgttcccaccctcctctactgctagtctgagcgggctggcaaggcgcatagnnnnnnnnnnnnnnnnnnn

SEQ ID NO: 159494 - DNA, 154 bp, Homo sapiens; identical to SEQ ID NO: 159315
  misc_feature: GYAE6OF01ALEGF.29.26.C04.1.454.CMB.1.raw
  modified_base (154)..(154): a, c, t, g, unknown or other
  misc_feature (154)..(154): n is a, c, g, or t

SEQ ID NO: 159495 - DNA, 180 bp, Homo sapiens
  misc_feature: GYAE6OF01ADUSL.29.26.C04.1.454.CMB.1.raw
  modified_base (156)..(180): a, c, t, g, unknown or other
  misc_feature (156)..(180): n is a, c, g, or t
tcagatagagtactcacgaccggtgctcgatttagtctagcgactttgggtttgggaagggtcagcgtcctaggtcagcccaaggccaacccccactgtcactctgttcccgcctcctctactgctagtctgagcgggctggcaaggcgcagtagnnnnnnnnnnnnnnnnnnnnnnnnn

SEQ ID NO: 159496 - DNA, 167 bp, Homo sapiens
  misc_feature: GYAE6OF01B809N.29.26.C04.1.454.CMB.1.raw
  modified_base (154)..(167): a, c, t, g, unknown or other
  misc_feature (154)..(167): n is a, c, g, or t
tcagatagagtactcacgaccggtgctcgatttagtctagcgactttgggtttgggaagggtcagcgtcctaggtcagcccaaggccaaccccactgtcactctgttcccacctcctctactgctagtctgagcgggctggcaaggcgcatagnnnnnnnnnnnnnn

SEQ ID NO: 159497 - DNA, 153 bp, Homo sapiens
  misc_feature: GYAE6OF01C5L9G.29.26.C04.1.454.CMB.1.raw
tcagatagagtactcacgaccggtgctcgatttagtctagcgactttgggtttgggaaggtcagcgtcctaggtcagcccaaggccaaccccactgtcactctgttcccgccctcctctactgctagtctgagcgggctggcaaggcgcatag

SEQ ID NO: 159498 - DNA, 155 bp, Homo sapiens; identical to SEQ ID NO: 159295
  misc_feature: GYAE6OF01BNAPN.29.26.C04.1.454.CMB.1.raw
  modified_base (154)..(155): a, c, t, g, unknown or other
  misc_feature (154)..(155): n is a, c, g, or t

SEQ ID NO: 159499 - DNA, 161 bp, Homo sapiens; identical to SEQ ID NO: 159479
  misc_feature: GYAE6OF01BIT9O.29.26.C04.1.454.CMB.1.raw
  modified_base (154)..(161): a, c, t, g, unknown or other
  misc_feature (154)..(161): n is a, c, g, or t

SEQ ID NO: 159500 - DNA, 156 bp, Homo sapiens; identical to SEQ ID NO: 159378
  misc_feature: GYAE6OF01A5X06.29.26.C04.1.454.CMB.1.raw
  modified_base (154)..(156): a, c, t, g, unknown or other
  misc_feature (154)..(156): n is a, c, g, or t

SEQ ID NO: 159501 - DNA, 158 bp, Homo sapiens
  misc_feature: GYAE6OF01A5WQN.29.26.C04.1.454.CMB.1.raw
  modified_base (148)..(148): a, c, t, g, unknown or other
  misc_feature (148)..(148): n is a, c, g, or t
  modified_base (154)..(158): a, c, t, g, unknown or other
  misc_feature (154)..(158): n is a, c, g, or t
tcagatagagtactcacgaccggtgctcgatttagtctagcgactttgggtttgggaaggtcagcgtcctaggtcagcccaaggccaaccccactgtcactctgttcccaccctcctctactgctagtctgagcgggctggcaaggcncatagnnnnn

SEQ ID NO: 159502 - DNA, 156 bp, Homo sapiens; identical to SEQ ID NO: 159431
  misc_feature: GYAE6OF01D27LJ.29.26.C04.1.454.CMB.1.raw
  modified_base (153)..(156): a, c, t, g, unknown or other
  misc_feature (153)..(156): n is a, c, g, or t

SEQ ID NO: 159503 - DNA, 155 bp, Homo sapiens; identical to SEQ ID NO: 159295
  misc_feature: GYAE6OF01C3NYS.29.26.C04.1.454.CMB.1.raw
  modified_base (154)..(155): a, c, t, g, unknown or other
  misc_feature (154)..(155): n is a, c, g, or t

SEQ ID NO: 159504 - DNA, 155 bp, Homo sapiens; identical to SEQ ID NO: 159295
  misc_feature: GYAE6OF01CRP2Z.29.26.C04.1.454.CMB.1.raw
  modified_base (154)..(155): a, c, t, g, unknown or other
  misc_feature (154)..(155): n is a, c, g, or t

SEQ ID NO: 159505 - DNA, 155 bp, Homo sapiens; identical to SEQ ID NO: 159439
  misc_feature: GYAE6OF01CQTLF.29.26.C04.1.454.CMB.1.raw
  modified_base (154)..(155): a, c, t, g, unknown or other
  misc_feature (154)..(155): n is a, c, g, or t

SEQ ID NO: 159506 - DNA, 158 bp, Homo sapiens
  misc_feature: GYAE6OF01C3V21.29.26.C04.1.454.CMB.1.raw
  modified_base (148)..(148): a, c, t, g, unknown or other
  misc_feature (148)..(148): n is a, c, g, or t
  modified_base (154)..(158): a, c, t, g, unknown or other
  misc_feature (154)..(158): n is a, c, g, or t
tcagatagagtactcacgaccggtgctcgatttagtctagcgactttgggtttgggaaggtcagcgtcctaggtcagcccaaggccaaccccactgtcactctgttccccacctcctctactgctagtctgagcgggctggcaaggcncatagnnnnn

SEQ ID NO: 159507 - DNA, 156 bp, Homo sapiens; identical to SEQ ID NO: 159378
  misc_feature: GYAE6OF01BVHF5.29.26.C04.1.454.CMB.1.raw
  modified_base (154)..(156): a, c, t, g, unknown or other
  misc_feature (154)..(156): n is a, c, g, or t

SEQ ID NO: 159508 - DNA, 165 bp, Homo sapiens
  misc_feature: GYAE6OF01EWB83.29.26.C04.1.454.CMB.1.raw
  modified_base (153)..(165): a, c, t, g, unknown or other
  misc_feature (153)..(165): n is a, c, g, or t
tcagatagagtactcacgaccggtgctcgatttagtctagcgactttgggtttgggaaggtcagcgtcctaggtcagcccaaggccaaccccactgtcactctgttcccgcctcctctactgctagtctgagcgggctggcaaggcgcatagnnnnnnnnnnnnn

SEQ ID NO: 159509 - DNA, 153 bp, Homo sapiens; identical to SEQ ID NO: 159382
  misc_feature: GYAE6OF01BLFC4.29.26.C04.1.454.CMB.1.raw
  modified_base (153)..(153): a, c, t, g, unknown or other
  misc_feature (153)..(153): n is a, c, g, or t

SEQ ID NO: 159510 - DNA, 221 bp, Homo sapiens
  misc_feature: GYAE6OF01DZ05J.29.26.C04.1.454.CMB.1.raw
  modified_base (153)..(221): a, c, t, g, unknown or other
  misc_feature (153)..(221): n is a, c, g, or t
tcagatagagtactcacgaccggtgctcgatttagtctagcgacttttgggtttgggaaggtcagcgtcctaggtcagcccaaggccaaccccatgtcactctgttcccacctcctctactgctagtctgagcgggctggcaaggcgcagtgnnnnnnnnnnnnnnnnnnnnnnnnnnnnnnnnnnnnnnnnnnnnnnnnnnnnnnnnnnnnnnnnnnnnn

SEQ ID NO: 159511 - DNA, 154 bp, Homo sapiens
  misc_feature: GYAE6OF01CHCQK.29.26.C04.1.454.CMB.1.raw
  modified_base (146)..(146): a, c, t, g, unknown or other
  misc_feature (146)..(146): n is a, c, g, or t
  modified_base (152)..(154): a, c, t, g, unknown or other
  misc_feature (152)..(154): n is a, c, g, or t
tcagatagagtactcacgaccggtgctcgatttagtctagcgactttgggtttgggaaggtcagcgtcctaggtcagcccaaggccaaccccactgtcactctgttcccaccctcctctactgctagtctgagcggctggcaggcncatagnnn

SEQ ID NO: 159512 - DNA, 154 bp, Homo sapiens; identical to SEQ ID NO: 159294
  misc_feature: GYAE6OF01AN4B8.29.26.C04.1.454.CMB.1.raw
  modified_base (154)..(154): a, c, t, g, unknown or other
  misc_feature (154)..(154): n is a, c, g, or t

SEQ ID NO: 159513 - DNA, 167 bp, Homo sapiens
  misc_feature: GYAE6OF01C8M93.29.26.C04.1.454.CMB.1.raw
  modified_base (157)..(167): a, c, t, g, unknown or other
  misc_feature (157)..(167): n is a, c, g, or t
tcagatagagtactcacgaccggtgctcgatttagtctagcgactttgggtttgggaaggtcagcgtcctaggtcagcccaaggccaaccccatgtcactctcgttccccaccctcctctactgcctagtctgagcgggctggcaagggcgcatagnnnnnnnnnnn

SEQ ID NO: 159514 - DNA, 168 bp, Homo sapiens
  misc_feature: GYAE6OF01DJ75P.29.26.C04.1.454.CMB.1.raw
  modified_base (154)..(168): a, c, t, g, unknown or other
  misc_feature (154)..(168): n is a, c, g, or t
tcagatagagtactcacgaccggtgctcgatttagtctagcgactttgggtttgggaaggtcagcgtcctaggtcagcccaaggccaaccccatgtcactctgttccccaccctcctctactgctagtctgagcgggctggcaaggcgcatagnnnnnnnnnnnnnnn

SEQ ID NO: 159515 - DNA, 158 bp, Homo sapiens; identical to SEQ ID NO: 159442
  misc_feature: GYAE6OF01B43RV.29.26.C04.1.454.CMB.1.raw
  modified_base (154)..(158): a, c, t, g, unknown or other
  misc_feature (154)..(158): n is a, c, g, or t

SEQ ID NO: 159516 - DNA, 160 bp, Homo sapiens
  misc_feature: GYAE6OF01DUWYV.29.26.C04.1.454.CMB.1.raw
  modified_base (149)..(149): a, c, t, g, unknown or other
  misc_feature (149)..(149): n is a, c, g, or t
  modified_base (155)..(160): a, c, t, g, unknown or other
  misc_feature (155)..(160): n is a, c, g, or t
tcagatagagtactcacgaccggtgctcgatttagtctagcgactttgggtttgggaaggtcagcgtcctaggtcagcccaaggccaaccccactgtcactctgttccccgccctcctctactgctagtctgagcgggctggcaaggcncatagnnnnnn

SEQ ID NO: 159517 - DNA, 154 bp, Homo sapiens
  misc_feature: GYAE6OF01BTFLJ.29.26.C04.1.454.CMB.1.raw
  modified_base (151)..(154): a, c, t, g, unknown or other
  misc_feature (151)..(154): n is a, c, g, or t
tcagatagagtactcacgaccggtgctcgatttagtctagcgactttgggtttgggaaggtcagcgtcctaggtcagcccaaggccaaccccatgtcactctgttcccacctcctctactgctagtctgagcgggctggcaaggcgcatgnnnn

SEQ ID NO: 159518 - DNA, 157 bp, Homo sapiens
  misc_feature: GYAE6OF01ETTVS.29.26.C04.1.454.CMB.1.raw
  modified_base (152)..(157): a, c, t, g, unknown or other
  misc_feature (152)..(157): n is a, c, g, or t
tcagatagagtactcacgaccggtgctcgatttagtctagcgactttgggtttgggaaggtcagcgtcctaggtcagcccaaggccaaccccactgtcactctgttcccacctcctcgtgtctgatctgagcgggctggcaaggcgcatagnnnnnn

SEQ ID NO: 159519 - DNA, 181 bp, Homo sapiens
  misc_feature: GYAE6OF01C9Q49.29.26.C04.1.454.CMB.1.raw
  modified_base (138)..(138): a, c, t, g, unknown or other
  misc_feature (138)..(138): n is a, c, g, or t
  modified_base (149)..(149): a, c, t, g, unknown or other
  misc_feature (149)..(149): n is a, c, g, or t
  modified_base (156)..(181): a, c, t, g, unknown or other
  misc_feature (156)..(181): n is a, c, g, or t
tcagatagagtactcacgaccggtgctcgatttagtctagcgactttgggtttgggaaggtcagcgtcctaggtcagcccaaggccaaccccatgtcactctgttcccacctcctactactgctagtctgagcgggtntggcaaggcanattaggnnnnnnnnnnnnnnnnnnnnnnnnnn

SEQ ID NO: 159520 - DNA, 162 bp, Homo sapiens
  misc_feature: GYAE6OF01BYTQJ.29.26.C04.1.454.CMB.1.raw
  modified_base (154)..(162): a, c, t, g, unknown or other
  misc_feature (154)..(162): n is a, c, g, or t
tcagatagagtactcacgaccggtgctcgatttagtctagcgactttgggtttgggaaggtcagcgtcctaggtcagcccaaggccaaccccactgtcactctgttcccaccctcctctactgctagtctgagcgggctggcaaggcgcatagnnnnnnnnn

SEQ ID NO: 159521 - DNA, 174 bp, Homo sapiens
  misc_feature: GYAE6OF01AFO5T.29.26.C04.1.454.CMB.1.raw
  modified_base (148)..(148): a, c, t, g, unknown or other
  misc_feature (148)..(148): n is a, c, g, or t
  modified_base (154)..(174): a, c, t, g, unknown or other
  misc_feature (154)..(174): n is a, c, g, or t
tcagatagagtactcacgaccggtgctcgatttagtctagcgactttgggtttgggaaggtcagcgtcctaggtcagcccaaggccaaccccactgtcactctgttcccaccctcctctactgctagtctgagcgggctggcaaggcncatagnnnnnnnnnnnnnnnnnnnnn

SEQ ID NO: 159522 - DNA, 156 bp, Homo sapiens
  misc_feature: GYAE6OF01DHZUQ.29.26.C04.1.454.CMB.1.raw
  modified_base (147)..(147): a, c, t, g, unknown or other
  misc_feature (147)..(147): n is a, c, g, or t
  modified_base (152)..(156): a, c, t, g, unknown or other
  misc_feature (152)..(156): n is a, c, g, or t
tcagatagagtactcacgaccggtgctcgatttagtctagcgactttgggttgggaaggtcagcgtcctaggtcagcccaaggccaacccactgtcactctcgttcccaccctcctctactgctagtctgagcgggctggcaaggcnatagnnnnn

SEQ ID NO: 159523 - DNA, 163 bp, Homo sapiens; identical to SEQ ID NO: 159407
  misc_feature: GYAE6OF01AXL87.29.26.C04.1.454.CMB.1.raw
  modified_base (154)..(163): a, c, t, g, unknown or other
  misc_feature (154)..(163): n is a, c, g, or t

SEQ ID NO: 159524 - DNA, 176 bp, Homo sapiens
  misc_feature: GYAE6OF01EHX40.29.26.C04.1.454.CMB.1.raw
  modified_base (152)..(176): a, c, t, g, unknown or other
  misc_feature (152)..(176): n is a, c, g, or t
tcagatagagtactcacgaccggtgctcgatttagtctagcgactttgggtttgggaaggtcagcgtcctaggtcagcccaaggccaaccccatgtcactctgttcccacctcctctactgctagtctgagcgggctggcaaggcgcatagnnnnnnnnnnnnnnnnnnnnnnnnn

SEQ ID NO: 159525 - DNA, 157 bp, Homo sapiens
  misc_feature: GYAE6OF01AOQGS.29.26.C04.1.454.CMB.1.raw
  modified_base (154)..(157): a, c, t, g, unknown or other
  misc_feature (154)..(157): n is a, c, g, or t
tcagatagagtactcacgaccggtgctcgatttagtctagcgactttgggtttgggaaggtcagcgtcctaggtcagcccaaggccaaccccactgtcactctgttcccgccctcctctatacgatcgctgagcgggctggcaaggcgcatagnnnn

SEQ ID NO: 159526 - DNA, 155 bp, Homo sapiens
  misc_feature: GYAE6OF01B5F52.29.26.C04.1.454.CMB.1.raw
  modified_base (148)..(148): a, c, t, g, unknown or other
  misc_feature (148)..(148): n is a, c, g, or t
  modified_base (154)..(155): a, c, t, g, unknown or other
  misc_feature (154)..(155): n is a, c, g, or t
tcagatagagtactcacgaccggtgctcgatttagtctagcgactttgggtttgggaaggtcagcgtcctaggtcagcccaaggccaaccccactgtcactctgttcccaccctcctctactgctagtctgagcgggctggcaaggcncatagnn

SEQ ID NO: 159527 - DNA, 156 bp, Homo sapiens
  misc_feature: GYAE6OF01AWQMA.29.26.C04.1.454.CMB.1.raw
  modified_base (148)..(148): a, c, t, g, unknown or other
  misc_feature (148)..(148): n is a, c, g, or t
  modified_base (154)..(156): a, c, t, g, unknown or other
  misc_feature (154)..(156): n is a, c, g, or t
tcagatagagtactcacgaccggtgctcgatttagtctagcgactttgggtttgggaaggtcagcgtcctaggtcagcccaaggccaaccccactgtcactctgttcccaccctcctctactgctagtctgagcgggctggcaaggcncatagnnn

SEQ ID NO: 159528 - DNA, 157 bp, Homo sapiens; identical to SEQ ID NO: 159395
  misc_feature: GYAE6OF01EVKEH.29.26.C04.1.454.CMB.1.raw
  modified_base (154)..(157): a, c, t, g, unknown or other
  misc_feature (154)..(157): n is a, c, g, or t

SEQ ID NO: 159529 - DNA, 159 bp, Homo sapiens; identical to SEQ ID NO: 159406
  misc_feature: GYAE6OF01EJ2U1.29.26.C04.1.454.CMB.1.raw
  modified_base (154)..(159): a, c, t, g, unknown or other
  misc_feature (154)..(159): n is a, c, g, or t

SEQ ID NO: 159530 - DNA, 186 bp, Homo sapiens
  misc_feature: GYAE6OF01D4STD.29.26.C04.1.454.CMB.1.raw
  modified_base (156)..(186): a, c, t, g, unknown or other
  misc_feature (156)..(186): n is a, c, g, or t
tcagatagagtactcacgaccggtgctcgatttagtctagcgactttggggtttgggaaggtcgagcgtcctaggtcagcccaagggccaaccccactgtcactctgttcccaccctcctctgccgagcatctgagcggctggcaaggcgcatagnnnnnnnnnnnnnnnnnnnnnnnnnnnnnnn

SEQ ID NO: 159531 - DNA, 160 bp, Homo sapiens
  misc_feature: GYAE6OF01BKIOG.29.26.C04.1.454.CMB.1.raw
  modified_base (154)..(160): a, c, t, g, unknown or other
  misc_feature (154)..(160): n is a, c, g, or t
tcagatagagtactcacgaccggtgctcgatttagtctagcgactttgggtttgggaaggtcagcgtcctaggtcagcccaaggccaaccccactgtcactctgttcccaccctcctctactgctagtctgagcgggctggcaaggcgcatagnnnnnnn

SEQ ID NO: 159532 - DNA, 179 bp, Homo sapiens
  misc_feature: GYAE6OF01DG0OQ.29.26.C04.1.454.CMB.1.raw
  modified_base (98)..(98): a, c, t, g, unknown or other
  misc_feature (98)..(98): n is a, c, g, or t
  modified_base (154)..(179): a, c, t, g, unknown or other
  misc_feature (154)..(179): n is a, c, g, or t
tcagatagagtactcacgaccggtgctcgatttagtctagcgactttgggtttgggaaggtcagcgtcctaggtcagcccaaggccaaccccactttnactctgttcccgccctcctccgtgtctgatctgagcgggctggcaaggcgcatagnnnnnnnnnnnnnnnnnnnnnnnnnn

SEQ ID NO: 159533 - DNA, 181 bp, Homo sapiens
  misc_feature: GYAE6OF01C959M.29.26.C04.1.454.CMB.1.raw
  modified_base (156)..(181): a, c, t, g, unknown or other
  misc_feature (156)..(181): n is a, c, g, or t
tcagatagagtactcacgaccggtgctcgatttagtctagcgactttgggttgggaaggtcagcgtcctaggtcagcccaaggccaaccccactgtcacctctcgttccccaccctcctctactgcctagtcctgagcggctggcaaggcgcatgnnnnnnnnnnnnnnnnnnnnnnnnnn

SEQ ID NO: 159534 - DNA, 149 bp, Homo sapiens
  misc_feature: GYAE6OF02HM7KI.29.26.C04.1.454.CMB.1.raw
  modified_base (149)..(149): a, c, t, g, unknown or other
  misc_feature (149)..(149): n is a, c, g, or t
tcagatagagtactcacgaccggtgctcgatttagtctagcgacttgggttggaaggtcagcgtcctaggtcagcccaaggccaacccactgtcactctgttcccacctcctctactgctagtctgagcgggctggcaaggcgcatagn

SEQ ID NO: 159535 - DNA, 223 bp, Homo sapiens
  misc_feature: GYAE6OF02F44XV.29.26.C04.1.454.CMB.1.raw
  modified_base (149)..(223): a, c, t, g, unknown or other
  misc_feature (149)..(223): n is a, c, g, or t
tcagatagagtactcacgaccggtgctcgatttagtctagcgactttgggttggaaggtcagcgtcctaggtcagcccaaggccaacccactgtcactctgttcccgcctcctctactgctagtctgagcggctggcaaggcgcatagnnnnnnnnnnnnnnnnnnnnnnnnnnnnnnnnnnnnnnnnnnnnnnnnnnnnnnnnnnnnnnnnnnnnnnnnnnn

SEQ ID NO: 159536 - DNA, 155 bp, Homo sapiens
  misc_feature: GYAE6OF02H7DTQ.29.26.C04.1.454.CMB.1.raw
  modified_base (153)..(155): a, c, t, g, unknown or other
  misc_feature (153)..(155): n is a, c, g, or t
tcagatagagtactcacgaccggtgctcgatttagtctagcgactttgggtttgggaaggtcagcgtcctaggtcagcccaaggccaacccactgtcactctgttcccaccctcctctgtcgagcgtctgagcgggctggcaaggcgcatagnnn

SEQ ID NO: 159537 - DNA, 192 bp, Homo sapiens
  misc_feature: GYAE6OF02GPH9Q.29.26.C04.1.454.CMB.1.raw
  modified_base (148)..(192): a, c, t, g, unknown or other
  misc_feature (148)..(192): n is a, c, g, or t
tcagatagagtactcacgaccggtgctcgatttagtctagcgacttggttggaaggtcagcgtcctaggtcagcccaaggccaacccactgtcactctgttcccgcctcctctaatacgatcgctgagcggctggcaaggcgcatagnnnnnnnnnnnnnnnnnnnnnnnnnnnnnnnnnnnnnnnnnnnnn

SEQ ID NO: 159538 - DNA, 150 bp, Homo sapiens
  misc_feature: GYAE6OF02JDDDK.29.26.C04.1.454.CMB.1.raw
  modified_base (150)..(150): a, c, t, g, unknown or other
  misc_feature (150)..(150): n is a, c, g, or t
tcagatagagtactcacgaccggtgctcgatttagtctagcgactttgggttggaaggtcagcgtcctaggtcagcccaaggccaacccactgtcactctgttcccacctcctctactgctagtctgagcgggctggcaaggcgcatagn

SEQ ID NO: 159539 - DNA, 154 bp, Homo sapiens
  misc_feature: GYAE6OF02HDB61.29.26.C04.1.454.CMB.1.raw
  modified_base (153)..(154): a, c, t, g, unknown or other
  misc_feature (153)..(154): n is a, c, g, or t
tcagatagagtactcacgaccggtgctcgatttagtctagcgactttgggtttgggaaggtcagcgtcctaggtcagcccaaggccaacccactgtcactctgttcccaccctcctctgtcgagcgtctgagcgggctggcaaggcgcatagnn

SEQ ID NO: 159540 - DNA, 152 bp, Homo sapiens
  misc_feature: GYAE6OF02JEEE1.29.26.C04.1.454.CMB.1.raw
  modified_base (152)..(152): a, c, t, g, unknown or other
  misc_feature (152)..(152): n is a, c, g, or t
tcagatagagtactcacgaccggtgctcgatttagtctagcgactttgggtttgggaaggtcagcgtcctaggtcagcccaaggccaacccactgtcactctgttcccacctcctctatacgatcgctgagcgggctggcaaggcgcatagn

SEQ ID NO: 159541 - DNA, 164 bp, Homo sapiens
  misc_feature: GYAE6OF02IDIDT.29.26.C04.1.454.CMB.1.raw
  modified_base (149)..(164): a, c, t, g, unknown or other
  misc_feature (149)..(164): n is a, c, g, or t
tcagatagagtactcacgaccggtgctcgatttagtctagcgacttgggttgggaaggtcagcgtcctaggtcagcccaaggccaacccactgtccactctgttcccacctcctctactgctatctgagcggctggcaaggcgcatagnnnnnnnnnnnnnnnn

SEQ ID NO: 159542 - DNA, 153 bp, Homo sapiens; identical to SEQ ID NO: 159291
  misc_feature: GYAE6OF02I77AF.29.26.C04.1.454.CMB.1.raw
  modified_base (152)..(153): a, c, t, g, unknown or other
  misc_feature (152)..(153): n is a, c, g, or t

SEQ ID NO: 159543 - DNA, 153 bp, Homo sapiens; identical to SEQ ID NO: 159296
  misc_feature: GYAE6OF02G504H.29.26.C04.1.454.CMB.1.raw
  modified_base (153)..(153): a, c, t, g, unknown or other
  misc_feature (153)..(153): n is a, c, g, or t

SEQ ID NO: 159544 - DNA, 157 bp, Homo sapiens
  misc_feature: GYAE6OF02F88X4.29.26.C04.1.454.CMB.1.raw
  modified_base (154)..(157): a, c, t, g, unknown or other
  misc_feature (154)..(157): n is a, c, g, or t
tcagatagagtactcacgaccggtgctcgatttagtctagcgactttgggtttgggaaggtcagcgtcctaggtcagcccaaggccaaccccactgtcactctgttcccgccctcctctactgctagtctgagcgggctggcaaggcgcatagnnnn

SEQ ID NO: 159545 - DNA, 195 bp, Homo sapiens
  misc_feature: GYAE6OF02IN8N7.29.26.C04.1.454.CMB.1.raw
  modified_base (144)..(144): a, c, t, g, unknown or other
  misc_feature (144)..(144): n is a, c, g, or t
  modified_base (166)..(166): a, c, t, g, unknown or other
  misc_feature (166)..(166): n is a, c, g, or t
  modified_base (168)..(195): a, c, t, g, unknown or other
  misc_feature (168)..(195): n is a, c, g, or t
tcagatagagtactcacgaccggtgctcgatttagtctagcgactttgggtttgggtaagggtcagcgtcctaggtcagcccaaggccaacccccactggtccactctacgttcccaccctcctctacttgccttagtcctgancgggctggcaaggcgcatacgnannnnnnnnnnnnnnnnnnnnnnnnnnnn

SEQ ID NO: 159546 - DNA, 152 bp, Homo sapiens; identical to SEQ ID NO: 159302
  misc_feature: GYAE6OF02IQDBI.29.26.C04.1.454.CMB.1.raw
  modified_base (152)..(152): a, c, t, g, unknown or other
  misc_feature (152)..(152): n is a, c, g, or t

SEQ ID NO: 159547 - DNA, 158 bp, Homo sapiens
  misc_feature: GYAE6OF02G24M0.29.26.C04.1.454.CMB.1.raw
  modified_base (152)..(158): a, c, t, g, unknown or other
  misc_feature (152)..(158): n is a, c, g, or t
tcagatagagtactcacgaccggtgctcgatttagtctagcgactttgggtttgggaaggtcagcgtcctaggtcagcccaaggccaacccactgtcactctgttcccacctcctctactgctagtctgagcgggctggcaaggcgcatagnnnnnnn

SEQ ID NO: 159548 - DNA, 154 bp, Homo sapiens; identical to SEQ ID NO: 159315
  misc_feature: GYAE6OF02HUNM0.29.26.C04.1.454.CMB.1.raw
  modified_base (154)..(154): a, c, t, g, unknown or other
  misc_feature (154)..(154): n is a, c, g, or t

SEQ ID NO: 159549 - DNA, 155 bp, Homo sapiens
  misc_feature: GYAE6OF02FF3MN.29.26.C04.1.454.CMB.1.raw
  modified_base (154)..(155): a, c, t, g, unknown or other
  misc_feature (154)..(155): n is a, c, g, or t
tcagatagagtactcacgaccggtgctcgatttagtctagcgactttgggtttgggaaggtcagcgtcctaggtcagcccaaggccaaccccactgtcactctgttcccaccctcctctgtcgagcgtctgagcgggctggcaaggcgcatagnn

SEQ ID NO: 159550 - DNA, 158 bp, Homo sapiens
  misc_feature: GYAE6OF02HNFNB.29.26.C04.1.454.CMB.1.raw
  modified_base (156)..(158): a, c, t, g, unknown or other
  misc_feature (156)..(158): n is a, c, g, or t
tcagatagagtactcacgaccggtgctcgatttagtctagcgactttgggtttgggaagggtcagcgtcctaggtcagcccaaggccaaccccactgtcactctgttcccaccctcctctatgtatactctgagcgggctgggcaaggcgcatagnnn

SEQ ID NO: 159551 - DNA, 154 bp, Homo sapiens; identical to SEQ ID NO: 159318
  misc_feature: GYAE6OF02GESN3.29.26.C04.1.454.CMB.1.raw
  modified_base (153)..(154): a, c, t, g, unknown or other
  misc_feature (153)..(154): n is a, c, g, or t

SEQ ID NO: 159552 - DNA, 155 bp, Homo sapiens; identical to SEQ ID NO: 159295
  misc_feature: GYAE6OF02F81RV.29.26.C04.1.454.CMB.1.raw
  modified_base (154)..(155): a, c, t, g, unknown or other
  misc_feature (154)..(155): n is a, c, g, or t

SEQ ID NO: 159553 - DNA, 153 bp, Homo sapiens; identical to SEQ ID NO: 159287
  misc_feature: GYAE6OF02HVTEE.29.26.C04.1.454.CMB.1.raw
  modified_base (153)..(153): a, c, t, g, unknown or other
  misc_feature (153)..(153): n is a, c, g, or t

SEQ ID NO: 159554 - DNA, 208 bp, Homo sapiens
  misc_feature: GYAE6OF02JTD2G.29.26.C04.1.454.CMB.1.raw
  modified_base (141)..(141): a, c, t, g, unknown or other
  misc_feature (141)..(141): n is a, c, g, or t
  modified_base (147)..(208): a, c, t, g, unknown or other
  misc_feature (147)..(208): n is a, c, g, or t
tcagatagagtactcacgaccggtgctcgatttagtctagcgactttggttggaagtcagcgtcctaggtcagcccaaggccaacccactgtcactctgttcccacctcctctactgctagtctgagcggctggcaaggcncatagnnnnnnnnnnnnnnnnnnnnnnnnnnnnnnnnnnnnnnnnnnnnnnnnnnnnnnnnnnnnnn

SEQ ID NO: 159555 - DNA, 153 bp, Homo sapiens
  misc_feature: GYAE6OF02IPMOM.29.26.C04.1.454.CMB.1.raw
tcagatagagtactcacgaccggtgctcgatttagtctagcgactttgggtttgggaaggtcggcgtcctaggtcagcccaaggccaaccccactgtcactctgttcccaccctcctctactgctagtctgagcgggctggcaaggcgcatag

SEQ ID NO: 159556 - DNA, 155 bp, Homo sapiens; identical to SEQ ID NO: 159295
  misc_feature: GYAE6OF02F6WB4.29.26.C04.1.454.CMB.1.raw
  modified_base (154)..(155): a, c, t, g, unknown or other
  misc_feature (154)..(155): n is a, c, g, or t

SEQ ID NO: 159557 - DNA, 160 bp, Homo sapiens
  misc_feature: GYAE6OF02GG7EA.29.26.C04.1.454.CMB.1.raw
  modified_base (154)..(160): a, c, t, g, unknown or other
  misc_feature (154)..(160): n is a, c, g, or t
tcagatagagtactcacgaccggtgctcgatttagtctagcgactttgggtttgggaaggtcagcgtcctaggtcagcccaaggccaaccccactgtcactctgttcccaccctcctctgtcgagcgtctgagcgggctggcaaggcgcatagnnnnnnn

SEQ ID NO: 159558 - DNA, 159 bp, Homo sapiens; identical to SEQ ID NO: 159406
  misc_feature: GYAE6OF02GC3BV.29.26.C04.1.454.CMB.1.raw
  modified_base (154)..(159): a, c, t, g, unknown or other
  misc_feature (154)..(159): n is a, c, g, or t

SEQ ID NO: 159559 - DNA, 154 bp, Homo sapiens; identical to SEQ ID NO: 159294
  misc_feature: GYAE6OF02FM1B8.29.26.C04.1.454.CMB.1.raw
  modified_base (154)..(154): a, c, t, g, unknown or other
  misc_feature (154)..(154): n is a, c, g, or t

SEQ ID NO: 159560 - DNA, 153 bp, Homo sapiens
  misc_feature: GYAE6OF02I20X7.29.26.C04.1.454.CMB.1.raw
  modified_base (153)..(153): a, c, t, g, unknown or other
  misc_feature (153)..(153): n is a, c, g, or t
tcagatagagtactcacgaccggtgctcgatttagtctagcgactttgggtttgggaaggtcagcgtcctaggtcagcccaaggccaacccactgtcactctgttcccgccctcctctatacgatcgctgagcgggctggcaaggcgcatagn

SEQ ID NO: 159561 - DNA, 155 bp, Homo sapiens; identical to SEQ ID NO: 159295
  misc_feature: GYAE6OF02FM1AK.29.26.C04.1.454.CMB.1.raw
  modified_base (154)..(155): a, c, t, g, unknown or other
  misc_feature (154)..(155): n is a, c, g, or t

SEQ ID NO: 159562 - DNA, 152 bp, Homo sapiens
  misc_feature: GYAE6OF02H91AV.29.26.C04.1.454.CMB.1.raw
  modified_base (152)..(152): a, c, t, g, unknown or other
  misc_feature (152)..(152): n is a, c, g, or t
tcagatagagtactcacgaccggtgctcgatttagtctagcgactttgggtttgggaaggtcagcgtcctaggtcagcccaaggccaacccactgtcactctgttcccgcctcctctactgctagtctgagcgggctggcaaggcgcatagn

SEQ ID NO: 159563 - DNA, 154 bp, Homo sapiens; identical to SEQ ID NO: 159318
  misc_feature: GYAE6OF02ISMEI.29.26.C04.1.454.CMB.1.raw
  modified_base (153)..(154): a, c, t, g, unknown or other
  misc_feature (153)..(154): n is a, c, g, or t

SEQ ID NO: 159564 - DNA, 157 bp, Homo sapiens; identical to SEQ ID NO: 159395
  misc_feature: GYAE6OF02JFZ87.29.26.C04.1.454.CMB.1.raw
  modified_base (154)..(157): a, c, t, g, unknown or other
  misc_feature (154)..(157): n is a, c, g, or t

SEQ ID NO: 159565 - DNA, 149 bp, Homo sapiens
  misc_feature: GYAE6OF02F3Y26.29.26.C04.1.454.CMB.1.raw
  modified_base (149)..(149): a, c, t, g, unknown or other
  misc_feature (149)..(149): n is a, c, g, or t
tcagatagagtactcacgaccggtgctcgatttagtctagcgactttggttggaaggtcagcgtcctaggtcagcccaaggccaacccactgtcactctgttcccacctcctctactgctagtctgagcgggctggcaaggcgcatagn

SEQ ID NO: 159566 - DNA, 154 bp, Homo sapiens; identical to SEQ ID NO: 159294
  misc_feature: GYAE6OF02G50D2.29.26.C04.1.454.CMB.1.raw
  modified_base (154)..(154): a, c, t, g, unknown or other
  misc_feature (154)..(154): n is a, c, g, or t

SEQ ID NO: 159567 - DNA, 155 bp, Homo sapiens; identical to SEQ ID NO: 159295
  misc_feature: GYAE6OF02GIL2Y.29.26.C04.1.454.CMB.1.raw
  modified_base (154)..(155): a, c, t, g, unknown or other
  misc_feature (154)..(155): n is a, c, g, or t

SEQ ID NO: 159568 - DNA, 154 bp, Homo sapiens
  misc_feature: GYAE6OF02HHQMM.29.26.C04.1.454.CMB.1.raw
  modified_base (154)..(154): a, c, t, g, unknown or other
  misc_feature (154)..(154): n is a, c, g, or t
tcagatagagtactcacgaccggtgctcgatttagtctagcgactttgggtttgggaaggtcagcgtcctaggtcagcccaaggccaaccccactgtcactctgttcccaccctcctctatacgatcgctgagcgggctggcaaggcgcatagn

SEQ ID NO: 159569 - DNA, 166 bp, Homo sapiens
  misc_feature: GYAE6OF02HV6CB.29.26.C04.1.454.CMB.1.raw
  modified_base (155)..(166): a, c, t, g, unknown or other
  misc_feature (155)..(166): n is a, c, g, or t
tcagatagagtactcacgaccggtgctcgatttagtctagcgactttgggtttgggaaggtcagcgtcctaggtcacgcccaaggccaacccactgtcactctgttcccaccctcctctactgctagtctgagcgggctggacaaggcgcatagnnnnnnnnnnnn

SEQ ID NO: 159570 - DNA, 154 bp, Homo sapiens; identical to SEQ ID NO: 159294
  misc_feature: GYAE6OF02F6R53.29.26.C04.1.454.CMB.1.raw
  modified_base (154)..(154): a, c, t, g, unknown or other
  misc_feature (154)..(154): n is a, c, g, or t

SEQ ID NO: 159571 - DNA, 158 bp, Homo sapiens
  misc_feature: GYAE6OF02F6OBU.29.26.C04.1.454.CMB.1.raw
  modified_base (149)..(158): a, c, t, g, unknown or other
  misc_feature (149)..(158): n is a, c, g, or t
tcagatagagtactcacgaccggtgctcgatttagtctagcgactttgggttggaaggtcagcgtcctaggtcagcccaaggccaacccactgtcactctgttcccgcctcctctactgctagtctgagcggctggcaaggcgcatagnnnnnnnnnn

SEQ ID NO: 159572 - DNA, 159 bp, Homo sapiens
  misc_feature: GYAE6OF02ICKWP.29.26.C04.1.454.CMB.1.raw
  modified_base (152)..(159): a, c, t, g, unknown or other
  misc_feature (152)..(159): n is a, c, g, or t
tcagatagagtactcacgaccggtgctcgatttagtctagcgactttgggtttgggaaggtcagcgtcctaggtcagcccaaggccaacccactgtcactctgttcccacctcctctactgctagtctgagcgggctggcaaggcgcatagnnnnnnnn

SEQ ID NO: 159573 - DNA, 155 bp, Homo sapiens; identical to SEQ ID NO: 159335
  misc_feature: GYAE6OF02GEGAX.29.26.C04.1.454.CMB.1.raw
  modified_base (154)..(155): a, c, t, g, unknown or other
  misc_feature (154)..(155): n is a, c, g, or t

SEQ ID NO: 159574 - DNA, 168 bp, Homo sapiens
  misc_feature: GYAE6OF02IS1U6.29.26.C04.1.454.CMB.1.raw
  modified_base (154)..(168): a, c, t, g, unknown or other
  misc_feature (154)..(168): n is a, c, g, or t
tcagatagagtactcacgaccggtgctcgatttagtctagcgactttgggttgggaaggtcagcgtcctaggtcagcccaaggccaaccccactgtccactctgttcccaccctcctctactgctagtctgagcgggctggcaaggcgcatagnnnnnnnnnnnnnnn

SEQ ID NO: 159575 - DNA, 155 bp, Homo sapiens; identical to SEQ ID NO: 159295
  misc_feature: GYAE6OF02IYL7I.29.26.C04.1.454.CMB.1.raw
  modified_base (154)..(155): a, c, t, g, unknown or other
  misc_feature (154)..(155): n is a, c, g, or t

SEQ ID NO: 159576 - DNA, 154 bp, Homo sapiens; identical to SEQ ID NO: 159294
  misc_feature: GYAE6OF02FHXMN.29.26.C04.1.454.CMB.1.raw
  modified_base (154)..(154): a, c, t, g, unknown or other
  misc_feature (154)..(154): n is a, c, g, or t

SEQ ID NO: 159577 - DNA, 177 bp, Homo sapiens
  misc_feature: GYAE6OF02GKTFP.29.26.C04.1.454.CMB.1.raw
  modified_base (155)..(177): a, c, t, g, unknown or other
  misc_feature (155)..(177): n is a, c, g, or t
tcagatagagtactcacgaccggtgctcgatttagtctagcgactttgggtttggggaagtcagcgtcctaggtcagcccaaggccaaccccagtgtcactctgttcccaccctcctctactgctagtcctgagcgggctggcaaggcgcatagnnnnnnnnnnnnnnnnnnnnnnn

SEQ ID NO: 159578 - DNA, 154 bp, Homo sapiens; identical to SEQ ID NO: 159294
  misc_feature: GYAE6OF02IJ31M.29.26.C04.1.454.CMB.1.raw
  modified_base (154)..(154): a, c, t, g, unknown or other
  misc_feature (154)..(154): n is a, c, g, or t

SEQ ID NO: 159579 - DNA, 158 bp, Homo sapiens; identical to SEQ ID NO: 159547
  misc_feature: GYAE6OF02GOJPX.29.26.C04.1.454.CMB.1.raw
  modified_base (152)..(158): a, c, t, g, unknown or other
  misc_feature (152)..(158): n is a, c, g, or t

SEQ ID NO: 159580 - DNA, 155 bp, Homo sapiens; identical to SEQ ID NO: 159295
  misc_feature: GYAE6OF02F48A8.29.26.C04.1.454.CMB.1.raw
  modified_base (154)..(155): a, c, t, g, unknown or other
  misc_feature (154)..(155): n is a, c, g, or t

SEQ ID NO: 159581 - DNA, 154 bp, Homo sapiens; identical to SEQ ID NO: 159318
  misc_feature: GYAE6OF02HL50H.29.26.C04.1.454.CMB.1.raw
  modified_base (153)..(154): a, c, t, g, unknown or other
  misc_feature (153)..(154): n is a, c, g, or t

SEQ ID NO: 159582 - DNA, 153 bp, Homo sapiens; identical to SEQ ID NO: 159382
  misc_feature: GYAE6OF02JDTH5.29.26.C04.1.454.CMB.1.raw
  modified_base (153)..(153): a, c, t, g, unknown or other
  misc_feature (153)..(153): n is a, c, g, or t

SEQ ID NO: 159583 - DNA, 199 bp, Homo sapiens
  misc_feature: GYAE6OF02GSRP3.29.26.C04.1.454.CMB.1.raw
  modified_base (152)..(199): a, c, t, g, unknown or other
  misc_feature (152)..(199): n is a, c, g, or t
tcagatagagtactcacgaccggtgctcgatttagtctagcgactttgggtttgggaaggtcagcgtcctaggtcagcccaaggccaacccactgtcactctgttcccacctcctctactgctagtctgagcgggctggcaaggcgcatagnnnnnnnnnnnnnnnnnnnnnnnnnnnnnnnnnnnnnnnnnnnnnnnn

SEQ ID NO: 159584 - DNA, 155 bp, Homo sapiens; identical to SEQ ID NO: 159295
  misc_feature: GYAE6OF02GQJO5.29.26.C04.1.454.CMB.1.raw
  modified_base (154)..(155): a, c, t, g, unknown or other
  misc_feature (154)..(155): n is a, c, g, or t

SEQ ID NO: 159585 - DNA, 177 bp, Homo sapiens
  misc_feature: GYAE6OF02I1KRF.29.26.C04.1.454.CMB.1.raw
  modified_base (151)..(177): a, c, t, g, unknown or other
  misc_feature (151)..(177): n is a, c, g, or t
tcagatagagtactcacgaccggtgctcgatttagtctagcgactttgggtttgggaaggtcagcgtcctaggtcagcccaaggccaacccatgtccactctgttccacctcctctactcgctagtctgagcggctggcaaggcgcatagnnnnnnnnnnnnnnnnnnnnnnnnnnn

SEQ ID NO: 159586 - DNA, 155 bp, Homo sapiens; identical to SEQ ID NO: 159439
  misc_feature: GYAE6OF02HRO8I.29.26.C04.1.454.CMB.1.raw
  modified_base (154)..(155): a, c, t, g, unknown or other
  misc_feature (154)..(155): n is a, c, g, or t

SEQ ID NO: 159587 - DNA, 200 bp, Homo sapiens
  misc_feature: GYAE6OF02I345H.29.26.C04.1.454.CMB.1.raw
  modified_base (151)..(200): a, c, t, g, unknown or other
  misc_feature (151)..(200): n is a, c, g, or t
tcagatagagtactcacgaccggtgctcgatttagtctagcgactttgggtttgggaaggtcagcgtcctaggtcagcccaaggccaaccccatgtcactcggttcccgcctctctactgctagtctgagcgggctggcaaggcgcatagnnnnnnnnnnnnnnnnnnnnnnnnnnnnnnnnnnnnnnnnnnnnnnnnnn

SEQ ID NO: 159588 - DNA, 159 bp, Homo sapiens; identical to SEQ ID NO: 159572
  misc_feature: GYAE6OF02HO0WV.29.26.C04.1.454.CMB.1.raw
  modified_base (152)..(159): a, c, t, g, unknown or other
  misc_feature (152)..(159): n is a, c, g, or t

SEQ ID NO: 159589 - DNA, 153 bp, Homo sapiens; identical to SEQ ID NO: 159287
  misc_feature: GYAE6OF02FJXUG.29.26.C04.1.454.CMB.1.raw
  modified_base (153)..(153): a, c, t, g, unknown or other
  misc_feature (153)..(153): n is a, c, g, or t

SEQ ID NO: 159590 - DNA, 154 bp, Homo sapiens
  misc_feature: GYAE6OF02H83I2.29.26.C04.1.454.CMB.1.raw
  modified_base (153)..(154): a, c, t, g, unknown or other
  misc_feature (153)..(154): n is a, c, g, or t
tcagatagagtactcacgaccggtgctcgatttagtctagcgactttgggtttgggaaggtcagcgtcctaggtcagcccaaggccaaccccactgtcactctgttcccgcctcctctactgctagtctgagcgggctggcaaggcgcatagnn

SEQ ID NO: 159591 - DNA, 153 bp, Homo sapiens; identical to SEQ ID NO: 159287
  misc_feature: GYAE6OF02IENOL.29.26.C04.1.454.CMB.1.raw
  modified_base (153)..(153): a, c, t, g, unknown or other
  misc_feature (153)..(153): n is a, c, g, or t

SEQ ID NO: 159592 - DNA, 159 bp, Homo sapiens
  misc_feature: GYAE6OF02I3B02.29.26.C04.1.454.CMB.1.raw
  modified_base (153)..(159): a, c, t, g, unknown or other
  misc_feature (153)..(159): n is a, c, g, or t
tcagatagagtactcacgaccggtgctcgatttagtctagcgactttgggtttgggaaggtcagcgtcctaggtcagcccaaggccaacccactgtcactctgttctcgccctcctctactgctagtctgagcgggctggcaaggcgcatagnnnnnnn

SEQ ID NO: 159593 - DNA, 154 bp, Homo sapiens; identical to SEQ ID NO: 159294
  misc_feature: GYAE6OF02GEP29.29.26.C04.1.454.CMB.1.raw
  modified_base (154)..(154): a, c, t, g, unknown or other
  misc_feature (154)..(154): n is a, c, g, or t

SEQ ID NO: 159594 - DNA, 155 bp, Homo sapiens; identical to SEQ ID NO: 159295
  misc_feature: GYAE6OF02IS6VI.29.26.C04.1.454.CMB.1.raw
  modified_base (154)..(155): a, c, t, g, unknown or other
  misc_feature (154)..(155): n is a, c, g, or t

SEQ ID NO: 159595 - DNA, 155 bp, Homo sapiens; identical to SEQ ID NO: 159295
  misc_feature: GYAE6OF02G8J11.29.26.C04.1.454.CMB.1.raw
  modified_base (154)..(155): a, c, t, g, unknown or other
  misc_feature (154)..(155): n is a, c, g, or t

SEQ ID NO: 159596 - DNA, 154 bp, Homo sapiens
  misc_feature: GYAE6OF02GQS5H.29.26.C04.1.454.CMB.1.raw
  modified_base (152)..(154): a, c, t, g, unknown or other
  misc_feature (152)..(154): n is a, c, g, or t
tcagatagagtactcacgaccggtgctcgatttagtctagcgactttgggtttgggaaggtcagcgtcctaggtcagcccaaggccaacccactgtcactctgttcccacctcctctactgctagtctgagcgggctggcaaggcgcatagnnn

SEQ ID NO: 159597 - DNA, 154 bp, Homo sapiens; identical to SEQ ID NO: 159294
  misc_feature: GYAE6OF02GGJAH.29.26.C04.1.454.CMB.1.raw
  modified_base (154)..(154): a, c, t, g, unknown or other
  misc_feature (154)..(154): n is a, c, g, or t

SEQ ID NO: 159598 - DNA, 155 bp, Homo sapiens; identical to SEQ ID NO: 159436
  misc_feature: GYAE6OF02I6LF9.29.26.C04.1.454.CMB.1.raw
  modified_base (153)..(155): a, c, t, g, unknown or other
  misc_feature (153)..(155): n is a, c, g, or t

SEQ ID NO: 159599 - DNA, 195 bp, Homo sapiens
  misc_feature: GYAE6OF02H7ID7.29.26.C04.1.454.CMB.1.raw
  modified_base (143)..(143): a, c, t, g, unknown or other
  misc_feature (143)..(143): n is a, c, g, or t
  modified_base (149)..(195): a, c, t, g, unknown or other
  misc_feature (149)..(195): n is a, c, g, or t
tcagatagagtactcacgaccggtgctcgatttagtctagcgactttggtttgggaagtcagcgtcctaggtcagcccaaggccaacccactgtcactctgttcccgcctcctctactgctagtctgagcggctggcaaggcncatagnnnnnnnnnnnnnnnnnnnnnnnnnnnnnnnnnnnnnnnnnnnnnnn

SEQ ID NO: 159600 - DNA, 154 bp, Homo sapiens; identical to SEQ ID NO: 159294
  misc_feature: GYAE6OF02G9PUH.29.26.C04.1.454.CMB.1.raw
  modified_base (154)..(154): a, c, t, g, unknown or other
  misc_feature (154)..(154): n is a, c, g, or t

SEQ ID NO: 159601 - DNA, 161 bp, Homo sapiens
  misc_feature: GYAE6OF02F7HVH.29.26.C04.1.454.CMB.1.raw
  modified_base (154)..(161): a, c, t, g, unknown or other
  misc_feature (154)..(161): n is a, c, g, or t
tcagatagagtactcacgaccggtgctcgatttagtctagcgactttgggtttgggaaggtcagcgtcctaggtcagcccaaggccaaccccactgtcactctgttcccgccctcctctactgctagtctgagcgggctggcaaggcgcatagnnnnnnnn

SEQ ID NO: 159602 - DNA, 154 bp, Homo sapiens; identical to SEQ ID NO: 159318
  misc_feature: GYAE6OF02HF9ZL.29.26.C04.1.454.CMB.1.raw
  modified_base (153)..(154): a, c, t, g, unknown or other
  misc_feature (153)..(154): n is a, c, g, or t

SEQ ID NO: 159603 - DNA, 154 bp, Homo sapiens; identical to SEQ ID NO: 159294
  misc_feature: GYAE6OF02FGC4T.29.26.C04.1.454.CMB.1.raw
  modified_base (154)..(154): a, c, t, g, unknown or other
  misc_feature (154)..(154): n is a, c, g, or t

SEQ ID NO: 159604 - DNA, 154 bp, Homo sapiens; identical to SEQ ID NO: 159315
  misc_feature: GYAE6OF02HL8GW.29.26.C04.1.454.CMB.1.raw
  modified_base (154)..(154): a, c, t, g, unknown or other
  misc_feature (154)..(154): n is a, c, g, or t

SEQ ID NO: 159605 - DNA, 154 bp, Homo sapiens; identical to SEQ ID NO: 159315
  misc_feature: GYAE6OF02FHA1W.29.26.C04.1.454.CMB.1.raw
  modified_base (154)..(154): a, c, t, g, unknown or other
  misc_feature (154)..(154): n is a, c, g, or t

SEQ ID NO: 159606 - DNA, 153 bp, Homo sapiens; identical to SEQ ID NO: 159287
  misc_feature: GYAE6OF02HIEF4.29.26.C04.1.454.CMB.1.raw
  modified_base (153)..(153): a, c, t, g, unknown or other
  misc_feature (153)..(153): n is a, c, g, or t

SEQ ID NO: 159607 - DNA, 155 bp, Homo sapiens; identical to SEQ ID NO: 159295
  misc_feature: GYAE6OF02FSXKO.29.26.C04.1.454.CMB.1.raw
  modified_base (154)..(155): a, c, t, g, unknown or other
  misc_feature (154)..(155): n is a, c, g, or t

SEQ ID NO: 159608 - DNA, 155 bp, Homo sapiens
  misc_feature: GYAE6OF02I7312.29.26.C04.1.454.CMB.1.raw
  modified_base (154)..(155): a, c, t, g, unknown or other
  misc_feature (154)..(155): n is a, c, g, or t
tcagatagagtactcacgaccggtgctcgatttagtctagcgactttgggtttgggaaggtcagcgtcctaggtcagcccaaggccaaccccactgtcactctgttcccaccctcctctatacgatcgctgagcgggctggcaaggcgcatagnn

SEQ ID NO: 159609 - DNA, 153 bp, Homo sapiens; identical to SEQ ID NO: 159287
  misc_feature: GYAE6OF02H5IZZ.29.26.C04.1.454.CMB.1.raw
  modified_base (153)..(153): a, c, t, g, unknown or other
  misc_feature (153)..(153): n is a, c, g, or t

SEQ ID NO: 159610 - DNA, 155 bp, Homo sapiens; identical to SEQ ID NO: 159384
  misc_feature: GYAE6OF02I5RD6.29.26.C04.1.454.CMB.1.raw
  modified_base (152)..(155): a, c, t, g, unknown or other
  misc_feature (152)..(155): n is a, c, g, or t

SEQ ID NO: 159611 - DNA, 192 bp, Homo sapiens
  misc_feature: GYAE6OF02IFFXC.29.26.C04.1.454.CMB.1.raw
  modified_base (150)..(192): a, c, t, g, unknown or other
  misc_feature (150)..(192): n is a, c, g, or t
tcagatagagtactcacgaccggtgctcgatttagtctagcgactttgggtttggaaggtcagcgtcctaggtcagcccaaggccaacccactgtcactctgttcccacctcctctactgctagtctgagcggctggcaaggcgcatagnnnnnnnnnnnnnnnnnnnnnnnnnnnnnnnnnnnnnnnnnnn

SEQ ID NO: 159612 - DNA, 154 bp, Homo sapiens; identical to SEQ ID NO: 159294
  misc_feature: GYAE6OF02HCSF3.29.26.C04.1.454.CMB.1.raw
  modified_base (154)..(154): a, c, t, g, unknown or other
  misc_feature (154)..(154): n is a, c, g, or t

SEQ ID NO: 159613 - DNA, 154 bp, Homo sapiens; identical to SEQ ID NO: 159294
  misc_feature: GYAE6OF02G6CPJ.29.26.C04.1.454.CMB.1.raw
  modified_base (154)..(154): a, c, t, g, unknown or other
  misc_feature (154)..(154): n is a, c, g, or t

SEQ ID NO: 159614 - DNA, 154 bp, Homo sapiens; identical to SEQ ID NO: 159315
  misc_feature: GYAE6OF02GO78M.29.26.C04.1.454.CMB.1.raw
  modified_base (154)..(154): a, c, t, g, unknown or other
  misc_feature (154)..(154): n is a, c, g, or t

SEQ ID NO: 159615 - DNA, 154 bp, Homo sapiens; identical to SEQ ID NO: 159294
  misc_feature: GYAE6OF02G9CFX.29.26.C04.1.454.CMB.1.raw
  modified_base (154)..(154): a, c, t, g, unknown or other
  misc_feature (154)..(154): n is a, c, g, or t

SEQ ID NO: 159616 - DNA, 196 bp, Homo sapiens
  misc_feature: GYAE6OF02JF8QB.29.26.C04.1.454.CMB.1.raw
  modified_base (150)..(196): a, c, t, g, unknown or other
  misc_feature (150)..(196): n is a, c, g, or t
tcagatagagtactcacgaccggtgctcgatttagtctagcgactttgggtttgggaaggtcagcgtcctaggtcagcccaaggccaacccactgtcactctgttcccacctctctactgctagtctgagcggctggcaaggcgcatagnnnnnnnnnnnnnnnnnnnnnnnnnnnnnnnnnnnnnnnnnnnnnnn

SEQ ID NO: 159617 - DNA, 155 bp, Homo sapiens; identical to SEQ ID NO: 159295
  misc_feature: GYAE6OF02FI9IF.29.26.C04.1.454.CMB.1.raw
  modified_base (154)..(155): a, c, t, g, unknown or other
  misc_feature (154)..(155): n is a, c, g, or t

SEQ ID NO: 159618 - DNA, 218 bp, Homo sapiens
  misc_feature: GYAE6OF02GFBCU.29.26.C04.1.454.CMB.1.raw
  modified_base (154)..(218): a, c, t, g, unknown or other
  misc_feature (154)..(218): n is a, c, g, or t
tcagatagagtactcacgaccggtgctcgatttagtctagcgactttgggtttgggaaggtcagcgtcctaggtcagcccaaggccaaccccactgtcactctgttcccgccctcctctactgctagtctgagcgggctggcaaggcgcatagnnnnnnnnnnnnnnnnnnnnnnnnnnnnnnnnnnnnnnnnnnnnnnnnnnnnnnnnnnnnnnnnn

SEQ ID NO: 159619 - DNA, 188 bp, Homo sapiens
  misc_feature: GYAE6OF02G41HW.29.26.C04.1.454.CMB.1.raw
  modified_base (159)..(188): a, c, t, g, unknown or other
  misc_feature (159)..(188): n is a, c, g, or t
tcagatagagtactcacgaccggtgctcgatttagtctagcgactttgggtttgggtaagggtcagcgtcctaggtcagcccaaggccaaccccactgtcacgtctgttcccaccctccgtctactgctagtctgagcgggctggcaaggcgcataggnnnnnnnnnnnnnnnnnnnnnnnnnnnnnn

SEQ ID NO: 159620 - DNA, 178 bp, Homo sapiens
  misc_feature: GYAE6OF02HQZG6.29.26.C04.1.454.CMB.1.raw
  modified_base (154)..(178): a, c, t, g, unknown or other
  misc_feature (154)..(178): n is a, c, g, or t
tcagatagagtactcacgaccggtgctcgatttagtctagcgactttgggtttggggaaggtcagcgtcctaggtcagcccaaggccaacccactgtcactctcgttcccgcctcctctactgctagtctgagcgggctggcaaggcgcatagnnnnnnnnnnnnnnnnnnnnnnnnn

SEQ ID NO: 159621 - DNA, 190 bp, Homo sapiens
  misc_feature: GYAE6OF02HGWVH.29.26.C04.1.454.CMB.1.raw
  modified_base (148)..(190): a, c, t, g, unknown or other
  misc_feature (148)..(190): n is a, c, g, or t
tcagatagagtactcacgaccggtgctcgatttagtctagcgactttgggttggaaggtcagcgtcctaggtcagcccaaggccaacccactgtcactctgttcccacctcctctactgctagtctgagcggctggcaaggcgcatgnnnnnnnnnnnnnnnnnnnnnnnnnnnnnnnnnnnnnnnnnnn

SEQ ID NO: 159622 - DNA, 153 bp, Homo sapiens; identical to SEQ ID NO: 159291
  misc_feature: GYAE6OF02FLFFM.29.26.C04.1.454.CMB.1.raw
  modified_base (152)..(153): a, c, t, g, unknown or other
  misc_feature (152)..(153): n is a, c, g, or t

SEQ ID NO: 159623 - DNA, 154 bp, Homo sapiens
  misc_feature: GYAE6OF02FTCR6.29.26.C04.1.454.CMB.1.raw
  modified_base (154)..(154): a, c, t, g, unknown or other
  misc_feature (154)..(154): n is a, c, g, or t
tcagatagagtactcacgaccggtgctcgatttagtctagcgactttgggtttgggaaggtcagcgtcctaggtcagcccaaggccaaccccactgtcactctgttcctaccctcctccgtgtctgatctgagcgggctggcaaggcgcatagn

SEQ ID NO: 159624 - DNA, 179 bp, Homo sapiens
  misc_feature: GYAE6OF02FFFX7.29.26.C04.1.454.CMB.1.raw
  modified_base (148)..(148): a, c, t, g, unknown or other
  misc_feature (148)..(148): n is a, c, g, or t
  modified_base (153)..(179): a, c, t, g, unknown or other
  misc_feature (153)..(179): n is a, c, g, or t
tcagatagagtactcacgaccggtgctcgatttagtctagcgactttgggtttgggaaggtcagcgtcctaggtcagcccaaggccaacccactgtcactctgttcccacctcctctactcgctagtctgagcgggctggcaaggcgnatagnnnnnnnnnnnnnnnnnnnnnnnnnnn

SEQ ID NO: 159625 - DNA, 152 bp, Homo sapiens; identical to SEQ ID NO: 159302
  misc_feature: GYAE6OF02IKEJG.29.26.C04.1.454.CMB.1.raw
  modified_base (152)..(152): a, c, t, g, unknown or other
  misc_feature (152)..(152): n is a, c, g, or t

SEQ ID NO: 159626 - DNA, 164 bp, Homo sapiens
  misc_feature: GYAE6OF02F7TKV.29.26.C04.1.454.CMB.1.raw
  modified_base (154)..(164): a, c, t, g, unknown or other
  misc_feature (154)..(164): n is a, c, g, or t
tcagatagagtactcacgaccggtgctcgatttagtctagcgactttgggtttgggaaggtcagcgtcctaggtcagcccaaggccaaccccactgtcactctgttcccaccctcctctactgctagtctgagcgggctggcaaggcgcatagnnnnnnnnnnn

SEQ ID NO: 159627 - DNA, 227 bp, Homo sapiens
  misc_feature: GYAE6OF02IINTD.29.26.C04.1.454.CMB.1.raw
  modified_base (152)..(227): a, c, t, g, unknown or other
  misc_feature (152)..(227): n is a, c, g, or t
tcagatagagtactcacgaccggtgctcgatttagtctagcgactttgggtttgggaaggtcagcgtcctaggtcagcccaaggccaaccccatgtcactctgttcccacctcctctactgctagtctgagcgggctggcaaggcgcatagnnnnnnnnnnnnnnnnnnnnnnnnnnnnnnnnnnnnnnnnnnnnnnnnnnnnnnnnnnnnnnnnnnnnnnnnnnnn

SEQ ID NO: 159628 - DNA, 155 bp, Homo sapiens; identical to SEQ ID NO: 159404
  misc_feature: GYAE6OF02HEU0I.29.26.C04.1.454.CMB.1.raw
  modified_base (154)..(155): a, c, t, g, unknown or other
  misc_feature (154)..(155): n is a, c, g, or t

SEQ ID NO: 159629 - DNA, 154 bp, Homo sapiens; identical to SEQ ID NO: 159416
  misc_feature: GYAE6OF02I3AI3.29.26.C04.1.454.CMB.1.raw
  modified_base (153)..(154): a, c, t, g, unknown or other
  misc_feature (153)..(154): n is a, c, g, or t

SEQ ID NO: 159630 - DNA, 154 bp, Homo sapiens; identical to SEQ ID NO: 159294
  misc_feature: GYAE6OF02FR73C.29.26.C04.1.454.CMB.1.raw
  modified_base (154)..(154): a, c, t, g, unknown or other
  misc_feature (154)..(154): n is a, c, g, or t

SEQ ID NO: 159631 - DNA, 154 bp, Homo sapiens; identical to SEQ ID NO: 159294
  misc_feature: GYAE6OF02HS9ES.29.26.C04.1.454.CMB.1.raw
  modified_base (154)..(154): a, c, t, g, unknown or other
  misc_feature (154)..(154): n is a, c, g, or t

SEQ ID NO: 159632 - DNA, 156 bp, Homo sapiens
  misc_feature: GYAE6OF02G04OI.29.26.C04.1.454.CMB.1.raw
  modified_base (153)..(156): a, c, t, g, unknown or other
  misc_feature (153)..(156): n is a, c, g, or t
tcagatagagtactcacgaccggtgctcgatttagtctagcgactttgggtttgggaaggtcagcgtcctaggtcagcccaaggccaacccactgtcactctgttcccaccctcctctactgctagtctgagcgggctggcaaggcgcatagnnnn

SEQ ID NO: 159633 - DNA, 154 bp, Homo sapiens; identical to SEQ ID NO: 159294
  misc_feature: GYAE6OF02F1T9I.29.26.C04.1.454.CMB.1.raw
  modified_base (154)..(154): a, c, t, g, unknown or other
  misc_feature (154)..(154): n is a, c, g, or t

SEQ ID NO: 159634 - DNA, 156 bp, Homo sapiens; identical to SEQ ID NO: 159378
  misc_feature: GYAE6OF02FMCRW.29.26.C04.1.454.CMB.1.raw
  modified_base (154)..(156): a, c, t, g, unknown or other
  misc_feature (154)..(156): n is a, c, g, or t

SEQ ID NO: 159635 - DNA, 156 bp, Homo sapiens; identical to SEQ ID NO: 159401
  misc_feature: GYAE6OF02GLX05.29.26.C04.1.454.CMB.1.raw
  modified_base (154)..(156): a, c, t, g, unknown or other
  misc_feature (154)..(156): n is a, c, g, or t

SEQ ID NO: 159636 - DNA, 197 bp, Homo sapiens
  misc_feature: GYAE6OF02HO1QR.29.26.C04.1.454.CMB.1.raw
  modified_base (145)..(145): a, c, t, g, unknown or other
  misc_feature (145)..(145): n is a, c, g, or t
  modified_base (150)..(197): a, c, t, g, unknown or other
  misc_feature (150)..(197): n is a, c, g, or t
tcagatagagtactcacgaccggtgctcgatttagtctagcgactttgggtttggaagtcagcgtcctaggtcagcccaaggccaaccccactgtccactctgttcccgcctcctctactgctagtctgagcggctggcaaggcncatgnnnnnnnnnnnnnnnnnnnnnnnnnnnnnnnnnnnnnnnnnnnnnnnn

SEQ ID NO: 159637 - DNA, 155 bp, Homo sapiens; identical to SEQ ID NO: 159295
  misc_feature: GYAE6OF02IRSAM.29.26.C04.1.454.CMB.1.raw
  modified_base (154)..(155): a, c, t, g, unknown or other
  misc_feature (154)..(155): n is a, c, g, or t

SEQ ID NO: 159638 - DNA, 155 bp, Homo sapiens; identical to SEQ ID NO: 159295
  misc_feature: GYAE6OF02F1W5J.29.26.C04.1.454.CMB.1.raw
  modified_base (154)..(155): a, c, t, g, unknown or other
  misc_feature (154)..(155): n is a, c, g, or t

SEQ ID NO: 159639 - DNA, 154 bp, Homo sapiens; identical to SEQ ID NO: 159294
  misc_feature: GYAE6OF02GXT57.29.26.C04.1.454.CMB.1.raw
  modified_base (154)..(154): a, c, t, g, unknown or other
  misc_feature (154)..(154): n is a, c, g, or t

SEQ ID NO: 159640 - DNA, 155 bp, Homo sapiens; identical to SEQ ID NO: 159295
  misc_feature: GYAE6OF02F9CBC.29.26.C04.1.454.CMB.1.raw
  modified_base (154)..(155): a, c, t, g, unknown or other
  misc_feature (154)..(155): n is a, c, g, or t

SEQ ID NO: 159641 - DNA, 156 bp, Homo sapiens; identical to SEQ ID NO: 159378
  misc_feature: GYAE6OF02IWQ3M.29.26.C04.1.454.CMB.1.raw
  modified_base (154)..(156): a, c, t, g, unknown or other
  misc_feature (154)..(156): n is a, c, g, or t

SEQ ID NO: 159642 - DNA, 155 bp, Homo sapiens; identical to SEQ ID NO: 159295
  misc_feature: GYAE6OF02HXEAL.29.26.C04.1.454.CMB.1.raw
  modified_base (154)..(155): a, c, t, g, unknown or other
  misc_feature (154)..(155): n is a, c, g, or t

SEQ ID NO: 159643 - DNA, 197 bp, Homo sapiens
  misc_feature: GYAE6OF02FN8RC.29.26.C04.1.454.CMB.1.raw
  modified_base (151)..(197): a, c, t, g, unknown or other
  misc_feature (151)..(197): n is a, c, g, or t
tcagatagagtactcacgaccggtgctcgatttagtctagcgactttgggtttggaaggtcagcgtcctaggtcagcccaaggccaacccactgtcactctgttcccgcctcctctactgctagtctgagcgggctggcaaggcgcatagnnnnnnnnnnnnnnnnnnnnnnnnnnnnnnnnnnnnnnnnnnnnnnn

SEQ ID NO: 159644 - DNA, 155 bp, Homo sapiens; identical to SEQ ID NO: 159295
  misc_feature: GYAE6OF02G1BFN.29.26.C04.1.454.CMB.1.raw
  modified_base (154)..(155): a, c, t, g, unknown or other
  misc_feature (154)..(155): n is a, c, g, or t

SEQ ID NO: 159645 - DNA, 153 bp, Homo sapiens; identical to SEQ ID NO: 159291
  misc_feature: GYAE6OF02IHEK6.29.26.C04.1.454.CMB.1.raw
  modified_base (152)..(153): a, c, t, g, unknown or other
  misc_feature (152)..(153): n is a, c, g, or t

SEQ ID NO: 159646 - DNA, 205 bp, Homo sapiens
  misc_feature: GYAE6OF02F4IZD.29.26.C04.1.454.CMB.1.raw
  modified_base (151)..(205): a, c, t, g, unknown or other
  misc_feature (151)..(205): n is a, c, g, or t
tcagatagagtactcacgaccggtgctcgatttagtctagcgactttgggtttggaaggtcagcgtcctaggtcagcccaaggccaacccactgtcactctgttcccacctcctctactgctagtctgagcgggctggcaaggcgcatagnnnnnnnnnnnnnnnnnnnnnnnnnnnnnnnnnnnnnnnnnnnnnnnnnnnnnnn

SEQ ID NO: 159647 - DNA, 153 bp, Homo sapiens; identical to SEQ ID NO: 159363
  misc_feature: GYAE6OF02FM5LS.29.26.C04.1.454.CMB.1.raw

SEQ ID NO: 159648 - DNA, 155 bp, Homo sapiens
  misc_feature: GYAE6OF02H6OSV.29.26.C04.1.454.CMB.1.raw
  modified_base (151)..(155): a, c, t, g, unknown or other
  misc_feature (151)..(155): n is a, c, g, or t
tcagatagagtactcacgaccggtgctcgatttagtctagcgactttgggtttgggaagtcagcgtcctaggtcagcccaaggccaacccatgtcactctgttcccaccctcctctactgctagtctgagcgggctggcaaggcgcatagnnnnn

SEQ ID NO: 159649 - DNA, 153 bp, Homo sapiens; identical to SEQ ID NO: 159382
  misc_feature: GYAE6OF02HZ73S.29.26.C04.1.454.CMB.1.raw
  modified_base (153)..(153): a, c, t, g, unknown or other
  misc_feature (153)..(153): n is a, c, g, or t

SEQ ID NO: 159650 - DNA, 154 bp, Homo sapiens; identical to SEQ ID NO: 159416
  misc_feature: GYAE6OF02G2U1K.29.26.C04.1.454.CMB.1.raw
  modified_base (153)..(154): a, c, t, g, unknown or other
  misc_feature (153)..(154): n is a, c, g, or t

SEQ ID NO: 159651 - DNA, 155 bp, Homo sapiens; identical to SEQ ID NO: 159295
  misc_feature: GYAE6OF02GILYU.29.26.C04.1.454.CMB.1.raw
  modified_base (154)..(155): a, c, t, g, unknown or other
  misc_feature (154)..(155): n is a, c, g, or t

SEQ ID NO: 159652 - DNA, 154 bp, Homo sapiens; identical to SEQ ID NO: 159294
  misc_feature: GYAE6OF02H6P1X.29.26.C04.1.454.CMB.1.raw
  modified_base (154)..(154): a, c, t, g, unknown or other
  misc_feature (154)..(154): n is a, c, g, or t

SEQ ID NO: 159653 - DNA, 157 bp, Homo sapiens; identical to SEQ ID NO: 159395
  misc_feature: GYAE6OF02GZ3WV.29.26.C04.1.454.CMB.1.raw
  modified_base (154)..(157): a, c, t, g, unknown or other
  misc_feature (154)..(157): n is a, c, g, or t

SEQ ID NO: 159654 - DNA, 166 bp, Homo sapiens
  misc_feature: GYAE6OF02IZKR5.29.26.C04.1.454.CMB.1.raw
  modified_base (153)..(166): a, c, t, g, unknown or other
  misc_feature (153)..(166): n is a, c, g, or t
tcagatagagtactcacgaccggtgctcgatttagtctagcgactttgggtttgggaaggtcagcgtcctaggtcagcccaaggccaaccccactgtcactctgttcccacctcctctactgctagtctgagcgggctggcaaggcgcatagnnnnnnnnnnnnnn

SEQ ID NO: 159655 - DNA, 172 bp, Homo sapiens
  misc_feature: GYAE6OF02HNEFB.29.26.C04.1.454.CMB.1.raw
  modified_base (153)..(172): a, c, t, g, unknown or other
  misc_feature (153)..(172): n is a, c, g, or t
tcagatagagtactcacgaccggtgctcgatttagtctagcgactttgggtttgggaaggtcagcgtcctaggtcagcccaaggccaaccccactgtcactctgttcccgcctcctctactgctagtctgagcgggctggcaaggcgcatagnnnnnnnnnnnnnnnnnnnn

SEQ ID NO: 159656 - DNA, 154 bp, Homo sapiens; identical to SEQ ID NO: 159294
  misc_feature: GYAE6OF02H0PMA.29.26.C04.1.454.CMB.1.raw
  modified_base (154)..(154): a, c, t, g, unknown or other
  misc_feature (154)..(154): n is a, c, g, or t

SEQ ID NO: 159657 - DNA, 154 bp, Homo sapiens; identical to SEQ ID NO: 159294
  misc_feature: GYAE6OF02GCX10.29.26.C04.1.454.CMB.1.raw
  modified_base (154)..(154): a, c, t, g, unknown or other
  misc_feature (154)..(154): n is a, c, g, or t

SEQ ID NO: 159658 - DNA, 154 bp, Homo sapiens; identical to SEQ ID NO: 159315
  misc_feature: GYAE6OF02I8IEA.29.26.C04.1.454.CMB.1.raw
  modified_base (154)..(154): a, c, t, g, unknown or other
  misc_feature (154)..(154): n is a, c, g, or t

SEQ ID NO: 159659 - DNA, 201 bp, Homo sapiens
  misc_feature: GYAE6OF02I1NQB.29.26.C04.1.454.CMB.1.raw
  modified_base (160)..(160): a, c, t, g, unknown or other
  misc_feature (160)..(160): n is a, c, g, or t
  modified_base (162)..(201): a, c, t, g, unknown or other
  misc_feature (162)..(201): n is a, c, g, or t
tcagatagagtactcacgaccggtgctcgatttagtctagcgactttgggttgggaagggtcagcgtcctaggtctagcccaaggccgaaacccccactggtacacctctgttcccgcctcctctactgctagtctgagcgggctggcaaggcgcatagntnnnnnnnnnnnnnnnnnnnnnnnnnnnnnnnnnnnnnnnn

SEQ ID NO: 159660 - DNA, 153 bp, Homo sapiens; identical to SEQ ID NO: 159363
  misc_feature: GYAE6OF02FEDZ6.29.26.C04.1.454.CMB.1.raw

SEQ ID NO: 159661 - DNA, 177 bp, Homo sapiens
  misc_feature: GYAE6OF02GNIPX.29.26.C04.1.454.CMB.1.raw
  modified_base (158)..(177): a, c, t, g, unknown or other
  misc_feature (158)..(177): n is a, c, g, or t
tcagatagagtactcacgaccggtgctcgatttagtctagcgactttgggtttgggaaggtcaggcgtacctaggtccagcccaaggccaaccccactgtcactctgttcccaccctcctctactgctagtctgagcgggtctggcaaggcgcatagnnnnnnnnnnnnnnnnnnnn

SEQ ID NO: 159662 - DNA, 222 bp, Homo sapiens
  misc_feature: GYAE6OF02G6B7M.29.26.C04.1.454.CMB.1.raw
  modified_base (148)..(222): a, c, t, g, unknown or other
  misc_feature (148)..(222): n is a, c, g, or t
tcagatagagtactcacgaccggtgctcgatttagtctagcgactttgggttggaagtcagcgtcctaggtcagcccaaggccaacccactgtcactctgttcccacctcctctactgctagtctgagcggctggcaaggcgcatagnnnnnnnnnnnnnnnnnnnnnnnnnnnnnnnnnnnnnnnnnnnnnnnnnnnnnnnnnnnnnnnnnnnnnnnnnnn

SEQ ID NO: 159663 - DNA, 156 bp, Homo sapiens; identical to SEQ ID NO: 159378
  misc_feature: GYAE6OF02F0IMY.29.26.C04.1.454.CMB.1.raw
  modified_base (154)..(156): a, c, t, g, unknown or other
  misc_feature (154)..(156): n is a, c, g, or t

SEQ ID NO: 159664 - DNA, 122 bp, Homo sapiens
  misc_feature: GYAE6OF02I6NVD.29.26.C04.1.454.CMB.1.raw
  modified_base (122)..(122): a, c, t, g, unknown or other
  misc_feature (122)..(122): n is a, c, g, or t
tcagatagagtactcacgaccggtgctcgatttagtctagcgactttgggtttgggaaggtcgagcgtcctaggtcagcccaaggccaaccccactgtcactctgttcccacctctatgtcn

SEQ ID NO: 159665 - DNA, 156 bp, Homo sapiens
  misc_feature: GYAE6OF02GSIZ4.29.26.C04.1.454.CMB.1.raw
  modified_base (155)..(156): a, c, t, g, unknown or other
  misc_feature (155)..(156): n is a, c, g, or t
tcagatagagtactcacgaccggtgctcgatttagtctagcgactttgggtttgggaaggtcagcgtcctaggtcagcccaaggccaaccccactgtcactctgttcccaccctcctctatacgatcgcctgagcgggctggcaaggcgcatagnn

SEQ ID NO: 159666 - DNA, 214 bp, Homo sapiens
  misc_feature: GYAE6OF02H38ED.29.26.C04.1.454.CMB.1.raw
  modified_base (160)..(167): a, c, t, g, unknown or other
  misc_feature (160)..(167): n is a, c, g, or t
  modified_base (169)..(214): a, c, t, g, unknown or other
  misc_feature (169)..(214): n is a, c, g, or t
tcagatagagtactcacgaccggtgctcgatttagtctagcgactttgggtttggggaaggtcagcgtccctaggtcagcccaaggccaaccccactgtcactcctgttcccgccctccctctactgcctagtctgagcgggctgggcaaggcgcatagnnnnnnnncnnnnnnnnnnnnnnnnnnnnnnnnnnnnnnnnnnnnnnnnnnnnnn

SEQ ID NO: 159667 - DNA, 156 bp, Homo sapiens
  misc_feature: GYAE6OF02FXT50.29.26.C04.1.454.CMB.1.raw
  modified_base (154)..(156): a, c, t, g, unknown or other
  misc_feature (154)..(156): n is a, c, g, or t
tcagatagagtactcacgaccggtgctcgatttagtctagcgactttgggtttgggaaggtcagcgtcctaggtcagcccaaggccaaccccactgtcactctgttcccaccctcctctatacgatcgctgagcgggctggcaaggcgcatagnnn

SEQ ID NO: 159668 - DNA, 155 bp, Homo sapiens; identical to SEQ ID NO: 159436
  misc_feature: GYAE6OF02GFP0M.29.26.C04.1.454.CMB.1.raw
  modified_base (153)..(155): a, c, t, g, unknown or other
  misc_feature (153)..(155): n is a, c, g, or t

SEQ ID NO: 159669 - DNA, 153 bp, Homo sapiens; identical to SEQ ID NO: 159363
  misc_feature: GYAE6OF02HNPRH.29.26.C04.1.454.CMB.1.raw

SEQ ID NO: 159670 - DNA, 153 bp, Homo sapiens
  misc_feature: GYAE6OF02HOWJ3.29.26.C04.1.454.CMB.1.raw
  modified_base (153)..(153): a, c, t, g, unknown or other
  misc_feature (153)..(153): n is a, c, g, or t
tcagatagagtactcacgaccggtgctcgatttagtctagcgactttgggtttgggaaggtcagcgtcctaggtcagcccaaggccaacccactgtcactctgttcccaccctcctccgtgtctgatctgagcgggctggcaaggcgcatagn

SEQ ID NO: 159671 - DNA, 156 bp, Homo sapiens
  misc_feature: GYAE6OF02IQVVZ.29.26.C04.1.454.CMB.1.raw
  modified_base (153)..(156): a, c, t, g, unknown or other
  misc_feature (153)..(156): n is a, c, g, or t
tcagatagagtactcacgaccggtgctcgatttagtctagcgactttgggtttgggaaggtcagcgtcctaggtcagcccaaggccaacccactgtcactctgttcccaccctcctctgtcgagcgtctgagcgggctggcaaggcgcatagnnnn

SEQ ID NO: 159672 - DNA, 177 bp, Homo sapiens
  misc_feature: GYAE6OF02I3R4B.29.26.C04.1.454.CMB.1.raw
  modified_base (154)..(177): a, c, t, g, unknown or other
  misc_feature (154)..(177): n is a, c, g, or t
tcagatagagtactcacgaccggtgctcgatttagtctagcgactttgggtttgggaaggtcagcgtcctaggtcagcccaaggccaaccccactgtcactctgttcccaccctcctctactgctagtctgagcgggctggcaaggcgcatagnnnnnnnnnnnnnnnnnnnnnnnn

SEQ ID NO: 159673 - DNA, 156 bp, Homo sapiens; identical to SEQ ID NO: 159378
  misc_feature: GYAE6OF02G16LW.29.26.C04.1.454.CMB.1.raw
  modified_base (154)..(156): a, c, t, g, unknown or other
  misc_feature (154)..(156): n is a, c, g, or t

SEQ ID NO: 159674 - DNA, 156 bp, Homo sapiens; identical to SEQ ID NO: 159333
  misc_feature: GYAE6OF02HN2T1.29.26.C04.1.454.CMB.1.raw
  modified_base (154)..(156): a, c, t, g, unknown or other
  misc_feature (154)..(156): n is a, c, g, or t

SEQ ID NO: 159675 - DNA, 157 bp, Homo sapiens; identical to SEQ ID NO: 159544
  misc_feature: GYAE6OF02GCP2I.29.26.C04.1.454.CMB.1.raw
  modified_base (154)..(157): a, c, t, g, unknown or other
  misc_feature (154)..(157): n is a, c, g, or t

SEQ ID NO: 159676 - DNA, 157 bp, Homo sapiens; identical to SEQ ID NO: 159395
  misc_feature: GYAE6OF02G28SC.29.26.C04.1.454.CMB.1.raw
  modified_base (154)..(157): a, c, t, g, unknown or other
  misc_feature (154)..(157): n is a, c, g, or t

SEQ ID NO: 159677 - DNA, 155 bp, Homo sapiens; identical to SEQ ID NO: 159295
  misc_feature: GYAE6OF02G0J8D.29.26.C04.1.454.CMB.1.raw
  modified_base (154)..(155): a, c, t, g, unknown or other
  misc_feature (154)..(155): n is a, c, g, or t

SEQ ID NO: 159678 - DNA, 154 bp, Homo sapiens; identical to SEQ ID NO: 159403
  misc_feature: GYAE6OF02G0PBX.29.26.C04.1.454.CMB.1.raw
  modified_base (154)..(154): a, c, t, g, unknown or other
  misc_feature (154)..(154): n is a, c, g, or t

SEQ ID NO: 159679 - DNA, 188 bp, Homo sapiens
  misc_feature: GYAE6OF02F13F7.29.26.C04.1.454.CMB.1.raw
  modified_base (155)..(188): a, c, t, g, unknown or other
  misc_feature (155)..(188): n is a, c, g, or t
tcagatagagtactcacgaccggtgctcgatttagtctagcgactttgggtttgggaaggtcagcgtcctaggtcagcccaaggccaaccccactgtcactctgttcccgccctcctctactgctaggtctgagcgggctggcaaggcgcatagnnnnnnnnnnnnnnnnnnnnnnnnnnnnnnnnnn

SEQ ID NO: 159680 - DNA, 156 bp, Homo sapiens; identical to SEQ ID NO: 159378
  misc_feature: GYAE6OF02GTOE7.29.26.C04.1.454.CMB.1.raw
  modified_base (154)..(156): a, c, t, g, unknown or other
  misc_feature (154)..(156): n is a, c, g, or t

SEQ ID NO: 159681 - DNA, 154 bp, Homo sapiens; identical to SEQ ID NO: 159294
  misc_feature: GYAE6OF02GSSVF.29.26.C04.1.454.CMB.1.raw
  modified_base (154)..(154): a, c, t, g, unknown or other
  misc_feature (154)..(154): n is a, c, g, or t

SEQ ID NO: 159682 - DNA, 152 bp, Homo sapiens
  misc_feature: GYAE6OF02IAP09.29.26.C04.1.454.CMB.1.raw
  modified_base (152)..(152): a, c, t, g, unknown or other
  misc_feature (152)..(152): n is a, c, g, or t
tcagatagagtactcacgaccggtgctcgatttagtctagcgactttgggtttgggaaggtcagcgtcctaggtcagcccaaggccaacccactgtcactctgttcccaccctcctctgtcgagctctgagcgggctggcaaggcgcatagn

SEQ ID NO: 159683 - DNA, 154 bp, Homo sapiens; identical to SEQ ID NO: 159318
  misc_feature: GYAE6OF02H8U7O.29.26.C04.1.454.CMB.1.raw
  modified_base (153)..(154): a, c, t, g, unknown or other
  misc_feature (153)..(154): n is a, c, g, or t

SEQ ID NO: 159684 - DNA, 203 bp, Homo sapiens
  misc_feature: GYAE6OF02HUKL6.29.26.C04.1.454.CMB.1.raw
  modified_base (153)..(203): a, c, t, g, unknown or other
  misc_feature (153)..(203): n is a, c, g, or t
tcagatagagtactcacgaccggtgctcgatttagtctagcgactttgggtttgggaaggtcagcgtcctaggtcagcccaaggccaaccccactgtcactctgttcccacctcctctactgctagtctgagcgggctggcaaggcgcatagnnnnnnnnnnnnnnnnnnnnnnnnnnnnnnnnnnnnnnnnnnnnnnnnnnn

SEQ ID NO: 159685 - DNA, 176 bp, Homo sapiens
  misc_feature: GYAE6OF02IJMLR.29.26.C04.1.454.CMB.1.raw
  modified_base (155)..(176): a, c, t, g, unknown or other
  misc_feature (155)..(176): n is a, c, g, or t
tcagatagagtactcacgaccggtgctcgatttagtctagcgactttgggtttggggaaggtcagcgtcctaggtcagcccaaggccaaccccactgtcactctgttcccaccctcctctactgctagtctgagcgggctggcaaggcgcatagnnnnnnnnnnnnnnnnnnnnnn

SEQ ID NO: 159686 - DNA, 153 bp, Homo sapiens; identical to SEQ ID NO: 159292
  misc_feature: GYAE6OF02HLIAZ.29.26.C04.1.454.CMB.1.raw
  modified_base (153)..(153): a, c, t, g, unknown or other
  misc_feature (153)..(153): n is a, c, g, or t

SEQ ID NO: 159687 - DNA, 209 bp, Homo sapiens
  misc_feature: GYAE6OF02IN5LO.29.26.C04.1.454.CMB.1.raw
  modified_base (153)..(209): a, c, t, g, unknown or other
  misc_feature (153)..(209): n is a, c, g, or t
tcagatagagtactcacgaccggtgctcgatttagtctagcgactttgggtttgggaaggtcagcgtcctaggtcagcccaaggccaaccccactgtcactctgttcccacctcctctactgctagtctgagcgggctggcaaggcgcatagnnnnnnnnnnnnnnnnnnnnnnnnnnnnnnnnnnnnnnnnnnnnnnnnnnnnnnnnn

SEQ ID NO: 159688 - DNA, 154 bp, Homo sapiens; identical to SEQ ID NO: 159294
  misc_feature: GYAE6OF02H2GXM.29.26.C04.1.454.CMB.1.raw
  modified_base (154)..(154): a, c, t, g, unknown or other
  misc_feature (154)..(154): n is a, c, g, or t

SEQ ID NO: 159689 - DNA, 158 bp, Homo sapiens
  misc_feature: GYAE6OF02IJU88.29.26.C04.1.454.CMB.1.raw
  modified_base (154)..(158): a, c, t, g, unknown or other
  misc_feature (154)..(158): n is a, c, g, or t
tcagatagagtactcacgaccggtgctcgatttagtctagcgactttgggtttgggaaggtcagcgtcctaggtcagcccaaggccaaccccactgtcactctgttcccgccctcctctgtcgagcgtctgagcgggctggcaaggcgcatagnnnnn

SEQ ID NO: 159690 - DNA, 156 bp, Homo sapiens; identical to SEQ ID NO: 159378
  misc_feature: GYAE6OF02G0HTP.29.26.C04.1.454.CMB.1.raw
  modified_base (154)..(156): a, c, t, g, unknown or other
  misc_feature (154)..(156): n is a, c, g, or t

SEQ ID NO: 159691 - DNA, 154 bp, Homo sapiens
  misc_feature: GYAE6OF02H5MQO.29.26.C04.1.454.CMB.1.raw
  modified_base (153)..(154): a, c, t, g, unknown or other
  misc_feature (153)..(154): n is a, c, g, or t
tcagatagagtactcacgaccggtgctcgatttagtctagcgactttgggtttgggaaggtcagcgtcctaggtcagcccaaggccaacccactgtcactctgttcccgccctcctctactgctagtctgagcgggctggcaaggcgcatagnn

SEQ ID NO: 159692 - DNA, 156 bp, Homo sapiens; identical to SEQ ID NO: 159378
  misc_feature: GYAE6OF02HEGYI.29.26.C04.1.454.CMB.1.raw
  modified_base (154)..(156): a, c, t, g, unknown or other
  misc_feature (154)..(156): n is a, c, g, or t

SEQ ID NO: 159693 - DNA, 156 bp, Homo sapiens; identical to SEQ ID NO: 159632
  misc_feature: GYAE6OF02HFCO6.29.26.C04.1.454.CMB.1.raw
  modified_base (153)..(156): a, c, t, g, unknown or other
  misc_feature (153)..(156): n is a, c, g, or t

SEQ ID NO: 159694 - DNA, 154 bp, Homo sapiens; identical to SEQ ID NO: 159294
  misc_feature: GYAE6OF02FG7PA.29.26.C04.1.454.CMB.1.raw
  modified_base (154)..(154): a, c, t, g, unknown or other
  misc_feature (154)..(154): n is a, c, g, or t

SEQ ID NO: 159695 - DNA, 154 bp, Homo sapiens; identical to SEQ ID NO: 159294
  misc_feature: GYAE6OF02GXBZK.29.26.C04.1.454.CMB.1.raw
  modified_base (154)..(154): a, c, t, g, unknown or other
  misc_feature (154)..(154): n is a, c, g, or t

SEQ ID NO: 159696 - DNA, 771 bp, Homo sapiens
  misc_feature: GYAE6OF02G3EBX.29.26.C04.1.454.CMB.1.raw
  modified_base (188)..(188): a, c, t, g, unknown or other
  misc_feature (188)..(188): n is a, c, g, or t
  modified_base (191)..(191): a, c, t, g, unknown or other
  misc_feature (191)..(191): n is a, c, g, or t
  modified_base (235)..(235): a, c, t, g, unknown or other
  misc_feature (235)..(235): n is a, c, g, or t
  modified_base (248)..(248): a, c, t, g, unknown or other
  misc_feature (248)..(248): n is a, c, g, or t
tcagatagagtactcacgaccggtgctcgatttagtctagcgactttgggtttgggtaagggtcgaagcgtcctaggtctaggccccaaggccgaaacccccactggtacaccctctgttcccgcctccttctaccttcgccttagtccttgagcggggccttcggacaaaggtccgccgaattaggntgngtgacacagtctccagcacctgtctttgtctaccaggggaaacncgccacctctccncggcgacggcctagtcgagtacgtacgtaacccaccgtagttacgccgtacgtaaccaaccacgaaccgttcggaccgacggtccgtacccgaccgtaccctacctacttcgttacgtacgtacgtactactaccgtacgtacgtacggtccgtacgtacggtaccgtaccgtaccgtaccgtaccgtacggttacgtacggtacggtacgtacggtacggtacggtacggacgtacgtacgtacgtaccgtaccgtacctacctacgtacgtacgacgacgtacgtacgacgtacgtacgtaacgttacgttacgttacgttacgtttacgttacgttacgttaacgtaactacgttaccgtaccgtaccggtaccggtaccggtacccgggtaccgttaccgttaccggtaccggtaccggtaaccgtaacgtacgtaacgtacgtacgtacgtacgtacggtcgtacgtacgtaccgtactacgtacgttactaccttacgtaccttaccgtaccgtacc

SEQ ID NO: 159697 - DNA, 154 bp, Homo sapiens; identical to SEQ ID NO: 159315
  misc_feature: GYAE6OF02F9BEV.29.26.C04.1.454.CMB.1.raw
  modified_base (154)..(154): a, c, t, g, unknown or other
  misc_feature (154)..(154): n is a, c, g, or t

SEQ ID NO: 159698 - DNA, 187 bp, Homo sapiens
  misc_feature: GYAE6OF02F6DR2.29.26.C04.1.454.CMB.1.raw
  modified_base (151)..(187): a, c, t, g, unknown or other
  misc_feature (151)..(187): n is a, c, g, or t
tcagatagagtactcacgaccggtgctcgatttagtctagcgactttgggtttgggaaggtcagcgtcctaggtcagcccaaggccaacccactgtcactctgttccgccctcctctactgctagtctgagcggctggcaaggcgcatagnnnnnnnnnnnnnnnnnnnnnnnnnnnnnnnnnnnnn

SEQ ID NO: 159699 - DNA, 200 bp, Homo sapiens
  misc_feature: GYAE6OF02FHDH8.29.26.C04.1.454.CMB.1.raw
  modified_base (146)..(146): a, c, t, g, unknown or other
  misc_feature (146)..(146): n is a, c, g, or t
  modified_base (152)..(200): a, c, t, g, unknown or other
  misc_feature (152)..(200): n is a, c, g, or t
tcagatagagtactcacgaccggtgctcgatttagtctagcgactttgggtttgggaaggtcagcgtcctaggtcagcccaaggccaaccccactgtcactctgttcccacctcctctactgctagtctgagcggctggcaaggcncatagnnnnnnnnnnnnnnnnnnnnnnnnnnnnnnnnnnnnnnnnnnnnnnnnn

SEQ ID NO: 159700 - DNA, 169 bp, Homo sapiens
  misc_feature: GYAE6OF02F2M1H.29.26.C04.1.454.CMB.1.raw
  modified_base (157)..(169): a, c, t, g, unknown or other
  misc_feature (157)..(169): n is a, c, g, or t
tcagatagagtactcacgaccggtgctcgatttagtctagcgactttgggtttgggaagggtcagtcgtcctaggtcagcccaaggccaaccccactgtcactctgttcccgccctcctctatgtatactctgagtcgggctggcaaggcgcatagnnnnnnnnnnnnn

SEQ ID NO: 159701 - DNA, 155 bp, Homo sapiens; identical to SEQ ID NO: 159295
  misc_feature: GYAE6OF02FPEA2.29.26.C04.1.454.CMB.1.raw
  modified_base (154)..(155): a, c, t, g, unknown or other
  misc_feature (154)..(155): n is a, c, g, or t

SEQ ID NO: 159702 - DNA, 168 bp, Homo sapiens
  misc_feature: GYAE6OF02GM3SA.29.26.C04.1.454.CMB.1.raw
  modified_base (156)..(168): a, c, t, g, unknown or other
  misc_feature (156)..(168): n is a, c, g, or t
tcagatagagtactcacgaccggtgctcgatttagtctagcgactttgggtttgggaagggtcgagcgtcctaggtcagcccaaggccaaccccactgtcactctgttcccaccctcctctactgctagtctgagcgggctggcaaggcgcatagnnnnnnnnnnnnn

SEQ ID NO: 159703 - DNA, 156 bp, Homo sapiens
  misc_feature: GYAE6OF02JA7BH.29.26.C04.1.454.CMB.1.raw
  modified_base (131)..(131): a, c, t, g, unknown or other
  misc_feature (131)..(131): n is a, c, g, or t
  modified_base (152)..(156): a, c, t, g, unknown or other
  misc_feature (152)..(156): n is a, c, g, or t
tcagatagagtactcacgaccggtgctcgatttagtctagcgactttgggtttgggaaggtcagcgtcctaggtcagcccaaggccaacccactgtcactctgttcccgcctcctctactgctagtctgancgggctggcaaggcgcatagnnnnn

SEQ ID NO: 159704 - DNA, 155 bp, Homo sapiens; identical to SEQ ID NO: 159295
  misc_feature: GYAE6OF02GWVIM.29.26.C04.1.454.CMB.1.raw
  modified_base (154)..(155): a, c, t, g, unknown or other
  misc_feature (154)..(155): n is a, c, g, or t

SEQ ID NO: 159705 - DNA, 153 bp, Homo sapiens; identical to SEQ ID NO: 159363
  misc_feature: GYAE6OF02IMUMU.29.26.C04.1.454.CMB.1.raw

SEQ ID NO: 159706 - DNA, 158 bp, Homo sapiens
  misc_feature: GYAE6OF02INOJX.29.26.C04.1.454.CMB.1.raw
  modified_base (151)..(158): a, c, t, g, unknown or other
  misc_feature (151)..(158): n is a, c, g, or t
tcagatagagtactcacgaccggtgctcgatttagtctagcgactttgggtttgggaaggtcagcgtcctaggtcagcccaaggccaacccactgtcactctgttcccacctcctctactgctagtctgagcggctggcaaggcgcatagnnnnnnnn

SEQ ID NO: 159707 - DNA, 210 bp, Homo sapiens
  misc_feature: GYAE6OF02HNWQX.29.26.C04.1.454.CMB.1.raw
  modified_base (151)..(210): a, c, t, g, unknown or other
  misc_feature (151)..(210): n is a, c, g, or t
tcagatagagtactcacgaccggtgctcgatttagtctagcgactttgggtttgggaaggtcagcgtcctaggtcagcccaaggccaacccactgtcactctgttcccacctcctctactgctagtctgagcgggctggcaaggcgcatgnnnnnnnnnnnnnnnnnnnnnnnnnnnnnnnnnnnnnnnnnnnnnnnnnnnnnnnnnnnn

SEQ ID NO: 159708 - DNA, 157 bp, Homo sapiens
  misc_feature: GYAE6OF02IA9PZ.29.26.C04.1.454.CMB.1.raw
  modified_base (153)..(157): a, c, t, g, unknown or other
  misc_feature (153)..(157): n is a, c, g, or t
tcagatagagtactcacgaccggtgctcgatttagtctagcgactttgggtttgggaaggtcagcgtcctaggtcagcccaaggccaacccactgtcactctgttcccaccctcctctactgctagtctgagcgggctggcaaggcgcatagnnnnn

SEQ ID NO: 159709 - DNA, 153 bp, Homo sapiens; identical to SEQ ID NO: 159497
  misc_feature: GYAE6OF02H8Y3S.29.26.C04.1.454.CMB.1.raw

SEQ ID NO: 159710 - DNA, 172 bp, Homo sapiens
  misc_feature: GYAE6OF02HO54F.29.26.C04.1.454.CMB.1.raw
  modified_base (152)..(172): a, c, t, g, unknown or other
  misc_feature (152)..(172): n is a, c, g, or t
tcagatagagtactcacgaccggtgctcgatttagtctagcgactttgggtttgggaaggtcagcgtcctaggtcagcccaaggccaacccactgtcactctgttcccacctcctctgtcgagcgtctgagcgggctggcaaggcgcatagnnnnnnnnnnnnnnnnnnnnn

SEQ ID NO: 159711 - DNA, 173 bp, Homo sapiens
  misc_feature: GYAE6OF02F4XW7.29.26.C04.1.454.CMB.1.raw
  modified_base (157)..(173): a, c, t, g, unknown or other
  misc_feature (157)..(173): n is a, c, g, or t
tcagatagagtactcacgaccggtgctcgatttagtctagcgactttgggtttggggaaggtcagcgtcctaggtcagcccaagggccaaccccactgtcactctggttcccaccctcctctactgctagtctgagcgggctggcaaggcgcatagnnnnnnnnnnnnnnnnn

SEQ ID NO: 159712 - DNA, 156 bp, Homo sapiens; identical to SEQ ID NO: 159378
  misc_feature: GYAE6OF02G7NSJ.29.26.C04.1.454.CMB.1.raw
  modified_base (154)..(156): a, c, t, g, unknown or other
  misc_feature (154)..(156): n is a, c, g, or t

SEQ ID NO: 159713 - DNA, 157 bp, Homo sapiens; identical to SEQ ID NO: 159395
  misc_feature: GYAE6OF02GUPFI.29.26.C04.1.454.CMB.1.raw
  modified_base (154)..(157): a, c, t, g, unknown or other
  misc_feature (154)..(157): n is a, c, g, or t

SEQ ID NO: 159714 - DNA, 155 bp, Homo sapiens
  misc_feature: GYAE6OF02FWAQ5.29.26.C04.1.454.CMB.1.raw
  modified_base (154)..(155): a, c, t, g, unknown or other
  misc_feature (154)..(155): n is a, c, g, or t
tcagatagagtactcacgaccggtgctcgatttagtctagcgactttgggtttgggaaggtcagcgtcctaggtcagcccaaggccaaccccactgtcactctgttcccaccctcctccgtgtctgatctgagcgggctggcaaggcgcatagnn

SEQ ID NO: 159715 - DNA, 160 bp, Homo sapiens
  misc_feature: GYAE6OF02JFRZ3.29.26.C04.1.454.CMB.1.raw
  modified_base (152)..(160): a, c, t, g, unknown or other
  misc_feature (152)..(160): n is a, c, g, or t
tcagatagagtactcacgaccggtgctcgatttagtctagcgactttgggtttgggaaggtcagcgtcctaggtcagcccaaggccaaccccactgtcactctgttcccacctcctctactgctagtctgagcggctggcaaggcgcatagnnnnnnnnn

SEQ ID NO: 159716 - DNA, 187 bp, Homo sapiens
  misc_feature: GYAE6OF02F4PGT.29.26.C04.1.454.CMB.1.raw
  modified_base (157)..(187): a, c, t, g, unknown or other
  misc_feature (157)..(187): n is a, c, g, or t
tcagatagagtactcacgaccggtgctcgatttagtctagcgactttgggtttggggaaggtcagcgtcctaggtcagcccaaggccaaccccactgtccactctgttcccgaccctcctctactgctagtctgagcgggctggcaaggcgcatagnnnnnnnnnnnnnnnnnnnnnnnnnnnnnnn

SEQ ID NO: 159717 - DNA, 157 bp, Homo sapiens; identical to SEQ ID NO: 159395
  misc_feature: GYAE6OF02G3RUR.29.26.C04.1.454.CMB.1.raw
  modified_base (154)..(157): a, c, t, g, unknown or other
  misc_feature (154)..(157): n is a, c, g, or t

SEQ ID NO: 159718 - DNA, 153 bp, Homo sapiens
  misc_feature: GYAE6OF02ISS8T.29.26.C04.1.454.CMB.1.raw
  modified_base (152)..(153): a, c, t, g, unknown or other
  misc_feature (152)..(153): n is a, c, g, or t
tcagatagagtactcacgaccggtgctcgatttagtctagcgactttgggttgggaaggtcagcgtcctaggtcagcccaaggccaacccactgtcactctgttcccaccctcctctactgctagtctgagcgggctggcaaggcgcatagnn

SEQ ID NO: 159719 - DNA, 205 bp, Homo sapiens
  misc_feature: GYAE6OF02JDF4A.29.26.C04.1.454.CMB.1.raw
  modified_base (151)..(205): a, c, t, g, unknown or other
  misc_feature (151)..(205): n is a, c, g, or t
tcagatagagtactcacgaccggtgctcgatttagtctagcgactttgggtttggaaggtcagcgtcctaggtcagcccaaggccaaccccactgtcactctgttcccacctcctctactgctagtctgagcggctggcaaggcgcatagnnnnnnnnnnnnnnnnnnnnnnnnnnnnnnnnnnnnnnnnnnnnnnnnnnnnnnn

SEQ ID NO: 159720 - DNA, 154 bp, Homo sapiens; identical to SEQ ID NO: 159416
  misc_feature: GYAE6OF02INTT1.29.26.C04.1.454.CMB.1.raw
  modified_base (153)..(154): a, c, t, g, unknown or other
  misc_feature (153)..(154): n is a, c, g, or t

SEQ ID NO: 159721 - DNA, 154 bp, Homo sapiens; identical to SEQ ID NO: 159315
  misc_feature: GYAE6OF02ILLNL.29.26.C04.1.454.CMB.1.raw
  modified_base (154)..(154): a, c, t, g, unknown or other
  misc_feature (154)..(154): n is a, c, g, or t

SEQ ID NO: 159722 - DNA, 154 bp, Homo sapiens; identical to SEQ ID NO: 159294
  misc_feature: GYAE6OF02HU800.29.26.C04.1.454.CMB.1.raw
  modified_base (154)..(154): a, c, t, g, unknown or other
  misc_feature (154)..(154): n is a, c, g, or t

SEQ ID NO: 159723 - DNA, 179 bp, Homo sapiens
  misc_feature: GYAE6OF02IGNJL.29.26.C04.1.454.CMB.1.raw
  modified_base (133)..(133): a, c, t, g, unknown or other
  misc_feature (133)..(133): n is a, c, g, or t
  modified_base (155)..(156): a, c, t, g, unknown or other
  misc_feature (155)..(156): n is a, c, g, or t
  modified_base (159)..(162): a, c, t, g, unknown or other
  misc_feature (159)..(162): n is a, c, g, or t
  modified_base (166)..(179): a, c, t, g, unknown or other
  misc_feature (166)..(179): n is a, c, g, or t
tcagatagagtactcacgaccggtgctcgatttagtctagcgacttgggtttgggaaggtcagcgtctaggtcagcccaaggccaacccactgtcactctgttcccaacctcctcgtacctgcctagtctgancgggctgggacaaggcgcatgnngtnnnntgannnnnnnnnnnnnn

SEQ ID NO: 159724 - DNA, 165 bp, Homo sapiens
  misc_feature: GYAE6OF02JU1RC.29.26.C04.1.454.CMB.1.raw
  modified_base (147)..(147): a, c, t, g, unknown or other
  misc_feature (147)..(147): n is a, c, g, or t
  modified_base (153)..(165): a, c, t, g, unknown or other
  misc_feature (153)..(165): n is a, c, g, or t
tcagatagagtactcacgaccggtgctcgatttagtctagcgactttgggtttgggaaggtcagcgtcctaggtcagcccaaggccaaccccactgtccactctgttcccgcctcctctactgctagtctgagcggctggcaaggcncatagnnnnnnnnnnnnn

SEQ ID NO: 159725 - DNA, 154 bp, Homo sapiens; identical to SEQ ID NO: 159294
  misc_feature: GYAE6OF02FNA6S.29.26.C04.1.454.CMB.1.raw
  modified_base (154)..(154): a, c, t, g, unknown or other
  misc_feature (154)..(154): n is a, c, g, or t

SEQ ID NO: 159726 - DNA, 163 bp, Homo sapiens
  misc_feature: GYAE6OF02GCCOA.29.26.C04.1.454.CMB.1.raw
  modified_base (154)..(163): a, c, t, g, unknown or other
  misc_feature (154)..(163): n is a, c, g, or t
tcagatagagtactcacgaccggtgctcgatttagtctagcgactttgggtttgggaaggtcagcgtcctaggtcagcccaaggccaaccccactgtcactctgttcccgccctcctctactgctagtctgagcgggctggcaaggcgcatagnnnnnnnnnn

SEQ ID NO: 159727 - DNA, 155 bp, Homo sapiens; identical to SEQ ID NO: 159295
  misc_feature: GYAE6OF02GCA7Z.29.26.C04.1.454.CMB.1.raw
  modified_base (154)..(155): a, c, t, g, unknown or other
  misc_feature (154)..(155): n is a, c, g, or t

SEQ ID NO: 159728 - DNA, 154 bp, Homo sapiens
  misc_feature: GYAE6OF02GTWM9.29.26.C04.1.454.CMB.1.raw
  modified_base (152)..(154): a, c, t, g, unknown or other
  misc_feature (152)..(154): n is a, c, g, or t
tcagatagagtactcacgaccggtgctcgatttagtctagcgactttgggtttgggaaggtcagcgtcctaggtcagcccaaggccaaccccatgtcactctgttcccacctcctctactgctagtctgagcgggctggcaaggcgcatagnnn

SEQ ID NO: 159729 - DNA, 207 bp, Homo sapiens
  misc_feature: GYAE6OF02FYKYN.29.26.C04.1.454.CMB.1.raw
  modified_base (151)..(151): a, c, t, g, unknown or other
  misc_feature (151)..(151): n is a, c, g, or t
  modified_base (157)..(163): a, c, t, g, unknown or other
  misc_feature (157)..(163): n is a, c, g, or t
  modified_base (165)..(207): a, c, t, g, unknown or other
  misc_feature (165)..(207): n is a, c, g, or t
tcagatagagtactcacgaccggtgctcgatttagtctagcgactttgggtttgggaaggtcagcgtccttaggtcagcccaaggtaccaaccccactgtcactctgttcccacctcctctgtcgagcgtctggagcgggctggcaaggcncatagnnnnnnntnnnnnnnnnnnnnnnnnnnnnnnnnnnnnnnnnnnnnnnnnnn

SEQ ID NO: 159730 - DNA, 153 bp, Homo sapiens; identical to SEQ ID NO: 159363
  misc_feature: GYAE6OF02G77WG.29.26.C04.1.454.CMB.1.raw

SEQ ID NO: 159731 - DNA, 130 bp, Homo sapiens
  misc_feature: GYAE6OF02JC29W.29.26.C04.1.454.CMB.1.raw
tcagatagagtactcacgaccggtgctcgatttagtctagcgactttgggtttgggaaggtcagcgtcctaggtcagcccaaggccaaccccactgtcactctgttcccaccctcctctactgctagtct

SEQ ID NO: 159732 - DNA, 217 bp, Homo sapiens
  misc_feature: GYAE6OF02F77J9.29.26.C04.1.454.CMB.1.raw
  modified_base (161)..(165): a, c, t, g, unknown or other
  misc_feature (161)..(165): n is a, c, g, or t
  modified_base (167)..(167): a, c, t, g, unknown or other
  misc_feature (167)..(167): n is a, c, g, or t
  modified_base (169)..(217): a, c, t, g, unknown or other
  misc_feature (169)..(217): n is a, c, g, or t
tcagatagagtactcacgaccggtgctcgatttagtctagcgactttgggtttggggtaagggtcagcgtcctaggtcagcccaaggcaaccccgactgtcacgtcctgttcccacctcctctacgtgcctagtctgagcgggctggcaaggccgcatagnnnnncngnnnnnnnnnnnnnnnnnnnnnnnnnnnnnnnnnnnnnnnnnnnnnnnnn

SEQ ID NO: 159733 - DNA, 160 bp, Homo sapiens
  misc_feature: GYAE6OF02ITLIY.29.26.C04.1.454.CMB.1.raw
  modified_base (152)..(160): a, c, t, g, unknown or other
  misc_feature (152)..(160): n is a, c, g, or t
tcagatagagtactcacgaccggtgctcgatttagtctagcgactttgggtttgggaaggtcagcgtcctaggtcagcccaaggccaaccccactgtcactctgttcccacctcctctactgctagtctgagcgggctggcaaggcgcatgnnnnnnnnn

SEQ ID NO: 159734 - DNA, 154 bp, Homo sapiens; identical to SEQ ID NO: 159294
  misc_feature: GYAE6OF02FOGXR.29.26.C04.1.454.CMB.1.raw
  modified_base (154)..(154): a, c, t, g, unknown or other
  misc_feature (154)..(154): n is a, c, g, or t

SEQ ID NO: 159735 - DNA, 156 bp, Homo sapiens
  misc_feature: GYAE6OF02H08SY.29.26.C04.1.454.CMB.1.raw
  modified_base (155)..(156): a, c, t, g, unknown or other
  misc_feature (155)..(156): n is a, c, g, or t
tcagatagagtactcacgaccggtgctcgatttagtctagcgactttgggtttgggaaggtcagcgtcctaggtcagcccaaggccaaccccactgtcactctgttcccacccctcctctatacgatcgctgagcgggctggcaaggcgcatagnn

SEQ ID NO: 159736 - DNA, 153 bp, Homo sapiens; identical to SEQ ID NO: 159363
  misc_feature: GYAE6OF02GWIZ0.29.26.C04.1.454.CMB.1.raw

SEQ ID NO: 159737 - DNA, 153 bp, Homo sapiens
  misc_feature: GYAE6OF02IHRNO.29.26.C04.1.454.CMB.1.raw
tcagatagagtactcacgaccggtgctcgatttagtctagcgactttgggtttgggaaggtcagcgtcctaggtcagcccaaggccaacccactgtcactctgttcccgccctcctctatacgatcgctgagcgggctggcaagggcgcatag

SEQ ID NO: 159738 - DNA, 158 bp, Homo sapiens; identical to SEQ ID NO: 159442
  misc_feature: GYAE6OF02G3ZPA.29.26.C04.1.454.CMB.1.raw
  modified_base (154)..(158): a, c, t, g, unknown or other
  misc_feature (154)..(158): n is a, c, g, or t

SEQ ID NO: 159739 - DNA, 157 bp, Homo sapiens
  misc_feature: GYAE6OF02GUBK6.29.26.C04.1.454.CMB.1.raw
  modified_base (155)..(157): a, c, t, g, unknown or other
  misc_feature (155)..(157): n is a, c, g, or t
tcagatagagtactcacgaccggtgctcgatttagtctagcgactttgggtttgggaaggtcagcgtcctaggtcagcccaaggccaaaccccactgtcactctgttcccaccctcctctactgctagtctgagcgggctggcaaggcgcatagnnn

SEQ ID NO: 159740 - DNA, 163 bp, Homo sapiens
  misc_feature: GYAE6OF02I05E8.29.26.C04.1.454.CMB.1.raw
  modified_base (147)..(147): a, c, t, g, unknown or other
  misc_feature (147)..(147): n is a, c, g, or t
  modified_base (152)..(163): a, c, t, g, unknown or other
  misc_feature (152)..(163): n is a, c, g, or t
tcagatagagtactcacgaccggtgctcgatttagtctagcgactttgggtttgggaaggtcagcgtcctaggtcagcccaaggccaaccccatgtcactctgttcccaccctcctctactgctagtctgagcggctggcaaggcgnatagnnnnnnnnnnnn

SEQ ID NO: 159741 - DNA, 159 bp, Homo sapiens; identical to SEQ ID NO: 159406
  misc_feature: GYAE6OF02F3JS5.29.26.C04.1.454.CMB.1.raw
  modified_base (154)..(159): a, c, t, g, unknown or other
  misc_feature (154)..(159): n is a, c, g, or t

SEQ ID NO: 159742 - DNA, 203 bp, Homo sapiens
  misc_feature: GYAE6OF02G0OBL.29.26.C04.1.454.CMB.1.raw
  modified_base (158)..(164): a, c, t, g, unknown or other
  misc_feature (158)..(164): n is a, c, g, or t
  modified_base (166)..(167): a, c, t, g, unknown or other
  misc_feature (166)..(167): n is a, c, g, or t
  modified_base (169)..(203): a, c, t, g, unknown or other
  misc_feature (169)..(203): n is a, c, g, or t
tcagatagagtactcacgaccggtgctcgatttagtctagcgactttgggtttgggaaggtcagcgtcctaggtcagcccaaggccaaccccatgtcactctggttccccgccctcctctactgcgtagtcctgagcgggctggcaagggcgcatagnnnnnnngnncnnnnnnnnnnnnnnnnnnnnnnnnnnnnnnnnnnn

SEQ ID NO: 159743 - DNA, 155 bp, Homo sapiens; identical to SEQ ID NO: 159295
  misc_feature: GYAE6OF02FS6KU.29.26.C04.1.454.CMB.1.raw
  modified_base (154)..(155): a, c, t, g, unknown or other
  misc_feature (154)..(155): n is a, c, g, or t

SEQ ID NO: 159744 - DNA, 157 bp, Homo sapiens; identical to SEQ ID NO: 159395
  misc_feature: GYAE6OF02F49BB.29.26.C04.1.454.CMB.1.raw
  modified_base (154)..(157): a, c, t, g, unknown or other
  misc_feature (154)..(157): n is a, c, g, or t

SEQ ID NO: 159745 - DNA, 154 bp, Homo sapiens; identical to SEQ ID NO: 159568
  misc_feature: GYAE6OF02HKTRW.29.26.C04.1.454.CMB.1.raw
  modified_base (154)..(154): a, c, t, g, unknown or other
  misc_feature (154)..(154): n is a, c, g, or t

SEQ ID NO: 159746 - DNA, 181 bp, Homo sapiens
  misc_feature: GYAE6OF02HDW7O.29.26.C04.1.454.CMB.1.raw
  modified_base (155)..(181): a, c, t, g, unknown or other
  misc_feature (155)..(181): n is a, c, g, or t
tcagatagagtactcacgaccggtgctcgatttagtctagcgactttgggtttgggaaggtcagcgttcctaggtcagcccaaggccaaccccactgtcactctgttcccgccctcctctactgctagtctgagcgggctggcaaggcgcatagnnnnnnnnnnnnnnnnnnnnnnnnnnn

SEQ ID NO: 159747 - DNA, 189 bp, Homo sapiens
  misc_feature: GYAE6OF02GSABN.29.26.C04.1.454.CMB.1.raw
  modified_base (155)..(189): a, c, t, g, unknown or other
  misc_feature (155)..(189): n is a, c, g, or t
tcagatagagtactcacgaccggtgctcgatttagtctagcgactttgggtttgggaaggtcagcgtcctaggtcagcccaaggccaaaccccactgtcactctgttcccaccctcctctactgctagtctgagcgggctggcaaggcgcatagnnnnnnnnnnnnnnnnnnnnnnnnnnnnnnnnnnn

SEQ ID NO: 159748 - DNA, 157 bp, Homo sapiens; identical to SEQ ID NO: 159395
  misc_feature: GYAE6OF02GXAPL.29.26.C04.1.454.CMB.1.raw
  modified_base (154)..(157): a, c, t, g, unknown or other
  misc_feature (154)..(157): n is a, c, g, or t

SEQ ID NO: 159749 - DNA, 156 bp, Homo sapiens; identical to SEQ ID NO: 159632
  misc_feature: GYAE6OF02IAZN2.29.26.C04.1.454.CMB.1.raw
  modified_base (153)..(156): a, c, t, g, unknown or other
  misc_feature (153)..(156): n is a, c, g, or t

SEQ ID NO: 159750 - DNA, 161 bp, Homo sapiens; identical to SEQ ID NO: 159479
  misc_feature: GYAE6OF02F08S7.29.26.C04.1.454.CMB.1.raw
  modified_base (154)..(161): a, c, t, g, unknown or other
  misc_feature (154)..(161): n is a, c, g, or t

SEQ ID NO: 159751 - DNA, 162 bp, Homo sapiens; identical to SEQ ID NO: 159520
  misc_feature: GYAE6OF02FH1PE.29.26.C04.1.454.CMB.1.raw
  modified_base (154)..(162): a, c, t, g, unknown or other
  misc_feature (154)..(162): n is a, c, g, or t

SEQ ID NO: 159752 - DNA, 163 bp, Homo sapiens
  misc_feature: GYAE6OF02JV32I.29.26.C04.1.454.CMB.1.raw
  modified_base (153)..(163): a, c, t, g, unknown or other
  misc_feature (153)..(163): n is a, c, g, or t
tcagatagagtactcacgaccggtgctcgatttagtctagcgactttgggtttgggaaggtcagcgtcctaggtcagcccaaggccaaccccatgtcactctgttcccaccctcctctactgctagtctgagcgggctggcaaggcgcatagnnnnnnnnnnn

SEQ ID NO: 159753 - DNA, 169 bp, Homo sapiens
  misc_feature: GYAE6OF02I3MCJ.29.26.C04.1.454.CMB.1.raw
  modified_base (147)..(147): a, c, t, g, unknown or other
  misc_feature (147)..(147): n is a, c, g, or t
  modified_base (153)..(169): a, c, t, g, unknown or other
  misc_feature (153)..(169): n is a, c, g, or t
tcagatagagtactcacgaccggtgctcgatttagtctagcgactttgggtttgggaaggtcagcgtcctaggtcagcccaaggccaaccccactgtcactctgttcccacctcctctactgctagtctgagcgggctggcaaggcncatagnnnnnnnnnnnnnnnnn

SEQ ID NO: 159754 - DNA, 158 bp, Homo sapiens
  misc_feature: GYAE6OF02HE16N.29.26.C04.1.454.CMB.1.raw
  modified_base (150)..(150): a, c, t, g, unknown or other
  misc_feature (150)..(150): n is a, c, g, or t
  modified_base (156)..(158): a, c, t, g, unknown or other
  misc_feature (156)..(158): n is a, c, g, or t
tcagatagagtactcacgaccggtgctcgatttagtctagcgactttgggtttgggaaggtcagcgtcctaggtcagcccaaggccaaccccactgtcactctgttcccgccctcctccgtgtctgatctgagcgggctggacaagggcncatagnnn

SEQ ID NO: 159755 - DNA, 156 bp, Homo sapiens; identical to SEQ ID NO: 159378
  misc_feature: GYAE6OF02F4GA9.29.26.C04.1.454.CMB.1.raw
  modified_base (154)..(156): a, c, t, g, unknown or other
  misc_feature (154)..(156): n is a, c, g, or t

SEQ ID NO: 159756 - DNA, 159 bp, Homo sapiens
  misc_feature: GYAE6OF02FN1ZQ.29.26.C04.1.454.CMB.1.raw
  modified_base (153)..(159): a, c, t, g, unknown or other
  misc_feature (153)..(159): n is a, c, g, or t
tcagatagagtactcacgaccggtgctcgatttagtctagcgactttgggtttgggaaggtcagcgtcctaggtcagcccaaggccaaccccactgtcactctgttcccacctcctctactgctagtctgagcgggctggcaaggcgcatagnnnnnnn

SEQ ID NO: 159757 - DNA, 156 bp, Homo sapiens; identical to SEQ ID NO: 159333
  misc_feature: GYAE6OF02G7X1C.29.26.C04.1.454.CMB.1.raw
  modified_base (154)..(156): a, c, t, g, unknown or other
  misc_feature (154)..(156): n is a, c, g, or t

SEQ ID NO: 159758 - DNA, 171 bp, Homo sapiens
  misc_feature: GYAE6OF02FWPRY.29.26.C04.1.454.CMB.1.raw
  modified_base (153)..(171): a, c, t, g, unknown or other
  misc_feature (153)..(171): n is a, c, g, or t
tcagatagagtactcacgaccggtgctcgatttagtctagcgactttgggtttgggaaggtcagcgtcctaggtcagcccaaggccaaccccactgtcactctgttcccacctcctctactgctagtctgagcgggctggcaaggcgcatagnnnnnnnnnnnnnnnnnnn

SEQ ID NO: 159759 - DNA, 168 bp, Homo sapiens
  misc_feature: GYAE6OF02I8ZG2.29.26.C04.1.454.CMB.1.raw
  modified_base (154)..(168): a, c, t, g, unknown or other
  misc_feature (154)..(168): n is a, c, g, or t
tcagatagagtactcacgaccggtgctcgatttagtctagcgactttgggtttgggaaggtcagcgtcctaggtcagcccaaggccaaccccactgtcactctgttcccaccctcctctactgctagtctgagcgggctggcaaggcgcatagnnnnnnnnnnnnnnn

SEQ ID NO: 159760 - DNA, 162 bp, Homo sapiens
  misc_feature: GYAE6OF02H1CLL.29.26.C04.1.454.CMB.1.raw
  modified_base (146)..(146): a, c, t, g, unknown or other
  misc_feature (146)..(146): n is a, c, g, or t
  modified_base (152)..(162): a, c, t, g, unknown or other
  misc_feature (152)..(162): n is a, c, g, or t
tcagatagagtactcacgaccggtgctcgatttagtctagcgactttggttgggaaggtcagcgtcctaggtcagcccaaggccaaccccactgtcactctgttcccaccctcctctactgctagtctgagcgggctggcaaggcncatagnnnnnnnnnnn

SEQ ID NO: 159761 - DNA, 166 bp, Homo sapiens
  misc_feature: GYAE6OF02I5ZX5.29.26.C04.1.454.CMB.1.raw
  modified_base (155)..(166): a, c, t, g, unknown or other
  misc_feature (155)..(166): n is a, c, g, or t
tcagatagagtactcacgaccggtgctcgatttagtctagcgactttgggtttgggaaggtcagcgtcctaggtcagcccaaggccaacccccactgtcactctgttcccaccctcctctatacgatcgctgagcgggctggcaaggcgcatagnnnnnnnnnnnn

SEQ ID NO: 159762 - DNA, 153 bp, Homo sapiens
  misc_feature: GYAE6OF02F9RGE.29.26.C04.1.454.CMB.1.raw
  modified_base (133)..(133): a, c, t, g, unknown or other
  misc_feature (133)..(133): n is a, c, g, or t
  modified_base (148)..(148): a, c, t, g, unknown or other
  misc_feature (148)..(148): n is a, c, g, or t
tcagatagagtactcacgaccggtgctcgatttagtctagcgactttgggtttgggaaggtcagcgtcctaggtcagcccaaggccaaccccactgtcactctgttcccaccctcctctactgctagtctgancgggctggcaaggcncatag

SEQ ID NO: 159763 - DNA, 164 bp, Homo sapiens
  misc_feature: GYAE6OF02JL6JL.29.26.C04.1.454.CMB.1.raw
  modified_base (154)..(164): a, c, t, g, unknown or other
  misc_feature (154)..(164): n is a, c, g, or t
tcagatagagtactcacgaccggtgctcgatttagtctagcgactttgggtttgggaaggtcagcgtcctaggtcagcccaaggccaaccccatgtcactctgttcccaccctcctctactgctagtctgagcgggctgggcaaggcgcatagnnnnnnnnnnn

SEQ ID NO: 159764 - DNA, 150 bp, Homo sapiens
  misc_feature: GYAE6OF02I79AX.29.26.C04.1.454.CMB.1.raw
  modified_base (139)..(150): a, c, t, g, unknown or other
  misc_feature (139)..(150): n is a, c, g, or t
tcagatagagtactcacgaccggtgctcgatttagtctagcgactttgggtttgggaagggtcagcgtcctaggtcagcccaaggccaaccccatgtcactctgttcccacctcctctactgctagtctgagcggctgnnnnnnnnnnnn

SEQ ID NO: 159765 - DNA, 187 bp, Homo sapiens
  misc_feature: GYAE6OF02IZZWW.29.26.C04.1.454.CMB.1.raw
  modified_base (155)..(156): a, c, t, g, unknown or other
  misc_feature (155)..(156): n is a, c, g, or t
  modified_base (159)..(187): a, c, t, g, unknown or other
  misc_feature (159)..(187): n is a, c, g, or t
tcagatagagtactcacgaccggtgctcgatttagtctagcgactttgggtttgggaaggtcagcgtcctaggtcagcccaaggccaaaccccatgtcactctgttccccacctcctctactgctagtctgagcgggctgggcaaggcgcatagnncannnnnnnnnnnnnnnnnnnnnnnnnnnnn

SEQ ID NO: 159766 - DNA, 158 bp, Homo sapiens
  misc_feature: GYAE6OF02FQFUF.29.26.C04.1.454.CMB.1.raw
  modified_base (154)..(158): a, c, t, g, unknown or other
  misc_feature (154)..(158): n is a, c, g, or t
tcagatagagtactcacgaccggtgctcgatttagtctagcgactttgggtttgggaaggtcagcgtcctaggtcagcccaaggccaaccccactgtcactctgttcccgccctcctctactgctagtctgagcgggctggcaaggcgcatagnnnnn

SEQ ID NO: 159767 - DNA, 164 bp, Homo sapiens; identical to SEQ ID NO: 159626
  misc_feature: GYAE6OF02F9W3W.29.26.C04.1.454.CMB.1.raw
  modified_base (154)..(164): a, c, t, g, unknown or other
  misc_feature (154)..(164): n is a, c, g, or t

SEQ ID NO: 159768 - DNA, 216 bp, Homo sapiens
  misc_feature: GYAE6OF02HWQYK.29.26.C04.1.454.CMB.1.raw
  modified_base (158)..(216): a, c, t, g, unknown or other
  misc_feature (158)..(216): n is a, c, g, or t
tcagatagagtactcacgaccggtgctcgatttagtctagcgactttgggtttgggaaggtcagcgtcctaggtcagcccaaggccaaccccactgtcaactctgttccccaccctcctctatacgatcgctgagcgggctgggcaaaggcgcaatgnnnnnnnnnnnnnnnnnnnnnnnnnnnnnnnnnnnnnnnnnnnnnnnnnnnnnnnnnnn

SEQ ID NO: 159769 - DNA, 170 bp, Homo sapiens
  misc_feature: GYAE6OF02GFFTJ.29.26.C04.1.454.CMB.1.raw
  modified_base (134)..(134): a, c, t, g, unknown or other
  misc_feature (134)..(134): n is a, c, g, or t
  modified_base (155)..(170): a, c, t, g, unknown or other
  misc_feature (155)..(170): n is a, c, g, or t
tcagatagagtactcacgaccggtgctcgatttagtctagcgactttgggtttgggaaggtcagcgtcctaggtcagcccaaggccaaccccactgtcactctgttccccaccctcctctactgctagtctgancgggctggcaaggcgcatagnnnnnnnnnnnnnnnn

SEQ ID NO: 159770 - DNA, 159 bp, Homo sapiens
  misc_feature: GYAE6OF02JDYE6.29.26.C04.1.454.CMB.1.raw
  modified_base (149)..(149): a, c, t, g, unknown or other
  misc_feature (149)..(149): n is a, c, g, or t
  modified_base (154)..(159): a, c, t, g, unknown or other
  misc_feature (154)..(159): n is a, c, g, or t
tcagatagagtactcacgaccggtgctcgatttagtctagcgactttgggtttgggaaggtcagcgtcctaggtcagcccaaggccaaccccactgtcactctgttcccaccctcctctactgcctagtctgagcggctggcaaggcgnatagnnnnnn

SEQ ID NO: 159771 - DNA, 216 bp, Homo sapiens
  misc_feature: GYAE6OF02IUJ8P.29.26.C04.1.454.CMB.1.raw
  modified_base (137)..(137): a, c, t, g, unknown or other
  misc_feature (137)..(137): n is a, c, g, or t
  modified_base (159)..(216): a, c, t, g, unknown or other
  misc_feature (159)..(216): n is a, c, g, or t
tcagatagagtactcacgaccggtgctcgatttagtctagcgactttgggtttgggaaggtcagcgtcctaggtcagcccaaggccaaccccactgtcactctgttccccaccctcctctactgctagtctggacgngggctgggcaaggcgcaatagnnnnnnnnnnnnnnnnnnnnnnnnnnnnnnnnnnnnnnnnnnnnnnnnnnnnnnnnnn

SEQ ID NO: 159772 - DNA, 154 bp, Homo sapiens
  misc_feature: GYAE6OF02HRD3Z.29.26.C04.1.454.CMB.1.raw
  modified_base (154)..(154): a, c, t, g, unknown or other
  misc_feature (154)..(154): n is a, c, g, or t
tcagatagagtactcacgaccggtgctcgatttagtctagcgactttgggtttgggaaggtcagcgtcctaggtcagcccaaggccaaccccactgtcactctgttcccgccctcctccgtgtctgatctgagcgggctggcaaggcgcatagn

SEQ ID NO: 159773 - DNA, 192 bp, Homo sapiens
  misc_feature: GYAE6OF02GU6VO.29.26.C04.1.454.CMB.1.raw
  modified_base (149)..(149): a, c, t, g, unknown or other
  misc_feature (149)..(149): n is a, c, g, or t
  modified_base (155)..(192): a, c, t, g, unknown or other
  misc_feature (155)..(192): n is a, c, g, or t
tcagatagagtactcacgaccggtgctcgatttagtctagcgactttgggtttgggaaggtcagcgtcctaggtcagcccaaggccaaccccactgtcactctgttcccaccctcctctactgctagtctgagcgggctggcaagggcncatagnnnnnnnnnnnnnnnnnnnnnnnnnnnnnnnnnnnnnn

SEQ ID NO: 159774 - DNA, 493 bp, Homo sapiens
  misc_feature: GYAE6OF01DC7W7.19.83.H06.1.454.CMB.1.raw
  modified_base (491)..(491): a, c, t, g, unknown or other
  misc_feature (491)..(491): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtatccacagctcctgatctattttgggttctaatcgggcctccggggtccctgacaggttcagtggcagtggatcaggcacagattttacactgaaatcaacagagtggaggctgaggatgttggggttattactgcatgcaagctctacaaactccctcaacgttcggacggagggaccaaggtgagatcaaacgatgtggctgcacatctgtcttnac

SEQ ID NO: 159775 - DNA, 517 bp, Homo sapiens
  misc_feature: GYAE6OF01CTOHC.19.83.H06.1.454.CMB.1.raw
  modified_base (420)..(420): a, c, t, g, unknown or other
  misc_feature (420)..(420): n is a, c, g, or t
  modified_base (512)..(512): a, c, t, g, unknown or other
  misc_feature (512)..(512): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactattggattggtacctgcagaagccagggcagtctccacagctcctgatctatttgggttctaatcgggcctccggggtccctgacgaggttcagtggcagtggatcaggcacagattttacactagaaatcaacagagtggaggctggaggagtggttggggtttaattactgcatganaagctctaacaactcctacaacgttcggacggaggacgaacggtaggagatacgaaacgaataggtcggcgtgactaccgatactgtcgttntaccg

SEQ ID NO: 159776 - DNA, 496 bp, Homo sapiens
  misc_feature: GYAE6OF01DXZXJ.19.83.H06.1.454.CMB.1.raw
  modified_base (415)..(415): a, c, t, g, unknown or other
  misc_feature (415)..(415): n is a, c, g, or t
  modified_base (434)..(434): a, c, t, g, unknown or other
  misc_feature (434)..(434): n is a, c, g, or t
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggttctaatcgggcctccggggtcctgacaggttcagtggcagtggatcaggcacagtattttacactgaaaatcaacagagtggaggctgaggatgttggggtttattactgcatgnaagctctacaactccctanaacgttcgacggaggacaggtggagatacgaaacgaatggtggctgcaccatctgtctctac

SEQ ID NO: 159777 - DNA, 591 bp, Homo sapiens
  misc_feature: GYAE6OF01CSD68.19.83.H06.1.454.CMB.1.raw
tcagtactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttggtctaagtcgggcctccggggtcctgacaggttcagtggcagtgatcgaggcacagtattttacactagaaatcaacagagtggagctgaggtatggttgggtttattacgtgctagtgacaagtctacctaacgtaaacctccccgtacgtaaccggtttcgggaccgggacgggaacccgtaaagggtacgggaaacggtaagtaacccggtaaaaacggtaacgttaggtacgggtaccgttacgaccgtaacccgtaattcccgttacggttccctttaccgttaacccg
